United States Patent 9,487,797 (GENOMIC PLANT SEQUENCES AND USES THEREOF) - sequence listing, part 9

SEQ ID NO: 17811 - DNA, 1501 bp, Oryza sativa
gttgaactatgagcttcctagactttcggtggtgcggtcgtcatagacgtcaaaagagctgagaaagttggcaatctccgtgtccgaacaagatccgagtggttggagcgtgacgcccatctccctgaagcccaatctaggcgaagccgaagcttgctcagatcgggacctaaggggatagacagatccagattcgaacgtggcagagggggaagttgcatgatgacctgaggatatgcactggtgatggtggaaagattgcgagggcgcactgatgtagatgaatcccccgagtggtttgaagccagcctagaagataaagtgttggagtacatctcggcggaatttggtaagccaaacggtgccgagtggtcacgacctcttccccgactagttcgaatccgagtcaagaagagagatgttgccgaagttgtcagtgatgaagtcgagactgccaaagcggtaggcctgccctggagggaaggagaaggagttgactcctggagtagaacccatcgtacttgtcgacggaaaactcgacgcaacccctacctggcgcgccaattgtcgatactaggaatcgacaatatgaaaagggggtagtgcacgagagctaaagtagatgggtggaaagacaagggtttaggcaggttcaggccctcttgacgaaaagtaatactgactcttgtttagggatttgactccaccgaatattgtattgatctgacgacctttagtgtggttatgccctcaagaggcctcttgcccaccttatatagatcgggagcggattacagatacaaacctaaccgaatagagaatatattttacgatattcccgattaagactttaaaccgtttccttaatactcaaggaaacgtaatacccaagtcataatccgttacatattttagagatataacatatcccctataatcagtcgaataaactagccgtacgtgtaggtatatggtactcataatctccacaacaagtttgctcggttcgctctacatggatgcagaccgcagtgagttcacattgtcgatggtggatatccgtagaccggataaatagggtatttggatacattggtacgaggatctacacgatacgacatcaagcaaacaagaagacaaggattatactggtttaagtcccttgtaaggtaatagccctaatccaatttatatgagattgatatggaaagaccacatattacaatagagaattgatgatctcgagattaacggcgagatccctatcgagatgggttcgatgagatctcccgacgagtatgtttcgcgtcatccggattgtaggctatggtggttgtattggtgctatgattcaatgatccagacccttaggggtgtgtcttttttatatcgtaagtcaccttagtctgtaagtagaactcgaagacaactgaccctccacaatatagtataaacccaatcctttctgagtaggactcgaagacaacggaccctccacaat

SEQ ID NO: 17812 - DNA, 1501 bp, Oryza sativa
tccctaagttgcggcattgacacaagaacagatccataatcctgatttttggagggcgtagacaggaattctctgactagtggcgaagtgcgactataataattgtactgacacaagaacggatccttaatagtactgaattttaaaagaacatagacagacagaattatggtgagctagttttattcttttttttttcgggtagttttgttcttgttatttaccaacagattaaagctactaagctaggtgagtaatttgacagggatgacaagacactaatcaccagatcactgaacagacaagtagaccacacgattgcgttgcggcgagacctcttgcaagaagagcaaatctagtaggacgcgctagatctgaagtagacccatacatcaccagcagtatcatcatcaacaaaaaagaatagaggacaaggaaacggatcggtgcatgccttggtcgatctcaaactcctcgaactcgtcgtcgtcctcgagcaggtccatcttggccgcctccgccgccgcatcggccttcgccgtatccgccatcggggatcctacaaccgcaagaaattaacccccgccggacgcaacggatcccctggataggataggcaaggatcggtgaggccagcgaaaattagggtttggatccaggagggaatcggatgaactgaacgcaccttggcgctggagctcgcgcgaccgccgataggagtcgatgtgctttgcttggggtcggggaaaggagaaatacggtagtagacgggagacgccagccacggcacgagcacgatggcaaatgggccgtcgtagcaccacctaggcattatgggccggtaaggcatggcgagcacagcacggcgcggaggccgtccgcccaagtcatatttcctcttaggaataagttaactttggctcccctaactaatgatcgaatctaattcgtatccctgatccgcaataccggatgacccctcaattgtcaaaaccggtgtaatttgactcccacggtggttttggatgacggtttcactgacgtggcagcgttgacttggttttcgtacttcgtggcgtttagatggcattagaattaaaaaaataatagatgattccccgcgctttgctgcgtaaattactaatcaattctcaatatatatttttttgacaatcaaactagaagtaaaaaggaaaaaaataatgaaacattagggtttatcagtacttatcatgaaataaacaaatgatacacgcgctttaatgtgaaacatattgataattttatgttaaatattataaaaaaaataatagatagatttgttaaaatattgtgcaaatgatgtgaggggtgataattggatatgcttgtatgttgattgcataattaaataaatttgtagatgatgttgtatgctcgcatgaggttaaatatgtaattattgctagtgggtgatgatgtaacatggttgtgtgttgagctttaaacttagtgggctata

SEQ ID NO: 17813 - DNA, 1501 bp, Oryza sativa
agctgctggagattggagtaggggttctgccacctgagtcatccaccccttgagcaaggccacaatatgagagttgagggatggtatttgggcacgtgtaaaaaaaatatccacgccaaacattggatagcaaacaataagttaacatggatgacatgaggaagaaaatgacctatacaatgacacattctagaaattggaattgagtagaattctcttgaatattttaacttgactcctaatcagagtttacaaaaccatttgaaggttggattgtgaaacacagtggactaacgaaattcacatattgatatttggatcttgatgatccgtttcgagtgaatcgataacgaattttgatcgtttgtaacgaaaatgatcgatttgaagcaaaaattgtacatattttttggggaacggaaaaaagccatacataatatttttgttaaactgtttggttgacaaccaaaaggttctatggaaaaatgaaaattaaaaaaataaaagtaaacaaatttgaaaaaatgacggagaagagagaaacatttggcatggcattataattttggcataccagattatagacaataaagttgacattgatgtgattatgcacgtatacaattagaaacattagaagagcaattagaaagtttaatatccatgccatgatcaacactattataatgtcaatcacacaacgttatatgaaaacaaaatattataatgtccatgacataaatagcataatagtaacgggtgttcacagttaaaagcatagctatgattgaaaagttaatttaagtccgtgagctcatcaatacttaaaacatttaaagtccatgacatcatcagcactgttataatgtcaatgaaataacataatattataatatccatgacatcaactatataatagtggaatgtacatagttaaaagcattataactagaaacaatattacaataatccaatacataattagaaacattataacagtaatccaaaattttaaagtgccagcaccaacattattactatgtcatcaaacaacataatatgactgaagaatattatagtatccatgagaccatgacatcaataacataatagtttgaatttcaacaaaatataacaaagtgttgttccttaattattgttgaagtatcaaaattcacatttttaacagattttgatgtcatgtagcattaccatgattgtttttttttcaaatcttctccatatttttcagcttgaatttgaatttttgcgaattctaccgagttcccttctttttcaggattcaaaccagctcacatcgatcaaaaactgcaaaaagaaatgtggtgttcgttgaatttgcgagccctgcggccaactctgatccaaatagctagcagccagccagggggtcatacctaaatgctgtcactaaaaagaccagatatcgaaatagtgccatcttggctgcagccatctttgcagtacaagcacaacatga

SEQ ID NO: 17814 - DNA, 1501 bp, Oryza sativa
tgatatagctaaatttaatttttaatgaagttctccatgattaattacactctctggaattttcttgaaattttcagatctcaattgctaactttaataatacaaacatcatttaagaatttattttaaaaaaatctaaataaaaactctccattctctctacgccaatttcatcccgtttccttcctcggcctgcagcctagccggcccacttttctcccttctcctcccctcttcctcggcccgcaagtacgcatccggcccagcaaagcactacaagtctaatcagcctccctcgctccttcttttactgtcatgtgggccagtgctaccgggtcgtctcctacctccgtccgtattgccgcatctgcccgatgacgcctgaatccgcctcctccgtgaaatcagtccacatccatggagataattagaaattgagtgaggggttttgatccttatcttctcccctttctgttttcccaagaatcaaaacaaaaccacgtcgtatagatgttggaagagaaaccctagctttatagttcgagtctgtttctcttcaaatctgcgcatgcacgtgctgagatggagggaatcggacggacgaaaaaagtgtgactaaagggaaaatacgaatattttagttaggtacagatatagaagtgctataataatagtaagtcatacaattaataatacaaattagcacttgtttacactagttttatcgtgctaattactaatcaatatcaaacatgtttaatatcattaatcataatttaacctacttagtaatcatacactaattagtattctagacaaggtggattatagattgccaaaaggcctgaggctagacaacctggcccaggcatggcatggcctggcccaacctttgggctgtgcttgggcctctgcctcagcatggtggaccatcccgatacgacatgttccaatgattagggaggcaaaatagatgagggagagaaatagacttattttagccatataaggcacagcccaaagagataaagaatgcaaaatagacttattccagccatataagacacggcccaaagatatgagggacataaaatagacttattccaaggaggagcacggtgggctttcgtaccttcgagccagctcggcacgacccgaatcttattggactgtgtttgggttgttggtgcagcccatgggtgggcatggcccggcccgacatgcaggtcaagtcgtgctgacccaactgatctcaggctcgggtctggtcatgccccggctggacagtccatttagccatccacatggtggatgtcttaatccggtaaaataagcctaatccctctatcgtgaatattgagagaatatttcatctttttagctgcctcattcaccctacccttcaaacaaacatcaccaaaaactagaagaccaactcccattcagctccggccattagccaattccaccaccggttctaaaagtcagttgctagataaga

SEQ ID NO: 17815 - DNA, 365 bp, Oryza sativa
gcctgcaggtcgactctagaggatccccctgaatcttccattgagaagagtgaacatgggagtacatcattacaagggccgatcacagccagcgttgtgccactaagaatggtgagaagaaagggggcgggagagagtagctttccaagcttggattacaattcaatcgccgcgcttaagtcttttagcccacaaatatgaaatttaatttttattagtattattacatgtagaagtatatttggatttcatatataactcttagcttctatttctataaggtatggatttcatatacaactcttggattctatgtctacatgcttagatttcatataaaaatattaacttttatttctactagc

SEQ ID NO: 17816 - DNA, 621 bp, Oryza sativa
ccattgctcttgctcccaccaccatcgaggtaacccaaccgcgcgcacaaaagtgatccatctagtagaaataatgatcagtgatactatatatataatctgcgagttaattaattaacccagcctagcttgatcgatgcaggaaatcaaagagagaggcctgcaggttgttgagcctaatgtgcaactaatgaggatccacgttggcaatctgccgaggaaggtagacagccatgggctgagacgcttcttgatgagcaagatcaagagcaagcatgggcatgggcatgacggattcgtagtggttacggatgcgagggtgatgtgcgagagaagtagcaggggacgtttttcacgaggttttggattcgcaacaatggcgatcgcagcggatgctgaaccggccgacgttgtcaccatgctcaatggacaggtcagtatgatgtatgtgcttaattagttaattcgctgcgtaaatccacatgggattgatgtataatcttccgtgaatgatgaattgatgataacttcttgcagattttggatgggcgtcccttgcgagtaaaatttgcagacaaggaccaaaggggatcatctgtatgtgtctagcactgcatgcgc

SEQ ID NO: 17817 - DNA, 272 bp, Oryza sativa
tggtatatatatctgaccgggaccaacgtgccatcttcaggagctaacacgccggctccggctagggacgagtgcttggaggctctcatcctgacgggatggggcgaggcgtgcgtcaaaccgcctgtcgccacctaacccacgatctgatcgggagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 17818 - DNA, 376 bp, Oryza sativa
aagtttttttaaaaagaactttcaaatataattacactatatttatactacaaatatatacatttgaaattaagctttaaaaaaaacttgtgacaattttttaaatgtttcacctctctaatagaacgtagggagacatatacagtagcaaaagcaagaatctcaaagagaaatcaagtaatactaggcatgccacaagcatccatgatgactgagaaacctaacaccgtcggttaacctacccaatttaggaactgctacgaagagtaaacatacgtgttacctattccaaggaggcaaaaaaataatcagaaaaaggagagaatccctacggtttcagctgttatcaactaatgatacgttacttcttcaacca

SEQ ID NO: 17819 - DNA, 1501 bp, Oryza sativa
ttatatatttcagttcaaaattttccctataaaatttgtactacccatactaccaggtttagtataattaatagaattagatctattggatccaaatagttaattattccaattttttaaggtacctaaaaaaccctcgtactgaggtacctgatcccaagtaaatatttttaagaggcctcccatgttgtaagaggtttattactttctgtatagttaaaactcactaagatcccaaaaaaactcacttgctaagatgataattaattgcggtaaagaagccttcatattaagccagaccacccacgacacacacctgacacccccatagaattaatgtgtccctgaaacatccatagctagattatgaagcctacggaaacagctcactatgccaaaatggactaccaccttgctttctccttaatcgatatcgcacccagcaaatcttaatttgtccaatattcttagcacgtttagtttgccacgtgtttagtaaccatttttaactagatattccactataagagcaggtacaatagcatgctataagccagctgcaaacatatattaagaagataaatgaggagagagaagggctacgggctacatatttgtagccagctgtagcacggactccaagacacacacagtgtgtgaatgacaggtgggaccagatattaatagtgtagtatgtaactattgtatgaatgagctattagattggctatagatgaattggagctagtagttagctatactattgaacttgctctaatgcatgggattgtatttattaatatataacccatatctggaaacatatctgaccacattttgatcaaccgatttatgtgcgcgcaatatgtattcaattaagcaacaattaacgacattaaattaagcaagctagtgagataactccaacatgatcattttcatccttgtgccggggcatggatttatctaattatatgctcaaacgtacgtacatttatttaccttctgggtacgtagatagctaggttttaaaatcgatggacgatatgataatgatgttagatctactattgttacaatcgctctcatctgtgtagttgcattgaattgatatatattttgagttcgcattatttggtcttcaatttgcagtagtcaaagagatcgatgccaataatgcgtgcattaacatttcaatttgctttcataggatgatcgagaagcgtgcgtgctttcactatctgttacaaaacacattgtttttgacaagttttaagtcaaattttaaaactgaaaattttaaattttgataccgtttaagatatttactgattggattctcataaaactcatatatattaatttgcatgtctatgtttatttctacacataatacgtgcgtacacacagcttaatctgcacgagataataaggtctaattaattgatacattaatctctgcgcgagtactgacttcgtcctggtggtacagtatactact

SEQ ID NO: 17820 - DNA, 1501 bp, Oryza sativa
cagggaaatagactagtaaaatcattatcacaaaaaaaagtataccttcattttgtttattgcagaatctgaagactgttgtacttcaactctgttactttcagattctgccgagctgttatctttgcctgcagagtgctcaccagtggcatccttgcttggaacataatttgaaattgaacaatttgccttgctacagtccgaatcttcacgagaactaataccatgttcctcaaaatcatccatactgcccgagtcacgtaatggaattttttatctgcgcaacagttacatagacaccttgagctcctgaccaactgatttattagaaatcattgatacaagcagatagtggcaaaggaaatcaaaaaggttatgcaaaaaagcgaaacaatggaattcagaaaagcgcaaaaaaaagatactattcatccaggagattttattctgtccaagatgtctgttctctatgtgatgaaggtactctctctaccccttggttttcagacacatgtatgagcatttttggtgacttggtgtactgagaattttttatatgttgtatattatcaaagacatagtagcaaaaacactagatcaaaaaaattgtttatatgtatggactagtcatgttagtcaccatgtcaagcaccccctgctatgtacttaccacgcatcacatatactttaatactttatatttaccagcacacagtttagccaaatcacccattgtcccataaaaaacagagcaaaatcctgaaacttaattgaacatctaatcctataaatatgagagcaaaattagttgatgaggacaccagtcactactagtcacaaaatatgagaatcaactgaaatgtgagtcaaaatcagttgatccaagaatcaactgaaattgaatcagaaaaataaaattcactagcagtcactaccggttcccccaaaaaattatctagaacaaagaaaaatctgcctaagttgattgcttatgagtgctcatgaggtggcaaacatatgcatatccacaataacaaaaaaaaaatagttaagctaacatgaacccacaaaatggcaaatagtgagggcgtatatgacaataagccatgtcagttataactgcatttgtattgatgttactggcctgatagatgggaatggtagactacaaccaaaactaaggcaaaaagattaccatttagtgctagtggccagaaatgccaaaaagtgcagatgggccagtcaatcacaaatatatatgctcatgaaaattttaacaaaaaatcatcaaaacttcgtgactaactacaaccagactgaacttaactcagtataagaggattatgagttgatgactgcaggaatacaaacttagaaatgcagaggtgtataaatctgcagtatataattaaacacaacacaagcggctgctaggttttctcagttctggatggttcgtttatatttaccagcacacagtttagacaaaaagtgcacccat

SEQ ID NO: 17821 - DNA, 1501 bp, Oryza sativa
atcgcccgcacggcgcaccacgcgagcaccgcgcccgcgaccgccgcccacacaagcatcagcggccgctcgtcacctgcggcgaagacgaccatccccatcgatcgtcccactcgctagcttatcgcagcagctaccctcgctcgcagagcagcttacttcccgcaacagctataacaaggagtgcagcagtgcgcagcagaaagagaaggggggaattgatcggtggtatgctcacgaccggttgtctgctactctgcctctcggctcaccaccccgctgttatatatatatatataaatcctatgtacaaacacggcgcgtgcgtggtttgttccccggcccgtattattgtttattctgcctttggaacatatgctccggattgctacttccgcgacggttctacagtctatggctggcatgcatgtcgttcactggggaaacttggaaatgtgggagcggtacggaaaggggaaaaaaaagaagaagcgaaaataagacttgtgttaattcgctgaccatcgatgttggtcgttgcatacacatctccgtccaattgggggtcaaatgatttaatttgtagcagctccctgggtctcgaagatcacacacacggtcagaagtcaaaggccagaacatgcccgcgaaccgtttcccctcgcccggtcttctcagaacggacgcccttttagattatgttgatatacatgttgtttctaaagtatattaataaagagattagcaaggagtcattggtaccgtaagacaccaatattgcattacatatggtggatccgctccaagcgatatgggtgcataatgatgattcggcagcctggtggggaagcccttatcttaacgagatactagccttttctttttttctaaaggactcattaacgagctactagctctccccgtaaaagctttatttttagctataaacttataaaaaaaacttgtctagatgcataagtataaataaaagtcttttccgagcaaacatagaaggtttttataaggactcattaacaactcaagtcgatttggcttattcatactaacaagttataaaacccacactctgctcgacgagttggcacgcttagctatttagcttgcttcaaaatatgtgtccaagaatagagcaaagatgtgatctctgagcgttagaagtggtcggatggtggataacagcatcaggtgacgctcatttcaaaagttatcaacaaagataatataatgcaattatgcaaatgaaaatgtcaagctctaggagccattccagccaaaaggttcgggagaatgggatgccaactaaaacatcaccagttggtagatctatgtatctaaatgtaacgtcccgcctcccccaggccgggcccacttacatctgatagctttcataggtcatagactgccctcacagaccaacacatgtcttcacgtccatgtgtccagtgccagttgcgctgtgtaaccactacactttgtcctc

SEQ ID NO: 17822 - DNA, 520 bp, Oryza sativa
  unsure (1)..(520): unsure at all n locations
tgccacctaacccgcgatctgaccggtcacacactgcgaccggtcacggaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccanccctcggggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcaccgacagtagcccccggcgttacgccagggcgattgcccccttcgagggaagcgctcgggcgtgacgccactccttaggcccggtgacaggtggggccggtccctacaggcgggcagaaacccagcggtcgcaaatcgcgcgcatcggcaagggaaaaccgactgacaataa

SEQ ID NO: 17823 - DNA, 219 bp, Oryza sativa
gtgtcaaacatttcgaaacgaagggagtatattggaacaagaagcggtaagatctctttttgaaaattagaagaactttactgtttcctaaaagggtaaaatccgaagctaatctgcaagcacgatctcaactccgattagccttttatgtaccatcagatgttagctcagtactgtttcgtattaaaactggaaattcgctggagggagaggactata

SEQ ID NO: 17824 - DNA, 163 bp, Oryza sativa
aaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgaga

SEQ ID NO: 17825 - DNA, 349 bp, Oryza sativa
tcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgca

SEQ ID NO: 17826 - DNA, 152 bp, Oryza sativa
accagacgctggttgcttttgtttcaatctgggcacaaaaatgtaatctgtcaacttgggtagttttgttatggctggctcagggttcatagaatagattttgagggtgtggtctgtttcagtaattgcctgttcactctgtctgtcccaga

SEQ ID NO: 17827 - DNA, 1410 bp, Oryza sativa
tcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtga

SEQ ID NO: 17828 - DNA, 251 bp, Oryza sativa
tatgtattttcaaaaagagaacgacttttaaacccgactcatatacggatgacgtacctgtcatagttacgaataaggcatacttactatcctatgacatatgaaatatacagatccgacataccttcgtatgtacgatatacttccatatacaccaaggaaaatgacaagagactatgaaaattatcctcatggacaagtgaatagtagagccctaccttgaggattgggtttatattatatcgtgcagg

SEQ ID NO: 17829 - DNA, 1501 bp, Oryza sativa
gagatgtgaaaaggaataggtcccactacaatgaggctaatgaatgacaccatgggttaatggtcaccaagccaaggacatcgtcatgttggcaagaatgaagtcaaacttgtgatgagaataaagtcttgacaaaggatggtaaagacctcggcataaatatggttcaactggatggtcacaagtgttgatcttggctcaagcattaaccccaagttggatggcgcaaggcaaaggtataatggagctaagaatgttttcttagtcttttcccggtcttggtgtttggtgtagaccggatttgctagatagacgccgtactatcaagaggggtctatgaagcgagaatgtggatgatcttgcgccatattagttcatatgcatgtaggtgcatttggtgggcttgtctagccaagtgtggtgagtattctcaagtcctaaacaaagagagatgtgggcaaatcctataggtttgggtagcctcatgtggttatgtccggtggagtatcctttggagtgtgagccctttttccctgagaaaagttgtgtttcttggatggattgttcatgggttggatagccctttgaataagctttccatagagtccaagaacgccaaattccgagacccgtgtcaagaaatatcgccgttttactaacggttggttgtgctgaaaagtgacctgcggtctgaccgtgggccttaggacggtttgaccaggcctgttagccggtctgaccggcgtgataaggccggtctgaccggcttcaatggtctgttgcactggtctggtttatggtggcgatacagagccaccagagccgcaaccggtcagtccgagccgatgacggtctgaccgagccgtggacggtctgaccggcctctacactgcggtcagaccgaccaagttgagtgggctcaatgattgccctgtaacggctagttttctagccgttacaaagtagtccggtctgaccggcctcacaacagcggtctgatcggcggagcacagagttggggatttcggttccaacggctagttttggtggttgggggtatatatacccactccccagcagcaagggcgaggttttggcactccattacattatcttgaacccttgcaagagctctcacacccttgggcacttagtttatctagtgaggtgttagagagtgagttaagccaatccaagtgcattgtttcattgttatagctagtgtggtacttgatcatccgcggcaagcatcctagacttgttactcttggaggttgccgcctcctagacggcttgtggaggtgttgcccggtgacctctccgaggagattgtggaggaggcctggcgccagttgtgagtggtttggagttcaccaccttcggagtgaaggaagaactaccctagtgatcgaggctttggtagtcctctccgtgggccggctcccgccttgccccctttgacgaagggggcgtgcgatggcttcgtggttgagcggtggag

SEQ ID NO: 17830 - DNA, 714 bp, Oryza sativa
ccgttcagtgttgttctttggtactgtatagccggctggatactgcacgtccacctggtctaagctttttaatattcatttataatatcatgtttgtgcaaagaaaaatacttggggtgctatttattctgctcatatgtatctagtataaagtatatagtttgtgttttttcaggatagtaacttcagtttagcactatgcgatcactggatgtttaattactggatatttgaattattatgcaagttcatctacattattttgtctatattactggtaaacggtgtgtttcgtacgaaaactttacagcaacttcagtttagcactatttcgatccgcccctgctggtttcatgctgaattatagaaaacatctgcactgcccatctgtcagtaaaataaaataaaggtctcgtttccaccacaaagagtggataaagttttgaatattcgtggcacgcttttcaaactgttaaacgatgtgtttcgtgcgaaaactttctatgcgaaagttgttctaaaataatagattaatctatttttttaagtttataataattaaaactcaattaatcatacgttattatcaccttattttacctgaaacactttatctttatcttaatcttcaggagatacaaacaccaccaaaatatgagtgccacctgttagcaccactctctttctttccccaacttctctctgcctcacagt

SEQ ID NO: 17831 - DNA, 516 bp, Oryza sativa
ctccttgcggggtggccgggcccacgaaaccaccgtgatcgcagatacctcgcaccgcacgcggactaaccccctggtcgaatctccactctcggggagggatctccactccccactgtctgagggaccgccccctcgacaacaataactgaaggatacttcgtacttggttttattattgagggaggaaaaatcggagcgtgccaatccatagttaagggaggtagtatatatataggcattttccttaggaatatgtgaattgacaatgtgcctatttttttttaagaaatcgtgcgttctacttatcgtagagagtcaaaatacatattgcacgagtgatatatttgtagcttcagagctacgacaaggctattgagaacagcatgatttgcggatggtcccgtcaaagaagtctaaattacatctagatccaacaaataagaaaataaggactccgaaagaaaataaaaaagcaatccagtccttgagctcgctgcttcttcttcttccaga

SEQ ID NO: 17832 - DNA, 1501 bp, Oryza sativa
ccgcgctgcacgaagatcctcgtcatctcccactctcctcagagaaggctccacgtctacgcaccagcaaccctcctcgaatcagagggccacgagcgcgcccttatcgcgcgtgcggaccttgggggcggtgaatctggcgcctcctccgccgccgctgccaagggagctgctcctctcgtcgtcgccggcagccaatctgagcattccactgccaattctcatcagaaccagggcgacaccagtccctcctcgcactcggatcacaaaaccctagctccccgcgagatcgagacgcgcaggctagtccccttcggagagggcggcgagccacccttcccaaaaccctaaatcgcccgccaacccgatcgattcagcagaaaacaacaccgatttctctcccaggctctctctctctcgagggggtcgagcggattacctcgtcttgggggaatcgactggtaggcgcccttcgattcagcgagcgatgggggggcgcacgggttcggggccgacgcggcgatggggagattggagctagggtttatgtccaaatcgaaatcaacaaaaaattttggcttcgccgcgtgaattttttttctctcgctgttgttttggggattctgcttcgggtggatggagagagagagagaaagcagctgtatggtgaggtgaggtatcggaagaggacgaagacgatggagatggaagaaggggcgaagagaggttgggtgtgcaaaactttttatacgtggagggggagcgctaccaggcgatgacaagtggggcccacatggcagcgtccgttgggatggacggtacgtcgcgatgctgttggttttgcgtcgatggaaatccagtggcccgcgtttgtggcatttgcacgggatggttcgtcagctattgtctcgcagtttcatggcagtgattaattccagagaataatcggcgaagcttctttaatatttcttataaacacgaaacaaatgcagacgttcataatatgcgtacactcatagttataaaaacacaaacacatcttacccctatagaaacctctagaatattagactatcatatcttgattaattggcatgtgggataattgatttttttttgcaccggtcagaccggggggaccagggcatgtataccagtcagataggagtgatgatgaataatgttatcaagtgatgaacatggacatgtctgatggttgcggttagaccggctagggtaggccgatcagaccggagtatggcgagcggttgtaggataaggaggctgactagaggggggtgaataggcggtttttcaaacttttggctaaaaccgagtttcgtatgtggaagcgtaaatcaaaatggttttgcacaattcaaaacctaaatcaactagtctcaagtaaatgcacaaagaaactagcctatgttgaggtttgcaagcttagggtgataatagcacaaataaactctagtatgtaaacttgctcaaagtaaat

SEQ ID NO: 17833 - DNA, 1501 bp, Oryza sativa
acatgcacaataaatgtataggatttgctccccctaaatatatgcatacaaataaatacaagagatgcaagtgtatgcataattagagaatgaccaattggggtttatcctatacacataaagagaaggcatatgtagtaataatgtagaccaacataaaacatataccttcatgatctccatgttctcaatgtaaatgagactaaataagataagactcaagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaatgacctagtagacaacttatgcaaaagagaggttaatcccataaacatcggtttatcatctatcaccaacgtaacaattatacgaattgtttaatccaagatcattcaatcttttctctctttggtgatggataataacccgatataaacaaatagagagatgagatgaaagatgttttcaaatcaagatagaaatcttataataaacaaaatatagaataagctccccctcaagtgtacatacatatggatataaaggaacacatacgcacataatcaatcaggatcaatgagagagctcacactatattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacagcggtcagaccggccagtctgcggtggcgcggtctgaccggccgacgttttgtcggtttcagtttcgggttatttatttgggtatttgtggataattattgtttatgaattctagatggatattatgtgtgtgctaccatgagtcaagttggtgagaacttgtgatcgaatatggtttcttagttgatgcatgtgtaggtgaatcttgatgcctcgggagggtagtgtcgatgatggatccaaagtcaactcaggagaagatgacgtcaggaagatcaggatatcatgcgggatgcttagactaaagatcaatgcacgtggttggtgaagattttatatggtatatgatagagatattgtgtgcgtaatggatgcagggtcgaaattggagggagtctatatttggtacagttggagtttgtaaggttcgtttttttgtatgggaaggttttctaggggattaggacttcttgtacaacgttgattcgtggttttaggttgcttacctcggatataaatagagagggtaggtgtagccttccgatatcgattttgagagagttgagtttagagaaaagttagggtttcgagtttagtcgagattttcgtaagaagtg

SEQ ID NO: 17834 - DNA, 1501 bp, Oryza sativa
agtattatacacgaaaagtgaaaagataatgcagctgcgacagtttggccgagtggtctaaggcgccagatttaggctctggtccgtaagggcgtgggttcaaatcccacagctgtcaaattttttgttttactttctcttgtttttaaaggtgttgatttttttattctcactttatctcccattattttattttatactttctcttattgtttgtcaacgagtgttttttttcgcacttttttttatctcccgttgtgatcacacatttacacaattttgagccttaatattgctacgaaaggaaccttttgttttgtatatactgccttgttgatacactagttacttataggattaagatgcaccccttgtaatagtagtattgtctatatcataaataaattataccgacagaccttaaacttgtaagtaagtttcacctatatccacgaatttgcaaattacgtattgagatccctaaacttgatttattcttatatcatcctagtttaaatcctcttctgacctagtcttgctcacgtgagtgacatgccacttggaagataacatggcaaaatttttcccttttccttcccctttttcccccttcccttcttcttttctcttcttcccctccaccgctggatgcactagtggcaacggcagacgagagaaagatggtgccgaccaccggaaaaagagccgccgacgacagagttggctcgacgatggagcagaggttcaaggtcagaggtgacaacggtcaccgtgagctccccactctctcccttctctccacctcgagctccacttgatggcgattaagagctcctcctctgtcatgctcatggtgttgtccgtgattgatggaaggaagggggaagaggggaggaaggaaaatgtgctgacgagtggacctttagcaacttcttttttttactataatgcccgtaagcaccatatcgaataaatcccatgttaacgtgccacaaaaagtgtcatgtataattcaaaaaaaggcaatccaaaccatcaatgatgataacctggttggttttatatattagttgtggtagcctccattttgaattttgtgattttgtggttgacagatgcgaacaagacttggccatagggaggcaaattagactactatttgctttcttagttttagttaaaagccccttcctcccaatatgcggcccgcatgggaaatcctcacactcggcccaatagaacggccattatggccagtgcagcccacccgagggtttatatgcgtgcacgcactcggccattcacacctcctgccggtctcctccgaaccctagcctgcttctcctcctcctccccgccgccgccgccgcgagcacagacgacgcagccatggtaatgcatcccatttctgatctacgcttctccggcgtattgcctattcgaaggtctcgtttgctcaccgggaatgcgtgccgccgccgccgctgtttgtgcttggtgc

SEQ ID NO: 17835 - DNA, 200 bp, Oryza sativa
ggatatatatactaactactaaattattgcacattgatacatatcgtactacatatattaactataattatttatttaattagggtgtgtttagtgggccatccggaactgagttgaaccacgcggtgttggtggtgggttacgacgagacggaggacggcacaccctactggatagtcaagaactcgtggggcgcagga

SEQ ID NO: 17836 - DNA, 1501 bp, Oryza sativa
ctagaatagaacaggacataacctaccacaacaaatttagacatacatatgcatatgtttaaattcattatactagattatgtcccatattatcttatgttgttttattttgagatggagggaatacgaaagaagataatgtgtttatttagtttttatctgtgctaactgggattggcaacaggtggagccgatgacagttggataagaacggagctgccgcctagaactgaaatgagaaagggcaaaaataggccttggccccgctgggtccctaaaacccgatcagagactcgtaggggttcagacaacgaggggacctgaggtggtcgaggaaggcgttgggtaccagtgtcggtgtggtagggaggcgaaggaggtgacgctcgggtgcaagcaacgtggagctaagggcgacaccgctcaacataggtgagggtgtctcgtgcctcgcaattgtttaccatgatagttctcatagactcaacttgatatagttaggaatggatagggaattagagttgaattcattctattccttgagtagttgggatgttaatgactttgttcatgtattgtgatgattgttcctattaatgtacgaaatattgagtacctcaaaggtgtgaaaatatctcatttggactattgcatactaggttctatatggaaaaagccccaaaatagggatatagtcttaagcagataatgaaggagtttccaacaagaaaagaagacttccaacccgaagccgacttttttaagatagtggatagaaatttagcatctatatccataagtggatatacacaactaactcaaaagccagcttaggactactcaagacaatatcctaaatgggcctctaattctttttggacaagacaaccctagaatcaacacttcctaggagggagggtaaccaaggcaagccatcataagcctattgaggtgtcaatacaagacaatacaaatcggaaccgataagccaagtcatcaaccatggctcaccttactagaaatttctatcctgaagagataatcgattagatttagactagagttccccatcaacgcatcacgcgcactggcacttttgatgggctgtgcaagttcagtaaaagtgggcatcttgggccttggttcatggaggcaagtttcagcccactgatgcatatactacctgctgatttttttttttttgcgatttttgggtatgccggtgcataccgggaacctctctgggtccgcccctatttgggattgttttcggaattttattaagattggtcacgctattattagtttactataaaatttatacttcatctgtttaatattataagactttctggtattgcccacattcacatatgctagaaagtcttataacctggaatggaggtagtacaattttgatgaagttgcaaaatattcgttttgctatatttttaaagtgtcgattcaatcaaaccaaatatttgacaataccttttcttta

SEQ ID NO: 17837 - DNA, 1501 bp, Oryza sativa
tccccgcgctgcgcgccggcctccgcctccctccccactgcgcgcgacgctgccgacgccgccgctgcaactcgctggcaggagagagagacatggagagacatgtggatagggttagagatgggtatggttttctcaagggtattttgggcattataaattttaattatatttcgttcttttttttaaatcaaatcttaacggtgttaagaaaacagggtcagacggaaggttcgtttttgaaaagcagggtcaaataagcaaactaaaaaaaatagggtcaaattggtagttagacttcaaaacagggtcaaataagcaattgtcccttttttattagtctacgtttagtacttcaaatgtgtgtccatatatctgatgtgacacgctaaaactttttatccctagatctaaacacagccacccaaatgttttcctggccatcacattcattaatgactaaggtccagggagcagagagtcttcttcaacctctagatagaatagatgaagaagcagaagagcaagtagaagaactcatcgacaacttgttccggcgatggtgcaacaacagtgatggtccgaaatccagcaaacacaacggaatagatttatcagggttagaggttgatgtgtaagggtggtcaatggaggggcagctttagaggatgaccatggaaggcaaggcaccgctgcccttgaccacagtagagagagaagtagattggttaggagtcgaataacggtggatctagcggtgtgatccccaaaggaactagccagttcctagcttcactacaaagtgatcagcttctcctttttaatttaggtgaataactaatctaatcctttaagtttcaccaaaggtttaatttggttcttcaggttttattttatccacatagatcactttactattcacccttctcatttcatctattatcctttttagttaaaaatattctctcttctccgccaatgtactatgacaggtatgccctcggtgtgaatctgatagtctgcgtctactcgaccgcgcaagcagtggtcgaaatcgggcgcctcatttcgccgaggtttgctgcttctctgaacccgataacctactgcgtcagcctcttcctggatcaggcaagcccaatacacacaatacatcggttcttcatttttcttttgaaacatctatcaacccatcaattcttctgctcaaaatgcgccattgcaaagctacggccatatttatattcaaacttttttctacaaactttcaacttttccatcacatcaaatgttttgatacatgcatgaagtattaaatgtagatgaaaaaaaaatcaattacacagtttgcatgtaaatcgcgagacgaatcttttgagcttaattacgccatgatttgacaatgtggtgctatattaaacatttgctaatgacggattaattagacttaatagattcgtctcgcagtttacacatggaatctgtaattttttttttgaga

SEQ ID NO: 17838 - DNA, 1501 bp, Oryza sativa
cacaggaatggaaattttctttcatatgccatctactcataatgccatttttcttaaagcctcctccgaggttccttgctcttccttgcaggctgagttaatggcgcttcaacttgctttggaggtgactgtcttcttaacattgaaggagtgactctcctctctgataattctaccattgtggaaacccttagaaaaggaagatttcaaacggagccaggtcattggagcttaagacctatttggagtcagatcgttgccacaattcctgaatctcttttgcaggtcatgtggattcctaggggcataaacaagttagctgaccaactagcaaaagaaaccaaatccagtgttaatacagcccctgtctatgtttgtcaaaatatatcgcatttggcttatcctaccagaagatgtcatgctaatgacattagagacaatttcaattccaggaactttgtaatccggcatgttctatgcttctaaataaagtgtttaaggttttttaaaaaaaaggatagattaaatcactttccttcacctgatttgcttataccatggccaactgaaagcactgctatttttcacctgatttgtactgaggtcacagcaaactagcaggcagcaggcttgttttgttggtaacattttgcttctatgaattatcatgtatgcatgaagtatttagatctaattatatgtttttgcctactgttattaatttattatgcttctgctgatgcggtttctgaggaggttgctctggcatccttcatgaattctccctgttgaattgtctgtacaatgcacatatgtattccacttttactaccgtgtattcccacaatttgtagcaaccttacgaaaataaagggcaaaaaagattaaatatggatgcagattttataaaagctaaatcatatctaaatattaatggccagttcgccaggccagcaagccatacatgcacagcaaactaaagcttttttataaagcaccatcactaatctctctcaatgcacagccaaaatgaaatctactcccttacagctagaataaactaagcattaatattttgttcatgacttaagtgttattccattcgatatatgcatttcctgaaggttttcatacagtaacatcactaatctttctcaatgtacggtcttttatacggtaacatcactaatctttctcaatgcacagccaacataaaatctactccattacaactggaataaacaaagcaccaatattttgttcatgacttagtgtcactccattcgatatatgtcgacatgtcttgcacctgcacgctaactagtacaataaaacagaggactgttatacatctcttatctgttgtccagttgatgtttgtgttcattaatccaaagatcagcagcgcagccactcatagcacttctgacccccccccccttttttttttgaaagtaatccaatgtgttaaaattcttatgctcgacaagaaatcatttat

SEQ ID NO: 17839 - DNA, 1501 bp, Oryza sativa
tggcgaccgagtttgggacacgggggcaatctgggtattttgaaaaaaaatactcgccactttcagtcgggaaatgataaaataataagctcggtgtcctacggcaaattttacaaaatttgtagtgtcctagagcagttccacgttttctcggtgtccctcagctaattacgcgttttttgggtgtcctgtatcaaattttgcctttataataagaagaagatatcacattttaaggagaaaatgggaccaaaccttacagcgctcagttaatctcatgttgaacaactggattttggagttgaaaccttacacccattgcactacctagtgtatctcaaaggaagtaggtaaaagcacactctgctctttatctaacacgaaagcaaacatggaccatcacgtcaaatatttgaagaggtcggagcgtaatttatttactaggacgactctcagcttgcctttccccggcaattttgtaggcgctgtgttccatttccgtgtcatcacaagcttcttaaccaataagaacggtttgacattgatccgtcaaacccaaaactgaccaaataacctctacttttacatcaactagctgggtggcccgcgtaattgcgcggctagcacccatataaaattatatatttttaatatatttttacttaaaatttattaaatagttatctcgttgtcttaagatttaaaagaccaaaccttatcatcgttgtgtttctaattaattttatagtttttaaaagtcacaccagttgctaccctttatttctgtcatattattctttattagcttacccaatctaccgtactgtttctattcattctccttgaaacctttaaaaattggatagtaagtttttagagtttattatcacgttgggcttcttatttataatttatagaagtcctatcaaacgctgtcattatacttctctatgactgtccactgcatcttctctatatttttaaaaatcaaacataattatcgtttatgttcatttttctactttctagaagtttcgccaaaacgccaacgactttgtctctatactcctctatggctcgcccgctgccgtccttctctattgttattgagattttaaaatcaaacatgattaacattgtggtttatttttttttactttttagaagcacgaacatttaaaaattggaccttatagtttttgagtttattgtctcgttgagtttcatgttttttataatttttagaaatctcgtcaaacgcagccactgtactcctctacgacccgttcgccgcatactctttattgtcattggaattttagaaatcgaacataactaacattggaattcatttttttactttctagaagacccaccaaccatcggtggctctgccattttattcctatacgacccgcccacagcctctcttttttattgtaattgagattttaaaaattaaatatgattatcattggggtttatttttttattttctaga

SEQ ID NO: 17840 - DNA, 1501 bp, Oryza sativa
ttgatgcatcttccggttgtttttagtaggtaaggacctgaaatgaaaaatccattcacatttttacaatgcgaactgattaaacaaggaggtgatatttcttaatgtcatacagtcatagataaattaacagttattttcttgtttgcaaatgtcatttgtaagtagtaaactcacatgtaacccggaataataatcttctgaacgcatttcaagaggcgctcagcttgctctgcctgcagctggaagatccttctcccttcaaggtagctgcttccgaatgcggtgcgagaaatgacatctccggtcaggctctgcatctccggccagacatccacctcgtacgagccttcagaaccaagggactccatccacctgctgatcagctcttcgcagcacgtggaaaacgccggcagcatgcgctgcagagtctcgcacgttccaatattcagacacagaaaacagcagagagagagagagagagagagagagagagagagagagagagagagaagaagcaagagtttactagtgcagtgttgtgtggttctgtacttctgtgttgtgtggttcaccttgagcttctcgagatggaaagccgggttgaggatcctcctgtgcttaacccacttctcgccctcgtggctggcgacgccgtcggagagcagcttcgtcagaccctggaacttgtgcttctccaagtgaccgaatttgttggacagcacgtccttggccaggtccgggttggcgatggtcaccttggggatcgggccgaaccatgagaagcacgccttgccatgctccctgacgctgctgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagccgccgcggccgccaccacagccggtgcagcagccggccgccctgccacaggagcaccaggcccaggagaccgtacgccagcgagctccatggcacggaggctggacacctcaacccggctccaagaaccattgctggggtcagtccacgagtgcaagtgtgcagatgagtggtgtgaaaagaagcttttgactactggagatggatatggtacggtgttgggcgaggttaacaaaaattttgacaatttggtcctttacaaaaactatttttataaataaaccaccgccaaaatttattttaaaaatgacccttctatttagtgtcacatcgtgtggcgctgaacttagacacctcagcgccaaatagcgtggcgctgaatgtgcgttgccacgctgacttagcctcccatttgcggtggcacggcattcagcgccaattgacgtggcgctgaggtgtctaaggtcagcgctagatgatttggcgtggaaaaaaaattatttttaaagtaagttttagcggcggtt

SEQ ID NO: 17841 - DNA, 1501 bp, Oryza sativa
tgctattttctttgcttcttgccctcctaagtgcttatctgactcttaccccgccctcttctgggagtttagatggctagccgcccccgccgtacagctcgtgcgccagcccgctttggttttgaagatggtagagtcgaaccagaagcaaatcatgaatcagctaatgagcagtctcaccacagcaaccgttcgcaccgtactgtttcccgcaacgcagaggttgagcaaccccgccgcagcagccgctcgcatcgcacagtttcccgtgatgcagagatggaacagtctcaccgctctcaccacactgccagtcacaattctggagaagaacgcctcccttccccacctcatgtggaaaacaacatgcaacacttaatggcagttcagacacaaatcttgcaaggactaaccacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactccggttgagaagacgctctacgcctctcaccagttaagaggacctgccgcagattggtgggagaattactgcaatgcacaccttgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaataagttggctcggtacgcccctgaggaagtggacacagacaagaagaagattaggaaattcttgaaagggatcgcagttggaatgagactccagttgcttgcgcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgccctcagatgaaccgtccggcacctccgccacagcagcgtgcccctagtggcaacactgcgccaaacagtgttacctctttcaagtcaccacagggaccgtcagcagttcagtgtttccggtgcaaccagatgggtcactatgctagacagtgtcctcagaatcctaccaacaccaactcaggacatgctaatggcagcactgccagaactcctactccagcggcagctcagtctcgtcctagctctcaggcaagtggacaaggttcacgtgcttccaacaactttggtcgaggccgtgtgaatcacattcaagctgaaaccgctcaggatgctccagacgttgtgatgggtatgttctctg

SEQ ID NO: 17842 - DNA, 1501 bp, Oryza sativa
gtaagcatacacgcacacacacaggtattgaggtataaatcactccctgctagcttgtaacaactaacatatacagtatgtaccttgagcttttcgagatggaaagcagggttcaggatcctcctgtgcctcgcccatttctcgccttcgtagctcgcgagcccgagggcgatcaatttcccgagacttttgagggtgaatttctcgaagtggccaaacttgttggataggatgtccttcactagctctggctcagcgatgaccactctcggcgttgtgccgaaccaggtgatgcacacgttgcctacattcagttcagtgttctgtgccgtcagatagagctcgatgaacagcgtaaactgaacataacagcacgcgcatactttctgaagtatatatgaacttgtgttcactattcacgaaactggaaaagtcatagcaatagaggcatgcatggaggcatgtcaagatggattctaatagctcgagtggacgtccacccgtttattgcatgtcaactagatggctacgaaaagttttcaaaacaattgagaagatagatcaatatgtaatatatcaatccacaaacatgcaagttcaaatttaacttctacaaattataacaaaaataacaaaatgtagaagttgaattttaacttgcatgtttgtgaattgatatattacacattgatatatcttatttatatttttttaatttttttataactatttagatgatatgcaataaacgggtggacgtccactcgatctgttaaaacagtttcccttatgcatggagcttaccgtactccttgacgatgtcctgaaggagcggggccacccgggggacaatgtcgtggcacggcggcatgggcttagcccgcgcctccttgctgcgccgggcgttctccggtaggtcgccggcggggaaccggtacgcggtgccgcggagcccctgcccctggagcgcgccggcgacccgccgcggccccagccagcacctctccgccgcccggtagagcgcgcctagcacgagcagggccgggacgccgtagtagagcatgccccacggcgccgccgccggcttacctgcttccagtgagactcccacctccattcccgtggcctcctccattattaccggttccctagctagttggctgacttgttgagactgcgaccacagctgccaagagcgcgcagtgagtggtttctgttggtacgagtggcagacgcgcgagcgttttataggcatacgctttgcttggcgtcacatgtttttctccgtctttgtgaggtttcttggcggccacggtcatacatacgtgcctggattttttttcagctagcgcgattgcatcgacaaagtgtggcagatagccagtgtgtgatttgctagttagttgtttgctaacttgctgcagaagctgctagcattttggatttttggtgctgtaaagttagtaaataaatgtggatttgttgctttcgttcctctgga

SEQ ID NO: 17843 - DNA, 1501 bp, Oryza sativa
aaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttatttcccctggcttgctgagtactcccgtactcacccttgctctagataaataatcccccccagttgctgaagaagatgaagcggatcctgttgatgtggagttcttccaggagcaagccggctacgatgagttttagggtttcggcctagttcccaagtcgcgcctgtgatgattggtccaagtcctggcttccgtttccccttttgtattgcagttgtgatattctgtcttcctgtgataccagcactgtttcctgggactggtatcgattaacaggttaatttggagcgtcacgggctagttccagtcggggctagttcggggcgtgacaatatctttacaaatatacaactttaaatttgacatttacgaggagaaaaaacatatttgaatgcgaatagtgcattattcacaagaaaattgttgtttttatttttagttgtgtatgtcaaattcaaacttgcatatttattatggaagaacacgttttcaaaaagttatatgactatataggagatataattgtctacaaggatgaaaatactctcacctaatataacgaataattcacttgatgggcatgtcatcgcttattaacacacttgtgacattttgtgctctttaatttatggagaatatggtttgtgctcatggttgggatttttcttgaaacaaagccaaaatttattgtattatcggtggagagcatctaaaaaactgccgtaagtttttctagtaaaaaaatttcagatgtaactatagtataattgaagtgtaattacatgtagctgcactataaccagggtttgaaattttagtttgaaatttccgaaatctcgcccgaaatttcggtaatctcgccccccgccggcatgctcaaatctcatccgaaatttttggctttttgcaaatttttgtgaatttggtcaaattttattcaaattcattcaaaatcaatcaaaatttcaaataatttcgttccgaaatttccaaaatttcagtaacccttggcataaagtccaaatttgaaattgtcaaccttgattataactacgttgcaattacggtataacttacataaaacttgtattcaactgcgctttggttaggttaggtagtactgaaatcttatgcgtaacatgtataaaaatttctttccagcaatatttttccttcatgtataaatctcaagatgatccgatggtcataaatccgaaagttttaggggggaaaaaaacttgtggaagtttttttggcaaatccgctgtaaaagttacacgctcgtgatgagtgccgtggagtgct

SEQ ID NO: 17844 - DNA, 1501 bp, Oryza sativa
agtgaaggggagcgggaagggcaagcacgcggcgaggtgtggaagggggcttaggtttcagtcctccggcggctagcgtcgccctcgtagcgaggtatgtcgcgacgcacgatggccgccacccccaccctctccggctctctgcgcgcgctcgcctgtggaggtagagaggagggtggaaccataggtaccactatttttttatattttgtttgactgacatgtgggcccctttgtttttaatttttatattttgcttctagtgctacatcatcgccacgtaggacgaggaccaactcaaaccagccacatagatgtcacgtcagctaaaatcgccatccacactaccgagggaccttgtctgcattggttttgacaattgaggggcccgttgtatttggtatttgcggtgcagtaacgaaaatcaaactcgttatcaagttaagggacctcagatgaacttatttctatgttgaacctttccgctggcccgtgaactgggaagtagataggcctactagactgtttcaccttaggtatgtattttagcccgacccatctctctgtttcacttactaattccagttcactgaggcattgcgtttgcatagcatagcatcagggagaacctgtatagtagaaaaaaaattgtcactgtagtatagattcacggcgatttgcaatttgatttgcattttatataaacataactgtgtttttatgcttacagttattatagtatgcttgttggggtatattggtaaataatcgcataaaaaactaaacttttaattctaagtcataagatccattgttttacccacgcatgaaataaacaaacaagtatatctttttttctctaatggagggacgaacagtatgtactagttacacatgttaatatagtggttacaaaaatgtttgacagataaaaataatcactcattcataaggcacgtacgtagatggtccgaagtcccaacttaacctctaattgtttttttcccagaggaaaacctttcctaattctattaccagaaatgacgtttataacaaagtcaacatatcccaacttacctttcaaaaaaaaaaatttatcccaactcatgatagttacatttaaagtgggcgagccccagacatattctgagctcacacaaacaataattcaacaccacatggtgggtgccccttccttgattttcttctccaccaagttccttctgatcaaggtttagaccgcccaaggctttgaccaataatacactatcagaggcaaccaagaaagctagcaagcaacttccttgattaacatcgataaccttaaacaaatgagcacacgaagaccaactgtcccagcgacactcctatataatcggattcgaatgcgctgaattcacatgtacacaacaccgtatactgtcccttccggtcaaagtacactgcccgctgacagtgaccagagattctactccagcttgctactcattttcgagggtgt

SEQ ID NO: 17845 - DNA, 1501 bp, Oryza sativa
ggaacgtaccgggtgtacggtttcccgctctcgcacttaaggaccgattccttggaatttcatccaaacataagataagtacgaccacatgggtggaatgggacacccctggctgagtaactagcttatcaggggagccttgatgccgagagacatgtggattcaccggggtggtgtcggggaggacccctgggcttgctggcacagtatggtctgggacctaccctgttgttggtctgggacccctctcgtcggcatatggtaaacctgtatcggctttcgaaatgccttgtcatgaaagcttggaggtctcccgacgtggctgatcccctcgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgactactgattgtgaaattgctgtcgtgaaaatgggttcgacgtctgaaaaatcagcagctgacgggatcagctaggcccgggtggccgtttgaaaagttgttggcccgggtggccgtttaaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttatttcccctggcttgctgagtactcccgtactcacccttgctctagataaataatccccccccagttgctgaagaagatgaagcggatcctgctgacgaggagttcttccaggagcaagccggctacgatgagttttagggtttcggcctagttcccaagtcgcgcctgtgatgattggtccaagtcctggcttccgtttccccttttgtattgcagttgtgagctcgggatctgtccgtagcccaacataactgtattccaactctataataaagagacctctgttgctgtaatattctgtcttcctgtgataccagcactgtttcctgggactggtatcgattaacaggttaatttggagcgtcacaggctagttccagtcggggctagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactg

SEQ ID NO: 17846 - DNA, 1501 bp, Oryza sativa
aactagtagcatgtttgtctatttcttgaagagatgaataaaaaaatcaactgcgtttctaataaacgcaatagtagtacagtagtagtagcagctctttttttcaccctgagaggaaaaaaggtttgtaagtacatacagcccggataagttttcaattatttttttacttttttaccttttattttaaaagcaaaacttctaaaatttattttcaaagtctgaaccttttggtggcgttagctagcttgacgtggtaaaataacactattacgtaaacatagcaacaactattatgtaaacatagcaacagttttatcctcccacaccagctaggatagcatggcaagacaacactaccatgccagcaagatcggctaataaaataacattatcacaccattctgacatacatgacaatgttgttttgtaaggcaacctagctagtgtgaccaaaaggttcagattttaaaaataagtctttaaaaagtttgttttaaaataaaaaaagacttaaaaaaagaaaaaaaaagttctgtggaccattagtttggctctccgtaaagctacggattataagttttaacaattttggatttttagttttgattttaaagagtaacttatcttttttactctctttgtctaaaagaataattttttaagcttatctaggtacatagttaaaaagtattatgtttaggtttagttaaagatactcttttaaacagcaaaagcaagataatgttggatgaaaagtggagtagataagaaaattacataatgaaggattgtaataggtaggaaagagtatattggtggagctgtttatattttaggacaaatcttaaaggtaaaaaatgttatattttgataataacttatactgatattgattactccctccatccctaaatataaaggattttaattagatgtgacacatcctagtacaacgtcatatctaacctaaatcttttatatttagagacggagggagtacaaaaatggtgttaatccttttctatgcacgaatgctttacttagagcctaagcatcttgatttcggctctatgcttgatactactacggagaaaacaacgcatgtttaaactagggtttgcaaaactgtaggattatcatgcggttatcaccgttattatatgtagtaaccttatcaacttctgaaaccatagtaaatctggcggtaaccgtgtagtctaaaacagtaaaacctggtgtagactctagtaccagatgtcgtgggagattttttttttcttgtgtaatcttggaacgtgtcatcccacctatcctacatatttaaaggccacacatcaccgtcgagatcatcaacaatatcggctatacggtttcgcggatcacctgtggtcctgtgcagccgtaccgtacgcctctgctttcctctcaccccaccgcgccaccggcgagcggcccgcgagggaggaggcgctgccgccgcctctgctgatgctgatga

SEQ ID NO: 17847 - DNA, 1501 bp, Oryza sativa
taacctaagcatgaagttgaagaaacaaccaaagaacacaagattatgaataggcataggcggtgaactcctagaaaagacatagcctcgtcttcctcatgcactcttcttgggggtgccgctacctccactctcttgttggcttttcgaggacggcaccagtagctcttggatagggtcatagccgacctttttttggagggaagggtcagatggacgacgactgtgagtgcaatgagtgaggtggaggacagtgtaatggtggtgggacggtgccacgtaggcgacatgcccatctctgtatgtattttttttaaaaaaaagtaaaatgacacaaatgttcttttcttaaaagaaaaaaacacaatgttcgagcgtcagcttgagaaatcagaacgtctgaagcagaaggtttagcccagaaatcaaaacttcagctaaaccttacgcatccatgggcctcgttggttatagcctgtgtgcatcaacatggggtgtttgatgggccggaagatgttttccgttccaggcccactgatgactgaacattttggggggtctgtctttggatcagcttctccttcctccggccctatcgcgcggtgcggtatctccgggatttgcaaccatacatcctctcctccattcaaagcgccagtcgtgtaccaccgcccgaggcacgtagaaccacgccaagatgcgtgaacccccgcttgcgtcgcgtcgacatgcgcagcggcgcccatgctccccatgtcgttgtcccgctcctgcaagagatacacctatgttagccacgtcttttctgtttgagatccttccaaatcctccccccatcttaatttcttcccatctctccggcggcgccggcgccattcgccttttctcccaaacgctcaccggctggcagcccccagcctccccgcctgctcgttcggccggtctcggcctcccccttcgttgatctccaacctgagcaccgtcgaccacgccgacgccggcgacgcctcgcccgcgtacaaggtaccaggtactgcatctgcatgcatactgcacacacgtgtcttgctgaattcctccaccgtggcaatgcggcggaggtcgcgctgtgacctcacctcacctccggctacgtggcgccgtcacgtggagtgattcactaccgtaatcagtgacgtcagtagtatcagataggatttcggagttattctgtgggacaggatggtcactaatttccggttttggttttaggatatcattttctttttagtgttggagaacaggagaaggcaatcattgattgttactttgttagtaattggttagtatatctgcactgcactctgcacacacgtactgatctctccgtcccgtttgcttcaacaacacatttgctttgctcggtacatgcagagagaaaaagaagcaatgggcatcggcatcggcatcggcatcggcatcggcatcggcaccggcaccggcgcggcgctaccattcggcg

SEQ ID NO: 17848 - DNA, 1501 bp, Oryza sativa
ccatccatccattaacctaagcatgaagttgaagaaacaaccaaagaacacaagattatgaataggcataggcggtgaactcctagaaaagacatagcctcgtcttcctcatgcactcttcttgggggtgccgctacctccactctcttgttggcttttcgaggacggcaccagtagctcttggatagggtcatagccgacctttttttggagggaagggtcagatggacgacgactgtgagtgcaatgagtgaggtggaggacagtgtaatggtggtgggacggtgccacgtaggcgacatgcccatctctgtatgtattttttttaaaaaaaagtaaaatgacacaaatgttcttttcttaaaagaaaaaaacacaatgttcgagcgtcagcttgagaaatcagaacgtctgaagcagaaggtttagcccagaaatcaaaacttcagctaaaccttacgcatccatgggcctcgttggttatagcctgtgtgcatcaacatggggtgtttgatgggccggaagatgttttccgttccaggcccactgatgactgaacattttggggggtctgtctttggatcagcttctccttcctccggccctatcgcgcggtgcggtatctccgggatttgcaaccatacatcctctcctccattcaaagcgccagtcgtgtaccaccgcccgaggcacgtagaaccacgccaagatgcgtgaacccccgcttgcgtcgcgtcgacatgcgcagcggcgcccatgctccccatgtcgttgtcccgctcctgcaagagatacacctatgttagccacgtcttttctgtttgagatccttccaaatcctccccccatcttaatttcttcccatctctccggcggcgccggcgccattcgccttttctcccaaacgctcaccggctggcagcccccagcctccccgcctgctcgttcggccggtctcggcctcccccttcgttgatctccaacctgagcaccgtcgaccacgccgacgccggcgacgcctcgcccgcgtacaaggtaccaggtactgcatctgcatgcatactgcacacacgtgtcttgctgaattcctccaccgtggcaatgcggcggaggtcgcgctgtgacctcacctcacctccggctacgtggcgccgtcacgtggagtgattcactaccgtaatcagtgacgtcagtagtatcagataggatttcggagttattctgtgggacaggatggtcactaatttccggttttggttttaggatatcattttctttttagtgttggagaacaggagaaggcaatcattgattgttactttgttagtaattggttagtatatctgcactgcactctgcacacacgtactgatctctccgtcccgtttgcttcaacaacacatttgctttgctcggtacatgcagagagaaaaagaagcaatgggcatcggcatcggcatcggcatcggcatcggcatcggcaccggcaccggcgcggcgc

SEQ ID NO: 17849 - DNA, 204 bp, Oryza sativa
ttctcgcgaaccttccacacacagactaggagcttagaatctcacccagggcccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaa

SEQ ID NO: 17850 - DNA, 1501 bp, Oryza sativa
acatccgattagcgaagaaactgccaagaggaaatcacctgcggctacggggcatcattggaggtggaagtgtccaagcggaactaatccaatataccaatggagtaatgaaggctgaaaaaattatacgtttctgttttgatttgggaagaaaaagggtggggccaccaggcaaacaagaagcgaataggagtaggccacgtagcaggaaaagggacgggaatacggaagtaggaacaggaaagccgcacccacacacacactgcgtgacctacggcttgcttgggcacgaccgcacgagcagcagcttgggcagctgggtctgcatgggcctggtggcactttgaagtgctaaacgatccaattggcctaggagacagcacaaacaggaaggaagaaagaaaaagataatcaatttcaggttcagacacatactagaattttagcagcacaaataaatataattgaaatgaaaagtgtagttgtttttatcaaaatttatcggtttgttctaactttagcctcaattgtttcactctgttaaaaacctacaggtcattaacacgcgatactcccactaaattatccttttaaatgtgcgatcttcgcagaagggtaaatggaaaataaagaaatgatctatatatgctaaagggacaacgcgtcaatagacacgctaatttttgtagtatagtaatgattgcgaagaatccccacataatatatatctcactgcttatatggatcttatgatggagctagaaacatcgtgaaacctaaggcatgttggcagtaattctatcgagccattcacagagaaccactttattatgagaagcatcatgtaggatggggtaatgggtctcaactctctctttattccacagtgcatcactttgttacgagaaacctcgtgtagcatggggcaacgggtctcaactctctctttatcccacaatgcaaaggagttatacctgtggctttaacttttcatatcagcccctaacattttacattaaagttctcgtagtttgtcaatttagagaatacttcaaattttacacaaaacaccctcaaaatcggaaacatatataaaatccctccttcctcactttccccgttgcccttccagtgccaccgacgcctctcccgttcccatcccccaacggcgacccacgctcctcaccatacagtcgccaccggcacaccacccctcctatatatcctccttccccaactggcggccctattcccttgggcggcgtggactgcgggagacggcgagatcggcagcgtgggagcaagggacggcgggagctcttcaaagacccccactcatgtcctactccaactggtggctttcctcccttggccggatactgacgagctcctctccctctccgtcaagctgctgctgatgcagaccgaggtggttcggagcggggacgacgacgagcttggcggcgctgaacgggaacgaaaacaaggttagtttgccacc

SEQ ID NO: 17851 - DNA, 292 bp, Oryza sativa
ttaaggtgggatctaaacaaggccttatacagtacatacgagggttgcaagatgacttgtgttttggactctactagtagctcttgttctctactactccctccgtcccataatataagggattttgactttttgcttgtactgtttgaccactcgtcttattcaaaaaattttgaaattattatttattttatttgtgacttactttattatccaaagtagtttaaacacaactttcggattattatttattcaaagtactttaataattctaaattttttttgaataaga

SEQ ID NO: 17852 - DNA, 1288 bp, Oryza sativa
gggcgaattcgagctcggtacccctggggttttgcaactatttattggtccttctggatctcggagaaaccctccattcgtttgctcgtctctgaccaccattgggtatgttgcttccattgccaaactgttcccttttacccataggctgattgatcttggctgtgtgattttttgcttgggtttttgagctgattcagcggcgcttgcagcctcttgatcgtggtcttggctcgcccatttcttgcgattctttggtgggtcgtcagctgaatcttgcaggagtttttgctgacatgttcttgggtttactgctttcggtaaatctgaaccaagaggggggtttctgctgcagtttagtgggtttactatgagcggattcggggtttcgaggaaaaccggcaaaaaacctcaaatcctcgacctttagttttgctgccacgttgctccgccccattgcagagttctttttgcccccaaatttttttttacttggtgcagtaagaatcgcgcctcagtgattttctcgactcgtagtccgttgatactgtgtcttgcttatcacttgttctgcttaatcttttttgcttcctgaggaatgtcttggtgcctgtcggtggatggcgaaccaaaaatgaagggttttttttttttgaactgagaaaaatctttgggtttttggttggattctttcatggagtcgcgaccttccgtattcttctctttgatctccccgcttgcggattcataatattcggaacttcatgttggctctgcttaatctgtagccaaatcttcatatctccagggatctttcgctctgtcctatcggatttaggaattaggatctaactggtgctaatactaaagggtaatttggaaccatgccattataattttgcaaagtttgagatatgccatcggtatctcaatgatacttactaaaacccaacaaatccatttgataaagctggttcttttatccctttgaaaacattgtcagagtatattggttcaggttgatttattttgaatcagtactcgcactctgcttcgtaaaccatagatgctttcagttgtgtagatgaaacagctgtttttagttatgttttgatcttccaatgcttttgtgtgatgttattagtgttgatttagcatggctttcctgttcagagatagtcttgcaatgcttagtgatggctgttgactaattattcttgtgcaagtgagtggttttggtacgtgttgctaagtgtaacctttctttgcagttcctgaaattgagtca

SEQ ID NO: 17853 - DNA, 471 bp, Oryza sativa
tcgtttcggataattaactgcgtggcaagtaatgagaagttaattgtgcatttgtgccccttttttttttgcttgctgtaacctgaaatcgctgttgatgagttagaagtgactgcggtaaagaaaatgccatgcccaccttcacattatctatgctttgttgcttcacccttggtccatggatttcgatcagggggcggttgcctgccacttgtttggaatttacaggtcacctgtgcatgaatttgtgttatttgttttatggtgaaacaaataaacttgaaaaagatttctgctaatgctgatgcaccattgggttttaattcttcgtgtatgtctgcatcttgctgcagaaggatgtcagaattgggaactgttttgggaccatgctactatgctttgacattgttgttttctcagtttcacaatgtgatgaggttaacgtgcttatttattttctatatctacagg

SEQ ID NO: 17854 - DNA, 1444 bp, Oryza sativa
gccatatgcttctctttgaccccagctcacaagtagaactataggtctagctcacatagtcgattggcatcttcaacctctggaagatagtccgtgtagaacgatgcaagaactgatcctcccatcaaatccggtcgaatcttcctcgatctcccaaaattggttgagggcttttgattcactcaatctcctcttttcatttttattaaaattggagctaatccacaaaactgtgggatataaacggtgatttctaaatagagattaaatctagtgaattaaagaggaactgaaaagaaaaattatgtggaaaatgacgatggagtagtggagaattgatttttacaattaatcggagaagggaaagcatgaggaggttgatcgatgtggcggtggagctaggattcgacctgacgactaaaaaaccgtgtagattaaaaaaatcctcaccatgtacacacacccttccgcatgcaaaagaaaatacgaacaaaaaaatagggacagaaaaaaaacggatgaataaaaggaaaggtttttactttttttttattttttttacagttggcgatttttttatttttttaatggtcgatcggcttttttttttacccagcatttattgccaattttttttcgttccggtacgaattggacttttttttgtttttttatggtgcgttttcttttccgcgtgattcttttcgtccttttctaaattgcggattttgaggagtaagattaaaaccgactaaaacacggatgacttaccaaagtagcggcaaaaacatttttaatttttataatagtagagatagtgatataaaagtagaagagaacaggaaaatctggtagattttgaattgtgcggtgcaaatcatcgtgttcttagattttggtcatttgatcttctgcacaattttttgtggaccatgggaattatcgagctctcgcttacaactgctcttggatggttctggccagaaattttgatgaacaatgttattttatttgaatttcgtattggtttatcgaattttgtattatagctccaaattgatgtttcggtctgacttctatgtctgatgcaaccttgatcagcaatgaactgtaattagctaaaacctctactgagtgttctagttcttctaacaaacagtttggctacatgggatttatatttcactggcatctttgggtcacccaaatttacaggtgcatttgcattacacaaaagaaaattattcagggttgctaaacagggcttgagtgtgaagtttatatcttcttgatgtctcccaatcctagaccaagattttgggaatatgatgaaactttgtctaaagagtaataagtagtatcttcagtttcatctactacagcagtagaaaagatgcaaccacatggtttgcaagactctgtactgagccaagatctgcattta

SEQ ID NO: 17855 - DNA, 1501 bp, Oryza sativa
acgacgacgccaccgccgcctcccccgccatggaggacgtcggcgccgccgtcgccgcggtcgactttctggccccgccgtgcaagaggccgcaccacgtcctcctcagcagcagcagcgaaggcgtaggccacgacgacgacgacaaccagcacgccgtgatggtgctgaggaggacgaggagcgggagggcgttcccgccgccgatatcggtgatcggcaagggcgggcggccgtggctgagcctccgggcgcaccgggaggccggccggctcgtgctgcgggagatgcggctgccgtcgcaggagttgctgcagccgtgcaaggaggacggcaggttcaagctgctcatccacccggaggccggccgccgtagtggcggcgccggcgcggggccacgcgtaggatcaggaagggaaggacacggcgccctcgagtcttgatcagtagatcagacagaattttccttttctttggtctttagagcaccgtaaattcttcctctccttcctgcgataatgtgcatgatcttgccgttaatcaatacatgcattggcttgcagcttaatctccgatctgttcaaatgcgtctcgtgcctgcatgcttgttccgatctagtattccattgcatgagaattccagacacggctgcgcggagaactgttcagttttggtttctgcaagataacgcgcggaatcacaaggaagaaacagaacaaagcgaattttttttaacgaagttttattaatagagcagaaaaaaattacaatcctagaggatcgtaactagaaaaaaaattacaagattacaataccagaggatttaaaagattacaataccggaggatcgtaacctgaaaaaaaaatataagattacaaagcgaaaattttggttgaacacggaatcaactaacttgatcccctcacgggtgatctctctaacaaacagtataaatcacacgcacgtgagcttaagttgggcttttgaggtttgacaaaataaaactcacatggtgacatggacatgaagaaaggaactggtcacatatgttctaatatctggatccatttcagttgacaattcttcacaatttacaaatatctagacctcacactcttttaacacacagtgggaaacagaaaatgtgcattagctcacatgtgccaaagcttattgtttaaaactttatagtatagttttgtttcgaaaatgaaaattatatatagcatccaaacagccccttaatctgtaccattagacattcacttcttttttctcaccgtttcaacattaattaggagtatttcgaaaactgaaatcatttgagccgaaggctaacatggaggtagttagcagtaaccttgaagataacttctgggacccacctggcattgactgtgacagcaccgagccgttttactcggtagcctcttgttcccgcacaactcgcatcgcatgccacgcctctctgctcccgcacggcgccgcgctgcgagctc

SEQ ID NO: 17856 - DNA, 397 bp, Oryza sativa
ggagaggaggttgatgactttgaggaaattgagtttatgctcaagcaaatacaatcttcagctagaaaaatgaaacaaaaaaagggaaaccttgagattttcaaggtcactcctaaacttaagaaaaggaaaaagaaaccaaaagaattatgaaaaggcatattctggaatattagaggcatggggaacccgaaaaaatagatcatttgcaggacctaattagggattcaaatgtagactttgtgggaattcttgaaactataaagcatgatttctctgctggcttacttcatagcttaagtggacaaaaaaaaattaaaatgggaatggctactctcatgtggcaggtcaggggggattctagtgggtgtaaacatatacaagttatcatttgtaa

SEQ ID NO: 17857 - DNA, 1140 bp, Oryza sativa
  unsure (1)..(1140): unsure at all n locations
ctattcgcaatcatgtcgggtgatcaagccgacaatgttcgcgaggaattatccattaacaacattttctcaaatagtctagctgtagccgatgctatacatgagataagttgtcaatattcgttggtaggttgggtgcgacaactcaacatttttcgagaatgttctcgataatgcggtgtactcgaccacatcctactcgagtgctcaatcgttcctgaaaaatattttctagaagacaagatgtatagcagagaatatcgagtatatactcaaaagactgcatggatcttctagtattatcaggatataatgaacagattaaatatcggacattatgtaaaccataaacaaacatgatttatacagaagaaaatagagcgagcccccagcattaaaccgtagtcggcctaacaccggaaacacttgcacaataaatattgtatagaaaacatgctctaggtaaacataataaattatttatctaacaatattgtatagatcggaaaataggtacgataaattgtatataaaatattgcgtacctttgtagatacatgccgaatatatctacggaattagtagatcaatttaattaatctactaattaccttaattagccttggtagccgatctgaattgtcttctgtgcatgtacatgtcgtcaaatcaatgcacacctaggcatgtattgagtccatgcatatgtaggtgcacatgtcaggagcaaatagtacgtgatggtcttgaataatgatgtattcggtctcctcgccacgacttgtcgggatggacgttctcactatgtgttaggggtgaggataatccaggtcccaacagaatcaaaattaattgacgatgtcacttcccgggcagtcgactcgaacggaggcttnctggtaaagtcattgatctctngcggggacatactccggtcgggttagatctttctatagccgaagtcatcgagtattttgttgtcggagaatccatccctcgaacccatctcgtcaaaaccttgaagcaccaaaatccccctacctagcacgccactgttaacgtttgatattgcgactacgttatttagatggtatggggatcggtggtaccagggtatatgccagattgaggtaaaagaga

SEQ ID NO: 17858 - DNA, 409 bp, Oryza sativa
tgagcaaagaagatggcgattgatggcacatttttttttctaatacataggtggggaggatttgatgagatcttacttttttgctccgagaaattgagatttcgccaacacgaggggcaaagtggggagagaaatggagtttctctgcacgactcctgatcatattcccaacgcctagataaagagaggaattattttgggattgcattcaaaagcgacggttaattatacagaacaccatatattgtttgttagagaaaactcttatttaatacctaaagcacttatcagtctacataacgtatgaaatcggttattgtgcccctaaagtacgaaaagcgttccacataaagtattctatagtttctgggaggtacttttaagctagttaaagagatatgatattagg

SEQ ID NO: 17859 - DNA, 1501 bp, Oryza sativa
gtaggaatgtattcctagagcgtggctccagtggcctccaggtccatatgcctctgttgtccacgctttggcaacaccaggcattattcccttcttgcgaaggaggtggcgaagacctaagccattcgtcagcgtccctttcctctcgagtgcgtggtagtggacactacgacctcgacgacggttgttacagtggaagaagacaaaaaaaaagagaaagaaaagaaaggaacaatgagcgaaaaggagaaggaaaaaagctaaactgtagcaggaagggtgtgaatttattttttctgccatggttagctgtgaagggggccaaacgcaaaacatttgccaacgtggaggtgcaagtcgatacgctttgatcaaatcaagataatgaatttaaatgtgtattttgcattcacagatctaaatgataatataatgtaacgtgtaatgtatttcactccattaataaaaaggtacgttggttattgatgttgggagctactaaatattgaggggttttgaacaaacacatactgtatgtaacatggtgtggcgtggccggacggatgatatcatggtcctgattgtaacacgaacatgatcctggcgtcatgtcataacagcctcatgctttaagtccatctacatcacactgtgttcttacaaattcttggtaaatccccttgactttggactagagaagctaagaagctaccaacgtcgagacgaggtgcatgttcttcaatatctgctatttcgccaagcaaaggtgtcccagcgaccaaggtgtgtttttatccagagagagaaaattacagggaaatgttacccacaaaatgtttgatctaattgactacaggaaacctatttgtagacgcagctttcctcctcctcctcctcctcctcctcctccttcttcttcttcttcttcttggtaaaagttcatgctcttcaatgtggaccgggcggccctttctgaacttcttttctgatacgaaaataggccataaatgtggggaaaaagtacaccgaaggtccctcaatttgttatcgggatataaaaacgtcctcgaaccgcaaaactagatatacggtgtcccttaactatacaaaaccggtcacccgaggtccttcggtagtttcgaccccggttttagtctacgtggcggctgagtcaacgtgggacccacgtgggccccacatgtcagactggtcatgtcatctctctctttcccatcttctctccctttctcctctccaacactttcttgtcagggactctcagcaggccgacggtcgaccgacaggtgcggaggaggccggtggggcgagtcgggagaggaggtccggttgcctgcgatggccggtgctgtggcggctgctccgaccgagggtgcaaaggaagaaggcggtgcttttgcgagctcaccggcatggactctggcggcggtgaggtgagcgaggatacgtggggtggtgagggcagagccgcgggtggagaggc

SEQ ID NO: 17860 - DNA, 1501 bp, Oryza sativa
cgataccagtcccaggaaacagtgctggtatcacaggaagacagaatatcacaactgcaatacaaaaggggaaacggaagccaggacttggaccaatcatcacaggcgcgacttgggaactaggccgaaaccctaaaactcatcgtagccggcttgctcctggaagaactccacatcaacaggatccgcttcatcttcttcagcaactgggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttctcaaacgacacggatgagacagtgcgtctcgtccggtcggagtatgtgcaatgtatcagctctttagaattgaaacaagattggcacccggccaacagctttttaaacggccacccgggccaacaacttttcaaacggccacccgggcctagctgatcccgtcagctgctgatttttcagacgtcgaacccattttcacgacagcaatttcacaatcagtagtcaaacaaaactacgctaggaatcacctcacatccgcccatgaccgtgggcacgactgttcgaacagtttgttaacctctgcagagggggtacactttacccacacgacattactaacccggatcacccagcccgaggggatcagccacgtcgggagacctccaagctttcatgacaaggcatttcgaaagccgatacaggtttaccatatgccgacgagaggggtcccagaccaacaacagggtaggtcccagaccatactgtgccagcaagcccaggggtcctccccgacaccaccccggtgaatccacatgtctctcggcatcaaggctcccctgataagctagttactcagccaggggtgtcccattccacccatgtggtcgtacttatcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttggtattcagattttaagtttgaaggcgtccgtcgatactcgcacggggtgcacgaatatcgagacgcaactagatggttacaaggggaccagatatagcaattaacaatggaaggatcaaatgcaacaaattgggtaagtccgccaatctgccttgcagacgggacagcagattaagtgcgatcctatcaatgcataatattttttttcaagcaacataattaaatttcaaatataggttcaagatgttcaaaggtggcttgccttgctcgagatctggagcttgatcctcgaaatcctcgcactgcgggtcttcgggctctgaaactacacgcgaaacgggacaactcaacaaac

SEQ ID NO: 17861 - DNA, 1501 bp, Oryza sativa
agattaatttaacttctgatcaaatagctaggctaaacgatcgtcttactaaatgataattcttacacatgaaatcctgaatactaaatacagtagtcaggtctcatattcacgaattctttcagtaaatcctagtaataatacctttagcttttctgcatgaaaggctggattcataatcctcctatgtttgacccatttttcaccatgaaggatcacaagcccaccaacgagtaacttagaaagccgagtggccagctttgtcttctcaaagtgaccaaatttgttcgatagaacttcacggaccaagtccggatcagtgattgtaacccttggcattggcccgaaccatgtaaaagaaaccctacctgtattttcatgcgcacagagatcagaacatggtacaaagacactgaaaaaaacaagataattgatgatcaaatagtggcatttctagatcaactgtacgatgaacttaaagttgcataacaacaatcaaatcttggatgtgttcgccgaaaaacaaaacaaaagaaaacaaatattgcagaagtagagcgagtacagtaccgtgttcctccaaggcacggtgaagcagaggcgcgacgcgcgggatgaagtcgtggggccggtccatgggcacgggcttggagcgggccgccgtgacgagccgcaggtcctcggtgaggtcgccatggaggaagcggtactgggtgcccctcaggccctgggccctgagggcccgttccatccgccgcggggccagccaggcccactccagcatctgcgcggcccagaccagcagcagcgcggccaccgcgccgccgagcaggctccacggcgaggcctcgccgaatggtagcgccgcgccggtgccggtgccgatgccgatgccgatgccgatgccgatgccgatgcccattgcttctttttctctctgcatgtaccgagcaaagcaaatgtgttgttgaagcaaacgggacggagagatcagtacgtgtgtgcagagtgcagtgcagatatactaaccaattactaacaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattacggtagtgaatcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgg

SEQ ID NO: 17862 - DNA, 1501 bp, Oryza sativa
gatctagtgattggtagggaatgtggcctctcgccgcacgacgctggttgatagtatcgcgaagatcgatgggacgcctgcaacgtggagagcgaggctgttcagccggacgctccctgtgtcggtcggcaggtgagtgaacagatcgttcaccatgatccctgctcctgcgactagatcccgcgccggcaacgctaaggcttggttggtgatagtctttagatcgaagaggtggaactcggctgtcagtcggcatacggacgcttgagaaaatcactgggaccgaggcgacgatcatggtcttggtctggtttaagatgttgacgacgtggtcaggtgcatcttgctgaagtagagtgtccagaagggtaatcgcggctaccgcgttctgctgcagggtgcgaaaaaccgccgtcctttcaatgtcttgttgtccgataagatctcgtgctcgtcgcccagcctccaaggcgcgctgtcgccggtcctcagcctcctttgcggcccgttcacgctcctgttgctcacgctgcagccggtctcgctcctatgctagtcgctcctcctccagtcggcaacgctcggcttcttgtcgtgcgcgctgttcttctgcttctcgggcttgacgctgttctgccgtctcgttgtcagccatgaaaatgccgaagaagagaggcgtgtagttgtcttcgtagctttcgtcgaagtcgtcgaggttgctgtagtcgtagtggtagccgaagtcgtcgtactcgaggatctccgtcggtcgagaatcgacaccggggttgctaaggtagccatctaattcttccgtcaaaaccgtcccgagaggttggagtataacgccgacttccctggagctagattggatcggggccaaggccggatcccgtctaggcctacgggaagaagatgtccttgtggtgaaaacagcggccaaatcgtcggggagtttcatcaggattgagggataggccccatcatcttgatcaggtcgtgtcggagtagattggatctcgttcgagtggtttgaagccaactcggttgagatgattttggagtagatctcggccgagtttgggataccgaacgggacggagacctggcctctccctgactggttcggatccgagtcaaggagagaaatcttgccaaagtcgttggtgatgaagtcgaggctgccgaacaggaacacctgctcgggagggaagacgaagtcgtcgatgccggagacgaaacccatcgcactagtcggcgaagaacttgacgctacccctatctggcgcgccaactgtcgaaacaagatttcggcaatactaaaagggggtggctatcaagctagaaaagtggatgggtttagagacaaggaattttatacaggttcaggccttcttaataagaagtaataccctactcctgtccgaggattgatccgccgagtatattattgatcgtatgatctgagagaaaaatcgtgccccaagaggcacccggaccc

SEQ ID NO: 17863 - DNA, 1501 bp, Oryza sativa
tcgatcgcagccccgcgatgacgggcctcgtagtacgcctccaaggctgggtaagtcggcggttgtccctccttggccatcctacatgaaaaagtaataaattcaccgttagttaccaatatgacatatattaaaagaaaatgaatgcgagaatccaaaataaataaatagacattaaatagacaagaataaaacatgcattgacttaagtaggaaaacaaaatatttacctccctaacacttctatttttttttggacttcttcttttttggatgcttaggacacttaggtttcttgtgaccctcctggtgacacaacgagcatctattttgcaccggcgcagcatcaagttgaacacatgatggtggtttccttccagaaccaccaagacccgagtccatttcgttcttgaatcgcttcgatctccttttccctcttgtttaatcttcaaatttgggtcagcaacaaattcttcaccatcatacggtggccactgtgtggggtcgaggtatggctcaaagcgacttgcctatgtgttcacaacggctcttgaagagaaatgatacggcattcggttgggagattcctcatcaattgcatgaatcagataaacgtggataagatgtgagcaaggcatatggtagagcaatggcctttggcaagaacatgagttcccctcatcttcaactttgaaggctcttgcgccgaatctaacaccaccacgcgttataccacccctctctgtgacctcgtatgtctttttctgcttatcaaaacaccttaaagtgtgtttgttcgccttacttttttgcaccttcatcttactagtaaccttggtggaccaacgctcccctaactggactcgcttcactgcttcatcatgtctgttcacaaagtaatcattgcacttcatgaatgtaaatgatactatggccgtcactggaagcttacgaacaccaactagcacgctattgaactgttcggccatgttggttgtcatttaaccccaccagcagctatttctatcgtatgcacgagaccacttatctttatccaacaactcatcttcaagccatttacgaggaccttcgggaatacgctgcagtagtgcctcaacatccctctcaaatatccacttctcgtcaatctgacatatccttaggagcacttttgtctgatgcttgtccgcaccggccttgtggaaattagcactgaagtgcctcatgcaccatcggtggtgaaccggtggcaatcctagaacaggagtcctcatggtattcattataccagcatgtcgatctgagataatacaaagctccctatgcggcccaaccacaacccgtcgaacaagatcgataaaccagcgccagtctcgtgaattctctttctccaccaaggcaaaagctaaaggtacaagttggtcctccgcatcagctgataatgcagtcatcaaggcaccaccatatttcccagttaggaaggttgcatctatagctagta

SEQ ID NO: 17864 - DNA, 1501 bp, Oryza sativa
tccgaccacattatcctcaaaagtttggttcgcaagatcttgtcttccccctttttccgttcactgatcctgaaacagagcatgaaagtctacttcaggacctgcaaaaacacggttattcatttttctccctttaataagcacaaacagaaaaccatcttaaccaattatatttatatgtcccgaactgcccaaaacatcgaacagagttatcatggagatatgattattgaaccatatgtgatgaagctttaggctgagttctttctcgattattcgtcggacggactatttgatacattttttgatatatatatatatatatatatatatatatatatatgctaaagataatttgcttccacttaaatgcataggcaacttattttaagctatttgctactttatttcttaaataattaacttatctatataatatattagacaatccgtagcaacaatccgctcaataatctgtgattattcaggaaacagtagcaggtgtgttggcttgatttcttcttttttctaattttcatatggctattggttttactccttccggtccttccggttccatattaattgatattttagacaaggctaagatcaaacttttataactttgaccatcaataactttaaaaatatttagtttaaaggaactagagcaacatatatagatttgtcttttaaagcactataataaaaataaacatgtatttatttattatatatattataataaaaaaataaggtcaaagatatatctggtagactgtgtccattgtttaaaacgtcaattaaaataaaatcagagatagcagttacttttgtaaggtatatcggttatattaaaacctactgggaatttgcgagctgagtgcgcttcggagcggcgtgttcgcacgcggaggcatccacgtcgcccgcgagcgctgggaggcgggtggattccgcgccccctcgagcgtccgcgcgagcggctcccgcgccgtccgatccctcacagcaacggctgagatcgcacgtggttcctagcgtgggtggacatttttcaaaaagacccattcttaatagataatttgttttatatccctcaccgtacgatccaacgttccgatttcttacgtatatactctccaaaactaggaaaatcctatgcgacgaagagaaaaacacgaaataggattgcgctctaaaaaagaaaagtcaaggggcttttctgaaacaacataaatccctacccctttcggcccttcctccccgaaaccctagccgccaccactcccgtgacggtgcgtcgcttccccctcctcgcgccgcctctccccgccacaccgacaccctgcgcagttgcgccgccgctccatcctccagcacctaacctcgccccgacaccgccacatgcttcgccgcatgtcctccacttcctctctcttcttgctgccgatgccgctgggctcgagctagcgagtaggtcgatctggctttcaatcag

SEQ ID NO: 17865 - DNA, 624 bp, Oryza sativa
gcagcagacttcagcccaagtgaggatggcaaacgctaagattaagtgactaatggcatattttctttggtgtcactataaaacctcgaagctaaacttcaaagcattacccatgcaatattttctgcatgaacaatttatcagtttagttcagttttttgttcaagttgctgggaacccattcaaccagaacagagtttatgtcatgtattctgctgttctgaagactatgtagttcttgtggttcaaaataatgcagggcagagagtgcacagcacttatttgtatcgcgccaaacataggcacttgatcttgtattgatttgaacttggtagatgcatgtggttacttttgaaatgcaatgaagctgcttggaatataaggaaattgccgatgatctaaaatgctaaacagcagaataatatccagtgatacattagaagttcacaaatgagccacccacgtgaccaaggatgcggaattgggatagtgggtaacttggcacccccaatgatcttacatatggagaataaatatatagaaaacgattttgctatatttctgttttggtctgttttcagtcgtagttctaccgctcgtttttgccttgagcctatggcacca

SEQ ID NO: 17866 - DNA, 378 bp, Oryza sativa
tagaatgacttacattgtgaaacggagggagtaccaatttaaccctactttttggagtttgcttatttgaccctccttttaaaaaacgaagctcctctctgaccctattccttttaggtgagttcatggtgttaagttagaggtaaatagtccattttgcccttgcttatttgaccctattatatcttgcttgtttgaccctactatgtcataccgtgtatatatttgaatactttgacatatttgtaataattttttcataagtttcacattgaagacaagtttgacagatttgtcataaatttggcaaatttgaatcattttgtcaaatttgatagaattttgacaaaataaattaaacaaaatttgacacagtta

SEQ ID NO: 17867 - DNA, 1501 bp, Oryza sativa
ctcctccctccgcgttcggcgccgccgtcccctctctacacgtgttggtgctgctgttgccaccgcctcaccctccgtgcacctacgctgccaccccgcgagtcggcgccaccgcagctgccgcttgcaccgagagaaacaagagagagagagataagggtcatgtattgaggtcgggaaatgtataagattaaagggaggtaattttggtttgttagagaataaataatttttttcttttgcgaaaatgaaaccctaaatggtttagtgcaaatagggttcgattttgagatgtaggagttcaaattgatagctagcatttgaaacagggtcagataagcaattgttccatatttaaaaaaatacatacagatagatgaaacgaaacacaacttccatgactgcattaagatatcgataggaacaattttttttgaaaggaatatattgataaaaacatatccagtttctttttcccaaatcttaagtcatagacttcctaatcctggatagtttcaaactctaggaagcaggatcaggatacttgttctacaatgcatccgtttagtgcaacaaacagctctacgggtggcaaatcaaatgcaagtgacaagaataggattttaaaagaagaatagaaaacacgtagaatattcataggcatgcgaatgcaaaacaaataaaaaacacaggaatagtcattcaaatataccgtaggaaaaccagaaaaccataggaatcaaatgaaagatagaattgaagaaaatttttcctaagatattaataattgctaactttcctctaaaatctctacatgattatccattctaatagaattttaaaagggaaataacagaattcaatcaaattcctatagaattaaaatcctttaaatttactatattttttctacaaatcaaatgcgcccttaaattggtattcttgatgcataaaatttcagaatctccattacccaacaagattttaaacttatttgctggtcttccaccagaagactctaacgaaagatctgctggtctcatcacccaccggctcagaagaatgcacaagatcggtaaagtcggatgacctgtgcggatcatgcccccatcaacggacatcaatcttagattgtgtttagatttaggggtgtaaaagttttcatgtgtcacatggaatatatacgaacacccatttgaagtattaaataatccgtcagtaaaccacgagataaatttattaaacataattaatccgtcattaacaaatatttattgtagcaccacattgtcaaattatagaacaattaggcttaaaagattcgtctcgcaaattagtcgcaatctgtgcaataagttattttgttagcctatatttatataggtgttcaaacgttcgatgtgacatgattaaaattttggggtgggatcttaacacccccttagtggacaaacagaatatatctattctaaatgcagttccgcaaacccgaccaaaattc

SEQ ID NO: 17868 - DNA, 1501 bp, Oryza sativa
agcgagcgagcgagaggagagatagacgttaccagtgatgcagcgatgagcgattcctcgttcaggcaggcaggcaggcaggcagccgctgagagaggggatcggtggtggtgtggtgtggtgtggtgtggtggctgcccccctattactcgtgccgaattcggctcttttttcttttttcttttcttttttaatcgttggatgtgtcacgtgggtggcctatacattggcttcaggtccatcaattgttgtaacgcgtatctatgcatctgttcttaaaaaggttaatttgattcataccattataaatgtgtctattcatataaatatcgttataattcgtttattcataaccatgtctctcgaattttataaaattagaatcataacagcactgtcactttttccatcttcttcctcatctacacgtgggaagcacctgtcagattcatcttcttcctccatcttcccctcttctcttttcttccctattctccaccacttgttagcatcctccccaccaatccatcccgaccccctcctcgctgcagagtatgcctctaccctcgccaacgcgggagtccacgtccctgacctccgttgcctactcaatcaatgcaagaactactcgatgtttggtgcacgactgtggcaacgagttcgacctacggccgggagaagcaccaatggatgcacgatgacggcacgctcgcctactcaatcgacggcgtctagtagcgaggtactcccacttgctctggcggcctgttgctgtgtgcggcaaggaaggatcaggatggatgtatgtggaagaggctgagaagcggtggataaagatgggaaaaaaaggaatatgggaggatgaaggaagaagatgaatctccaggtgggtcccacgtcaagatggaggaagatggaaaacatgaccgtgatgataatgttctaattttataaaatttgagtagcatagctacgaatagataaattgtattgatatttatctaaattgtggagattatggataccccatacccacatggcatgtatatccgactgggtatgggggtaccatgtatagatagatagaatatctttaaagggtttcgggttaaattcctaaacttgtatatcaaggaagcacccgggatttcagtcggttacaattgtattttatctataactgcctattccgttaggaatatgggctgtactttgtaatacggactccttcccctatataaggaggggtccgggtgcctcttggggcacgatttttctctcagatcatacgatcaataatatactcggcggatcaatcctcggacaggagtagggtattacttcttattaagaaggcctgaacctgtataaaattccttgtctctaaacccatccacttttctagcttgatagccacccccttttagtattgccgaaatcttgtttcgacagttggcgcgccagataggggtagcgtcaagttcttcgccgactagtgcga

SEQ ID NO: 17869 - DNA, 1501 bp, Oryza sativa
accatggcaaagggagctaaattgtagcacgaattcctcacaagcgtgcagcgtacaacatttattcagccaaggccacacatctcgcacatcaacaagtgacgctaaaacgagatcatcaggaaaaagaaaaaaaagatgtaaacgcttgcagcagcagagagagagagagagaacgcagcgaatcgataaagtttctcactacagcttgtacttgtagcgggcgacctcggagtcgttggggaagaagcccatgaggcggccggcggagttctggtaggcgtacatgaaccctcccatgaccccgatgagccctcccgtcaccatcgatggcccgcggatccccggcttgatccctgcaaaggacgcgcggaattgaggcctcctcctcccaggggtggaacgtagagaggggtggggggaggacgtaccggagaggtagccgacggtgacggagacggcggagatggtggagaggcggaggtagtcgagcgcggagaaattgccgacgaccttggtgaagggcgggttccggtccaccaccgggtactccggcttcaccgacgcggtgatgtcggtgttcatctcgccgcgcggcggctgcgggttgcttccccccctcttggcggtggcggcggcggcggcggcggcgaggcggagacggcgagatttggtcgtggggatgagctgcagctgcggtgcgtggtgtggcctccttggaagctggaaagtagcggcggctaaatgggccgggccaaaacagtaaaatgggtctagcccagaaactgcccggcccaaataaaagaagcgacttggagtgacgccccgaatttttttcatttttagattttttttaaaaaatatttacagaagtaatctatcggccaaaaaaattgcaaaaatagaccctgccgcccacctttggagcggcaagctgacgtggcaaacggggaagggacgggcggtgacggagggagggtttttttgcaggaaagcccttgccgccctctgttggggcggcaaggggcctgaatgcaaaaaaaaccagtcggggccggcattttgcaggcggccccttgccgccctctggccgggcggcaggcctcgctgcctataaaaggcctgccgcccagctcccagccctcattcctcccctctcaaatccagtgaaaaaaaagaagaaaggggaggagaagagaagaaggggcgaagccctaccggattcagacgccgatttcaggtaatattcatagatcctatatgtgactattgagttaaatagtgtgtattttttaaaactttgtttgaataaatgcattatatttttagggttttagttgtactaatctagaagtgcgtattgcagatatcggtaactacgtagatctgctagtttggaatcaatactttaccgttgcattggcatacacaagaagatattacgttgtagatgtttattgcatgaaagagtaatataatctagttatttcgttgacagata

SEQ ID NO: 17870 - DNA, 661 bp, Oryza sativa
ctagtgttagttatcttggttagataaccaagccgatgtaaatgacctgtttgagtgaacttaagattctaaaaatctactagttgaaagccaggttctgagaatttgaagaagttgggttttccagcttctagcttctagattattttttggattctacaactatatattctcaaaatctgggtaacaatataatctgtttagggggagctggagattttgtgagaagcgttgctagaacctcctctaaacagacccaaaatctcccgaacacatgtttcgaatgggttgggcctaaaaaagattcttacagagatggcccaagccttttagtagcccacaaggcgattctttctctctctttcagattcgttgtctcactgacaagtgggcccactaagtactttcaaataaaggaaaccctcccttgtttctcggaggaaaaaagctaaggggagctggactgtttgaaagtttgaatctttcggcttctcatctcacactccgtacacccagtccatacacccatagtatccaccaccaacgcattagccctcatggtccatacaccatgtccacgtaaaaaaatcgctctttgccatccaaaggttcgatttttatctccttccttccatctctctgctcacttcacttcaccttc

SEQ ID NO: 17871 - DNA, 373 bp, Oryza sativa
cggaggaggtattctttgaacacgtgttaaatttatcatcctatacatagtataatactcctgtattcaagggtacaatgttcttctagcgctcaagagatcaaccttacattaagactacgatgttcttctagcgctcaggagatcaacttgcgacaaaaacactagtaacaattcaattattgggatattaaatatgtgaaggaatataccaaatatatgaatgggatgtaagttgagctatcaaaaggacaataccttattaaatcaagttgatcaattatttgtactagcacagtagcagcaactaatggtccagcagaccagcaccaagtggtggtgtgtgatggcccgcgaattgtttcttggcaga

SEQ ID NO: 17872 - DNA, 1501 bp, Oryza sativa
ttttcgcaccgtctctttttttttctccgtgcgtggtgcggtttctttggatgacagatgggtcctacgcgacagtggatcagaaggattagaggattgctggatgaactcgtactttttatattaatatataaatattagtatagatatagatcatgtcctcttccaccgtcgtcaatcgtcataccacgggcagtggcaggtgaatcacgcgcgtagacacgtattcgacttgtgagttgtgaggtgtgtgagcatgaccccactctacgagcggatcaggcaggccaatgaaaggtcagggcagagcagagcgagggaggtgtggcgtggcgtgggcttctctcctcgcgcactgggcaacacccccacgcaattacgcaggccgaaaccgaaacagccgaacatccccgcgaattttctcggttggctcgcaggctagattcttaatgggcttttgcaggccgtgtttcaactttgttggaataagtccacttactatccctcaactttacgtcgagtacttgaatctgtataacatccctaatcaccaataccagaaatatctaccctcaagtattcaaaaccatgtaaagtaagtcccatgacatgtcatgtgcggtttgctgacgtggtatcctagtcagcaaaaaaatatgtgaggccaacatgtaagtggcccagccactgaagatttcgctgccaagcagcgctcggtgtgctgccttgtgccggcgctcctcttgcccaccatgccgaggcagcctccagccgaccgaggcgtcgccgtcccctagcacctcacgtagccctccctccctccctacttccctccctccctcctctcctcgctcgcgctttcgtctacaatctagagatcaactcaaatgggaaaactccttcgccaccgttgtcaccatcgccgaggcgctccccccttctcatgcccctaccccactcatcacttggcccacccccaatcctgagctggaccgtcgtcgctgcctccatcggatctaggagcgcgaagttgcctggatgccctattccccactcccactcccgtccctcgtcttccaccttgatcacaccggggaggttgacgcattcgcgtaaatttgtagagtaatatatttataaaaaatagtagaaaaacctaatttaaaataccattatttttttctactaagtgcgtcttttttttactttatcgtttttatcataagtctgtacgtacgattctttacctactttttttttcttccggtgaatagtaggtaagcttcattttttcagttggtacatacgtacaaagtatttacatttttttttctttttccaacccacagaatacaggaggaaggtatcactttttttaacaaaaacaatacactaatttaatggtctaaaatattgggtccaccaatttaagtgaaaatcaatggtgagattagacattatcatatgacaacttaaaagtgtttgtaggagtgtcacgtgg

SEQ ID NO: 17873 - DNA, 220 bp, Oryza sativa
taataagtaagcacatggtaacaaaatttatgtcaagaagaaaaaaagcttgatgcacagatagagggtcctgcacaagcgcttctcactatgctagatgctatccttcaactaagttaatttggctgcacagttccattgagctatataccttctaagttctaatcatgagtttcatattggtgtgatgagctaatgacagatagctctgtcctgcagg

SEQ ID NO: 17874 - DNA, 1501 bp, Oryza sativa
cagaggaagacatgctgctataaattattgcctttgaacggtagaatcgtagtgtgcaccgtgcagccacgtcatatgaatcgggtgatctacctgttcgaagaacgggtctggcctgccaaatcggtagagaaaggccagaacggtgatgttgccattttcgttggtgtgaaccatgtggagctccagtgggaacctgccagagaaaaaagttacaacgaattgtgatcactgatcagcacagaaaaggatgatccattccatatttccagccgtcgtctgcatttcgtctctgttatgtgcaggcaggcgcaaacctgaagccgttgatggtgtgctcggaaggagagtgccagtgcatctgcttcagcgtgtacttcaccccgttaatgctcagaacccctgctgcctcttcgtaccgcagctgaaggaaacaaaaacgactaactatcagaagactgcacaatcagaggagggacagagtagtgttcagtgcaagaggtttggttcagaacaaaccgcgacgttgaagatgttgtcgacaagagtagcatttgcagcggtataatttctatggagtggctccatattcagttcatgaaccaggttgttggtgtcgatgtcaattggggactgctgctttccgttcgagcaacgcgtgaagtcggcactcaaattcccccagaagtcagggccgatagaaccagtgtacccaaacttcacgccacctgcttccaatcaagaattcacatatctcacatcaacgataacgttagaaaatgataatattgcgaaacttgattgtgaaattgtccaaattgacagcagaaacggaagcaaggaattctgaatgctctcatgaaggcatggaaacgactgtaacagtagataaatacacaagcagagtagacagggttcagacaaatactcaatgcagggtagaagaatgtaccgctgtcacatgcaagggacgggagaaagagagtgcacagcagcagaacaaagatcgcatttccatgagaagctgccatcttttcctgcaatgcaataaagcctgcaaacggagaagaaaccacagggcaagaacagagagtagtttggagtcaagccacttgtagaatgagcaaatatataggcattgagcttaatcgcattgtcgcaaactggcaatgtcatggaccaaccacaatccatcttacctctactttgctatatgcagatcagcttcaaccctttggagtttggtccctggaaccaaagtggccgtgctccgactagtagatgttcctgcgaaaaggacaggcaaaagatgtcgattctctgcagccatcacaagatcgatcatatataaagtgtgcaatcatgctggggcaatagtgatctgacctctttgctcgacggctgcaggaatcttcgaaggccagaagatttccaagagcaagaacgctgctgctggtgaaggtgctaacttgggcggtttatccaccagagttcagaagac

SEQ ID NO: 17875 - DNA, 1501 bp, Oryza sativa
ccaatagagatatctagcaatcttgatggacagagtttgacatgaataggagcagtcttactgctagtcatcgtctcatcttcaaataattctgaatatagatatgggctgtgtttagttcacgccgaagttggaagtttggttgaaaattggaacgatgtgattgaaagtttgtgtgtgtatgacatgttgatgtgatgggaaaagttggaagtttggaaaaaaactttggaactaaacacaccaatgatagtgatgataatatagtatagggatatagataagctgttactgatatacctactgctagtcctcatgagttgttcctacatgctagcaatagtgtttttcaagatgcagcacagtagatctgaaagacatggaattcctgcttcggtgttacccatcaaaccatagcaattttagcaagtacagttaaaattagcatcaattcaagccaaatatcataccatagcaaggtaacaggaaattccaacaataaagtattgtcatgtagaaacgacacctaactccatacaaattacctttatgttggcctttgccatatttttttgccgtatgtttcgtttttctttagattcagagttcagttgaaccctattttcctttttctcatcacatgaatcctgtatttcttgaacctgcaaggaccttatgaggaacaattagcaactcacatgaagaaaaaaaatgttactgacatcagcagcaagacattttacccaatcttgctgaagatatcggtgtggagcccctaatagtgaccatggtggcagtggtcgaacaaatttttattgagtatttcaacaaatgcatggtcaacattttagcaaacaaatagtgagcacgctgctgtacaaaagaatgactggagggaaccatataacaaatagttgaagaaacataatctggatgcaggtggattccttgggctagctgcagataacattttcatttttgctaaggtgcagagcatggactaaagtatggactcaaagatttggaacagagctctagaattcattagagtttaccaacatttagaacagagctctagaattcacattggctgggatctaaatacaaataacatgtcaacactctgtaaatacaggagttgaaaataacaatataatgcaaaatatgatgccgaatgtataatcaaacactgcaacagattttgtaaatacaggaatgtatagtgcaagatcgtctaaactactgcaacagattctgtacgtgaatcaaacaatagcctaatgagcacattgcttgagatgactgataacctggcacagcgagctacctccggcagcctgagggaagcagctccagccagtggagtgggctgcactggttccatgaccagtcaacgtgaagcacagcggacgcaggggttattggtgtcggcggcaaggcagaggcatgggtgggttaggacttagcagtgcgtaccgaggacagcggtggccggtggaga

SEQ ID NO: 17876 - DNA, 648 bp, Oryza sativa
tccatcaatcaaagaaatggcccgttcaacagtttaaaaagcgtgctaatggaaatctaggtggaatttacatcttaatcggaataaaatgggtcaggtactttttgtgctaaccggtatattttgtgaaaaaaaattctatatagaagtacctttataatattagataaatctattttttaacatttataatacttaactcaattaattaaaagatagtggctttcttgttttccgcgctctaacttaattttcatcttcattacaaacaaacaccaccttgtgattgaacacacattgtatttgttttaaatgtattaatttgatctcttttttgcggggaaagtatttatttgatctaataagttagaaaagattgcacattgcactcatgacccaagtagttcaacgagcacgcacttggtgttaggaaagctctagaaattcaggcccacatgtcaggcaatcaaggagaacaaaatagcagttggcagagccaccttgagaatacactagttctgacttcttacagaagttgtccttgttgcaatgccaaccatttggcccccatgcttgcaatgcaaccagcctctttatggttatcacaacaaacggatgctcctggatcattacatatatcacaacaga

SEQ ID NO: 17877 - DNA, 417 bp, Oryza sativa
ttggtgattaaagttgcaaatatataatgcactcttacactctctcagtacaaaatactaatttgttcatacattttgtagatgcatattaatgtaactggaaattaaaatggagcaaacaatgtgttttctgttgatcttatgcatatttggtttcatcaaaaatatttctcgagttgacatatctctaatttgctctagcaccccctcaatttatattctagattcgccactgtacacgggtattagctgtgatcgaagtccatcgatttctcacgaaatgacgttttggtttgatattgttaggaactaatcaacccaagcggaagagtattttgggtgcgtgtgtggtgaagtgcacgcacacttaggaccctgcaacagatggatccagggtttacaaaatcgttttatagt

SEQ ID NO: 17878 - DNA, 1501 bp, Oryza sativa
tcatttgttttattaaaaaccattgcaaatatgctaaagtgtaggtcatatttatattttttaatgataaaacatgttgcaataaaataaataatatttatatagatattttaattaggaagaatggttaaacatcgtgtcaatagtaaatattttgctcgcacgtcactatggcaaaggccaggataaaatacatcttgtgcaacgataaaatatcttctttacctacaaaaaaacactaaatcggacaggaaggacgcaatttgcagatatagtacagtttggactttggaccaatgattaaatcacaacaatccagtgggtttgctgttggcttccaacttgcaggcagcatttgtgacaactgaaaactaaacataaactgccctctcgtggataatcctgacgtcttgacgcacgtggtggtccatccttcacattggcgtcagttcagatttgttatatcaattgctgatgcttttcttttgtctcgtagtactaaactaaactgaatctggttttgacaatttctttttccaatgcagatagtgtttttcttttttcttttttgatttctttcttcttgatttgttttgcgtggagtacaaatagtgttttctttttctggaggtgaagcactcctttctcaatccgtacgtcaaatcactcaaggcgtatatacattatttattcgtaagattcgcagccaaacgcgttttatgtggtatcatgatggttgtagtctccgcggcgactttgagtaaaaggagaggcaaaatttggctcgttttgatttgattattgaacagatttacagattattgctaagaattagtactatctttgtctcagtgcagttgtgagattccgaattcaacttttaaccgtatgtcttatctgaaaaattatattttttcaaaaaagaatagtcacacataaagtattattcatgttttataatctaataacaacaaaaaaaaatactaatcataaatttttttaaataagacggacggtcaaacgtttgatataaaaaaaatgaaaaactataatctttctaggatggaggttgtcaggttacggataaggtataccctctattcttagatgtacgctatacgacaatataatatatctgcgcgtatacgaacgttctctatatacgctaaggaaattcatcatggagtccacagatggaaagattcctacccggataggaatgggtcgttactgtatcgtgtagggtccgatgtctccgagtcctacttggaaaccacctgacctgcggtataaaagggacccccgggaggacataaggcatcgaatctcataaataagacaaccaccacagcctacgaagtcaaagcctacaggagccaagccgccgggtgatctagccgaaccaactcgactacgatctcgtcagtatcatcgagttctgtcattccctttgtaatttgtggttttcactatataatcccataccaactgaattagggct

SEQ ID NO: 17879 - DNA, 463 bp, Oryza sativa
gcctgcaggtcgactctagaggatccccagatcgctatctttagtcccggttcaaatacccgggactaaagatgtggtcccggttggatggtttttttcttttttttttcttttctcttttttttcactgttcttttgctatttgcccaaatcatctcagatcaaatattcatagcaaatcattcacagcattatctcatatcaaacattcacagcacacagcaatatagttcatccaaatcattcacagcaatagttcatcccaaatcattcacacaatagttcatccccaaatcattcacaacaacaacacaaatcaaatcacgcattcaacacagattgtatcaatcaacacagatcgaatcgcacattaaggaaaaaaagaaaaaaaaaatccacggcagcaccggctccaccgcctgccgccgcaccggcctccgcgccgaccacctcccccttcaga

SEQ ID NO: 17880 - DNA, 1501 bp, Oryza sativa
ggaaagctagggttcggaggagagaggtcgatccgaatcgaactcgaatccacggatttccaaaccgaattaggcgatgattccaaaagagaaaaggaagaggagatctcaaggatcatttcccctctatcaattcggccggagaaggaaaggatcgaccgaattttggaaggagacggcggcggcgctcggctagggtttcgggcggcggcggccgaaggaggaagacggctccgacaaacgggccccacctgtcagcggctgagagagagaggagagcggcggctcggcggattgggccggactgggccgagggagagagagagagggttttgggccggctttcggcccaaagccaaaagaagactttttaaaacctttttcaatttaaattattcatgaaatgcaatcccatttattaaaaatacttccttagctcaaataaatcccagaaaaatctaggaattatagaattaagcaaagtatttaatgaaattttatctagcccaattttatattgagatttaacaaattaaaattagatcttctcttctaggcttttaaaatcatttctaataattccttttaaacaacaatttataatttaaggatttttaaacaagaaaaactcttaacaattataattagatcattaatgatcaaattattactgaactgttctttgtaacatttaggaattgagctctgaaaaatccgagaaaatttcagagagttgacttaatcatggagaatttaataaaacaattaaatccatccatgctttatatttaggaaattttatttcccacatttaacttcacttgtaaattaaaggtcatttaatataaattctattattattttattaaataatttataaatcctgaaacgaaaatcaggatgtgacaaactaccccccttacaaagaatctcgtcccgagattcggaacggctagaaagaaaagggcataggtaaactgcaatctatcttattccataactccgataattattctaaggctttaaagaaaactactgccgctttgaaactggtggctgagctgtaacacttgaaaacgcaactcttgaagacgcaactggcactgcattggctcctgtgacgacaatgttgttgacttgcggctgctgatgcttcggcttcggacactctcttgcaaagtggcctggcttgtaacagttgaaacatacctgctgctcccttccactactgttattctcttgagactgatcctgctgaactggcaccggctgattagcttgctcaatgttaacttcattgctttcattagtctctaatttgatctcaccaccgatgttcaacggttgcgactgtccttgaccagcggaagaagatccaccaatttggagtggcttgatacgctgcctctggctactaccttgtgcctcctggaatacagtcattttccttttacggttatccatcctgttcttcttgtcttcaaggcgaattgctttgtca

SEQ ID NO: 17881 - DNA, 272 bp, Oryza sativa
acagactcacccgaggtgaacgaaggaagtgaagagagcaacacatctgaaacttctttagaggcatgctgatggacagtccattagcacgaacacacggtgtaggaagagtaggaataggaagcactaggaaatctgtcagcagaatcaggacatcaaattgaggagagggctttgcaccttcaacgaaacttagaactcgttctggacctagccaagtagaacctcacactcaagcctaagggatctgacatggagtgactgttccgtcc

SEQ ID NO: 17882 - DNA, 961 bp, Oryza sativa
tttagtgaccaaaagcaataaatatatatttgtgttttttaacttcatgagagcatggaagttgtttttcccttgttttgttttctttacctttaagagtttttttttaaaaaaataaaaaacttttttggaagttcttcctttcgtagtaacacggtagaaaaagaaataacttatacaagaattttttttataatcgaagaaaacttctgaccactgaagcaatgctctttaattgttggtgagtggtgacatacacaatgcaaacgatcgaaagacaaccttgccacaccacggctcactgaaaattagcccatcgtctggccgttaaataccttttgacaaaacaagacaaaaaaaattgaaggatgcgagcacaagttgtgctaaatgcttgaatgtaacatgagatcaagtgctgtcactaagtgaccagaacagcttggcctgccacacgtctgaactttcccggagtaagaatcagtcttgaactgaccatgacaaatatgttacccagctttgttggaaggttttgctctgtagcactttctgatgcttcctatccccactatctctatctacatagtttcatcaaaacgaaaaaaataatgacaggttttcatcggcattgtcgatctatgagctcttctcttttctcccttaagccacctcccatggtctaagctgggtcactccctgtctcttttcgcgaatgcgtaaaaaaatggcccgttaatatattagaagaaaagagtttttgatacataacgcaatgactagaagaccattattgccaggggacaaggaaaaaactgagaaaggttaaaaaactatgaaagaaacttaaagctgcgactcctatatagcgggagaagggcggtggaggaaacccgctatgctctcaataggcctccaaaagaagcggcaccagccaaagaccagagatggccctcctgaacga

SEQ ID NO: 17883 - DNA, 1501 bp, Oryza sativa
cttaagggtgatgaagaattcaagattccctgctgctaaacctagattagtaatgcagtcctttttatccctttggtgcgaactgatgaggatggcgactgtgccttgatggatagatctcatctaccggcagcttaaattaggaagcaatattctctctgttgggtagagagcatataatctagcctgtatttggctctgataagtgggtggagtcagttcagtttgctatttcagttctttacctgttccatgccatgccatattgtcctccgaaacaaattctatgaaacaaattccagtgattggaatattgtcctaagaaaattatcctaaccataatggaacaaattccacaagagaaacaaatccataaagtgttagacctgcacgctctttcactgtgtcctactataaaacgattaaattgattgattggaacggccactggtctctctttcccctccgtaaatttcttgctcagttcaactaatctagcagctgcgtggctgtgactgtgagccaccgaaagatccaaacgccaccaccaaaaccaaaccaagcaaagcccctctcaatctccgaataatctcgcgtctcttttgcgccttttcttgtacttcccttcgcttgctcgcctttgaattgatccatcaaccacaaaaaagagaggaagagaaaaattttgcagtctccatcactcctgctgtcccatgcgattattttgtcccggtcgtttgatcaatccaaggacaactcaacgagatgatgctggtgatgaggtgagtcatccttcctctcctattaaaagctgtttttcttgctccctcctcgctccctctcacacgacatgagcagccctagatcgtccggggttggagcaactgttgtgtgaggcacggaggctcccagattcctttttgggttcttttcatttgagttcttctggcacttttacctgatatttttttccttctttcttcttgccgggtggtgccttatttgcaggagatcaaatcttgatggtcattattagctgaaaaggattggatttttaccgcagagacagtatctgagctgtgtttctcagtgcctcccatgttcttgcaccaaccaagctagaacttggaaaggaacaccaccatcaccaatttgcaagagaaggttctctcccttgtattataaccacaactatattgattcgagattaaagagaagggcacagtgaggatactggcatttggaggcttgttgaatccaggtgcgtgtgccacctctcccgaaaggccaaaaaaaaccactgctgcgagtgcgagtgtgcaactttcctgcaagaaacagtgagccgaacacaccggctctgttcttggctaattaaaccccaattgcggcgctgtttggattcagttcttcgcaattcttggattccccagcagcaactgttcttccccaaccgagagcccaaatctttgatccaaaactttgaaccagatagaagcca

SEQ ID NO: 17884 - DNA, 1501 bp, Oryza sativa
tatgagattcgatgccttaagtcctcccagggggtcctttttataccacaggtcaggtggtttccaagtaggacttggagtcatcggaccctacacgatacagtaacgacccagtccttccgggtaggaatctttccatctgtggactccgtgatgaatttccttagcgtatacagagaacgttcgtataccgcaaatataccatattgccgtatagcgtacatccaaggatagagggtataccttatccgtaaccctgacagtagcccccgacttctgcttaaatgaactcatgtaaccgatagcgacttctgatgtcggagttgttgtcgttctcgactggttgatctcggtgtgagaaccgtagagacaaggagtggtcgacaacaccatgcgaagttcaacggttatgagtgaattaaaattgaagtccaaaaaccgcctcgcgcaacggacccagaaattttcggcggccatctatctcctttccttggaattcgcaccgtcagtagtgcgcctatttaagggagttttgggaatccattttggagtccggctgttgcgaaaactttctagcctccaaatactcttcgtcttctccgcttccacgcaaaccctaactcgcttgcctcggtttgttctccggcgatctccaacggcaatggacctcgacaagtccaattccactagtgcgtccgtgaagaagttgcaggaggagggcgctctccccggtcgcgggaccatggagagggaaccaggaggtacttaacctgaatccgtcctgggccgcatggttgcggttgaggactatattctctgtggttttcttcctccgccttctgagtttttccttctcgtcttgaacttctacggtctttctctactccatctgaaccccaactccatagccttcctcagcattttttcccatctctgtgaggcctacattggggtagagctgtttcttgacctctttcgtttttactatgagttgcgttggatggaacctaaaaaggtatccgggtgtgttggttttcgacttcgggatggcctgaagtcgcgatacatccccttccagtgcccctcttctcgtagtaaatggcgggcgaggtggttctatcttcagatagaagattcggatccagtctttgttgttcctgaggagcaaccagacaagattccgtcttggaccgccaaacccgccttgaccccatcccttcagtcttttatcgatatcatcgatgacctccgagtacgagggttgtcgggggtatgaagtcgctgccgacttcattggtagacggatccagccgctccaggctcgagcccatccagcctttgactaatctgggccggaggacgcgacccgtgtttctcctcggggtatttttcttgcattctgggttcctttccttacgtgcgcattcctcctgacttatcgaaatttggttctcgatctacaggtttgaacagcgcaaccgtggagcgccgtgtcggccac

SEQ ID NO: 17885 - DNA, 1501 bp, Oryza sativa
taaaaatcgactcaaatacggaaatatttttctaaaaacgtacgaacttagaaaccgaatcacacacaaatgacgtaccaaagtatcggaaaaaacatgttttatatatatatatatatatatatatatatatatatatatatatatatatatatatatatatatatatatatatatataggacactcatatggggcaccatggtgcccgggcaccatggtatgaaatacacaaattcgcccaaatgtttcaaaattttcaaattgtgagtatatacctacttataagtattcatttcatacctatacctagcaacaaaacaactcaaatttaactttatttcacaatccattattacatacctaactaattatatgtttggatgctatatacctagaatcaaaatctaacaaaagtaagtttgaattcagttcaaacttgctttgaactagttagtaaagtagttaacgttaatacctaaatatttgaaaaagtttcatactcatttgaattgggtatatagtaaatttcaatcatggtgcccgggcaccatggagtaccaaacaaatttactatatatatatatatatatatatatatatatatataatatgtgttaattatgtgataagttgcctaagatcaattgccagcttagtatatttaccccaaaattaactggccgagcttcagttaattcatttgtggctccaagcaggtgcctatcagttgtgcgatgaggtgtcacataccgtgacgtcaccattttcatttaattagagttggccggagactcttctggtggaaaattaaagctgcaccgagtcttcggccaaagaacggaggatcaaaccccagtggccagaattaagattggatccttccatgttgaatgcccttttcaactttcatggtcttccccaagacccaaccaaagagtagtcagaaagtgactcgatcagcaccaagcaagagaggcaaaatgcacaccaaagatattcaattaactatataccgtatctctcttcgtttttaattgattattatttagttagcaaattagtcaataaaaccccaacgaccaaatgcatgacccgttctaattcagtttctccctttcttaccgcatgtacgtgcccggctgcttcctatatacaccacactgcctcaccctctacacatgcatatagtaaccttaatttgcttataacctagctagctaccttattaacctcgggcataagaagattaaatacgagatcgtcgtcgagcaccttgcaaccattgttcatgcacgtctttgcaccgcaccaggtgaccccgttgtcggtgttgctcgctgctgctgctggtggtggtttcgatcgccgtgatcggagcagggttgtcggcggcggcggcggcggccgagagggttgggagatggacgaggtgctggcgcagatcagcgaggggttccggctcgccggcgagctgatgtcggagctcgcggcgacccaga

SEQ ID NO: 17886 - DNA, 1501 bp, Oryza sativa
atatatatatatacatacacacgcactatatatcaatagatgtatgctaattactaacacacatggcaagtggcccactacatgcaacattcaagagaaaaacagagcaatttgttgttgtaggattgctaattttcctgttttatattgacatatctagtaaaaaaagaacgtgtgaggtatatcatatatgccctcttgacctacttgtgataaacaactaattaatttaagattcacctctttattttgaactttgaggacggacaaattatactagaatgagggaaaacttagttgtccatctgaagacaaagatcctaatattggtgactccatttcttttctaatcagcgagggataattatatgtagcatacccttgctagttaagccgctttcatcgtgtcaattcataccattgacgtttagaaaatgtcgaagatgccttctgttattttccaatgaaaaaccttgaatttttcgtccgttagacgcccaggtggaaaactagcattaaagtaattaagtaaggctaatgaattaaccaggtgatgctaagaaaatatattttgaatcagatcagcttttgatttcgtatgaatattgaaacatgcgtgcctgcattttgattccgattttatttatggacaccattcacgtgcatatataatcagaagcagcaatggtgtctttcccagtataaaagacagaaaacatttgctctatttgatgacactccggtgacgtgttctccatacagtcaattctagtagtccacatggaagaattctcatcttaatttatctgattatctggtttttcaaattcaaaattccatactcaaaacaacacgtgttacaaatacagtggaaacctcacggtgtcattacgcgtaagcatggctgttaaggtggtgctagccatgtacctgccatattggcaatgccacagaaatcctgatacaactgtgtttgtatctgtactaggggaatttttattgcaattcccaaaacaaaggggggaaactcaactagaaaaagggaaagaaatcaatggaaaatcaatgcggcccattttttttaataaaaaaagggaagcgtcccggtagccgccagctcagcgcgcacgcagccatctcggggcagaaaaggcgcccccaccccacccgcagccgcaagtggaaagcagagagagagagaggcggccgcggcagcagtagcaggcatcattagctgctaatccctcaccccctctgtcgctaattaatccctcggatcgccgtatttactaggtttactaatcacgttttggcgatttagtcttctctcttctctctctctcgtctctctctcccccacctcttcttccctttcccccgcctccctctcctcttcgtcgtcacccgccgcctcccgctgaatccgcggcttgggaggagacgccggagtcgggggcgtggacgggggttggatctgcttgccttgatggtggcgattgga

SEQ ID NO: 17887 - DNA, 1501 bp, Oryza sativa
cacaggatcatacctcaggaagtaaccgtgctcagccgccaagccaaggttctcgcaggggaaccagtcatggagtgttcccttctcgaacccgctgcagaggaaaaccttgttgctcttgtccctgcacaagctggtcagcgtttcgacggaattggcgctcgggctcttgttgatcgcctgcggcatgagcgtgccgtcgtagtcgagcaggatggcgcgcgtcttcgccctccggtacgccatgacaatgtgctccatggcgagcttcctgaagctgaggtcaagcgacaccaccctgaaccgcagcccgaagccgatgccccagcaccgccgctgcgcgtgatccttgcacgtcctctcgaggtcctgcaggaagctggtcgcccagtagcccacgtcgtgggtgtccacgtagcggtagtgcttgtcgtggcgcatccgcttctccttctccggcagcacgagcgcgctctccatggcgtccgccacggcctcgatgttccacgggttcaccctcaccgcgccgctcagtgacggcgagcacccgatgaactcggacaccaccagcatgctcttcttctcctccggcttgctcggctgcagcatcctgtcgagcgcctcgttgccctgcctggacacgatgtactcgtaggggatcaggttcatgccgtcgcggaccccggtcaccaggcacacctcggcgacgacgtagtacgccacgcgctcgtagaactggagcggctcgtcgatgagcaccaccggctcgtacccgggcgcgccgtacgcctcgttgatccgccgcaccatggcgtacgtctcccccttcacctcgtcgacgtccttgccgcgagccgcgcgccgggttcgcgacctggacgagcaccagcttgccgcgccactcggggtgctgccgcagcagctcctccatggcgagcagcttgaggctgatccccttgaagatgtccatgtcgtcgacgcccagcatgacgaccctccccttcccggagtaagtcgccatcagctctgccaccttcgcctccgtctccggcaacgcgagcaccgtcttgagctgccccatgttcacccccaccgggaggatcttgatgctcaccgtccggccgtagtactccaagcagatgtggccacgcttggactcgtaggagagccccagcatccggccgcagcaggagaggaagtggcgcgcgtagtcgaaggtgtggaagccgatgaggtcggagttgagcagcgcgcgcaggagctcctcccggacggggagcgtcttgtagatctccgacgaggggaacggcgagtggaggaagaaaccgagcttgatgcggttgaagcgcttgcggaggaaggttgggagcaccatgaggtggtagtcgtgcacccacacgaagtcgtcgtccgggttgatcacctcgagcaccttgtccgcgaagatcttgttcgccgacacgtacgactgccacagcgcgcggtcgaagcggccgccgag

SEQ ID NO: 17888 - DNA, 1501 bp, Oryza sativa
taacccgcgatctgactggtctcacacaccgcgactggtcacggaccggataagcgtgcgctgcgccgcattaaatgcggcgtggcgcgctcgtccaacctgctataaatgcggttaggtgagccccgctgtgctcacctaacccacacaagtggcgccaaaaccacagggggtcggggcgccccagccctcggggccgaaacaggggcggcccgacccctcggggagacggagggaggggtggccgtgtcaccctcgggcccgaccccccccccccccccgagggggtcaggccacgtgggtgaccgcggctatccaagcctctagtcacgatacccccggccccatgtcaccgacatgatgtttttagaaaaaatttttgggaactaaacgggccctgcccttagttacagcaaacagattgaaacaaccatactagctagagggcggctaacacctcgtggcatctgcgtttttaggttttgcctgcatgtgtctcgtagctttcctcctagctaggaatcaaaaatcaattcttagctttcctcctgtgaaacaagagccattcgattggaacgaccgcgagagacgtatggaacagaacaattattacaggcggccagcgcctcatggcttttaccttggactcggtggttcactggccctgggccctggcctgttgagtacatgtcacggatgtcggtctgtggcagtaggtgttatgaaccttttctctaaagaagcaagtaaaatagagtggcttattattaatcattagcttaaaaagctttagaaaaatagattaatataaaatttcaaagataccttttaatagttttttttaaaaaattaactctatcccaaaatacttgtcgttttaagttttatttaatatttgactatttatcttattcaaaatattaaggaattattatttattttgtttgtgacttattttattattaaaagtattttaagtataacttgtctctttttatatttgcacaaatattttaaataaaacgaatgattaagcgttaaaaaaagtcaaaacgacgtctaatttggaatagaggaattatactgtttaataatttggaaaaaacgtgtttaataatttggaaaaaacgtgtatgtagacaacgagaaagaagttgagaaaatatagattagaacgcacctttcacgcgagtatttgcctttccatgaatccacctatgctcaggttttacctgacaaaggcaaggccctgggggtatgcactacgctgactgcacggtcgcagcagccgaggggccaccacgcgggcggcgcgaggtggcggaggcggagctacaaatatccatcccttccaatccaggcttccacttccatcgcatcgatcgagtcggctgcttgcctgcactgaatactgatcgatattccatcacactcactgcctcttgtgccactctctcgcttgctcgccgttgctgagctcaatttcatatcctttcctcca

SEQ ID NO: 17889 - DNA, 1501 bp, Oryza sativa
aataattgttctgttccatacgtctctcgcggtcgttccaatcgaatggctcttgtttcacaggaggaaagctaagaattgatttttgattcctagctaggaggaaagctacgagacacatgcaggcaaaacctaaaaacgcagatgccacgaggtgttagccgccctctagctagtatggttgtttcaatctgtttgctgtaactaagggcagggcccgtttagttcccaaaaattttttctaaaaacatcatgtcggtgacatggggccgggggtatcgtgactagaggcttggatagccgcggtcacccacgtggcctgaccccctcggggggggggggggggtcgggcccgagggtgacacggccacccctccctccgtctccccgaggggtcgggccgcccctgtttcggccccgagggctggggcgccccgaccccctgtggttttggcgccacttgtgtgggttaggtgagcacagcggggctcacctaaccgcatttatagcaggttggacgagcgcgccacgccgcatttaatgcggcgcagcgcacgcttatccggtccgtgaccagtcgcggtgtgtgagaccagtcagatcgcgggttaggtggcaacaggcggcctgtcacacgcctcgccccgtcccgtcggaatgatgagagcttcctggctctcgtccctagccggagccggcgtggtaactcctggagttggcatgtcagtcccggtcagatccattccaggcttcatcgcaaccatggcaaggaagtcattgtatgaagaagggcagacgtgtggcatgctaaactgacgcgtggtggacaagaatgaccggtttgtgactggtctaacaccggtcacgtcatcggcagacaaccgtgctcccacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 17890 - DNA, 1501 bp, Oryza sativa
ttcctcgatgaccgatgccttccaccgcgcgccgtctcccttcggaattgtgctcagggcacgcaaccattcctcgtcgccgcactgtttgattttgccacctagctccttttccacccgccgctgccgctccatctcttgccgccgccgccgctcagccccagctatgtgagaaggagagagaaggaagagagagggaggaggaagaaggaaggagaagatgattatgcgggccccacatgttagtgggtcccataacttttttttacatgacaaatgggtctcatatttttttaattctaatgtcacataagcgctatgtcaatgtcatgttggatgaataccatgttaacaccgccacgtcaacgaaactatcctccaaattccaaaacagtcgagggaatcaaattgcactggttttaataattgggggttgagagatctgctattgtaaatgagtcagattcggctgctagttaagaaaatcgaagtggaattatcctatatatctataaagtttatccccactaagtatagttaatgctaattctctcttctctcatgaaaccacatcaccttaattatttttagcctttggattattcatcaagggtgtaaattgcttcttttcacatcacctcaatttattttagtatttggatgattcatcaaggcggtaagataatatcttgggcagttatgtatctaggacctttgacgcaaattgatgcggttcttgcaaattgcatctctttctcctaaaaggcacaccatacaacccaatcatttataacttttggataattgataaaggtataaaaatatataaaacatgaaaaaaaattgtatagtaggtaagaaagaaaattttagaactcatatatatattatattatcacacaattctcccgcagcaacgcgcgtggtacccatcttgtttatttatccagttattagctttttcctcggccttactacttttagcccaatccacggggatatcatgcgccaaattgtagatttttttcatttttaaatttttattttttaatatttatagaaaaattataccggtgaaaatatttacagaaataaaccctgccgctctcggggagggtggcagggtgacttgtgtgaccaggtattggaggctgctgagcgggcatgcgaattttgcatgcggcgaaaattgcatatgacctcagcgcaaaatacacacatggcaccatatgccacgtcaccttaatatttctatttttgtaaatattttcaccggtataatatttctgtgaatattaaaaaataaaaatgaaaaaaaactcccaaattgtagccctgaacttgaacgggaagtcaaatttacaaaccatccttttatgtccactagctaggtcaactggtggcccatacggtattctcggcccacctatatatatggacctaatctagcccgtcttcatggtggaccatctgtattttggtccaaccggaactttcggtc

SEQ ID NO: 17891 - DNA, 302 bp, Oryza sativa
acccctcggggagacggagggaggggtggccgtgtcaccctcgggcccgacccccccccgagggggtcaggccacgtgggtgaccgcggctatccaagcctctagtcacgatacccccggccccatgtcaccgacagtagcccccggcgttatgccagggcgatcgcccccctcgagggaagcgctcgggcgtgacgccactccttaggcccggtgacaggtggggccggtctctacaggcgggcagaaacccagcggtcgcaaatcgcgcgcatcggcaagggaaaaccgaccgacaataa

SEQ ID NO: 17892 - DNA, 1501 bp, Oryza sativa
cagaataaaacagtttgtgccagcacagatgcagctcgccgccaaagttcacatgcttttagccaccgatagtttataccatggctttctttcataattttcatagttttttaaaaatatcttatattctttgcactctctgctcgtttagattattaaatttaacaagttgatactggtttgaacattcagcactgaccagacatatagatagataatttgctctactttgattctttgaaccttttttggagtatataaataaatgccagtataatttgactagtgaaaagttgaagtcggcatctagtttggctacttcatacttacaactaagctcatgtggcagcagttgatttcctccttgacaagtgggttaaggtttggacctctttttcttctaagattatatggttgattcggacttgttgatattttaagttcgtgcctagtttagctcaaaacacattttttggattggataattattcaaagacactttttgttgtagttgtcaaaatattactagagtgaattgcatttttggggcatctttcactgttaaagtaacttttggccaactctatatttattttactaccctgactctattccttaaccatccatatcgtcttctccaggaaagtatggcttggtcgtaggagagttcgctgatgcgtggtggcgatgtgcttgatgtcgttggtgtgctaaaggagagtgatcggagtgttccaaattgaaaaaaaaaaaacctaggctaaagggaaaaaaaaacagtacggggcaaatgccttgtagcattcaacctaaaaaaggtaaaaaaaatgtaaatgatgatccaaaataaaactttgggagaaaatatatggtgcaaattacatatctagtgtaaaactactgtaagattgagaagtagaagcctgatattttttttactctcagtaatctggttaattataagagtaaaaattttactccaggtgacatggacaaatatcatacgtctatttctcgatcccatggtagttttcagatttacactacatatatggtttatattatatattttcctaaactttggtaataaaaattgacccaagttacaactcactcatattactatagttactaaaaaatagtcctaagtaactactccatatttgagagagaggagttcaagcaatggatgctctaacaaagtcttttttttccctttcctttatagatttatcagtggctaatgcgatagtgagattctcaataaaaatctaggaaggcttatttgtcgggttgacgatggtttggtcaaactgccatggttcataattttcataaaaactttatatatataaatttcttaaaaaaacatttcaaatttatatttcaactttataatatatagttagggtgagtttgaggagaaggagtttgagaagattgggaagatacgcaaaacgaggtgagccattagcgcatgattaattgagtattaactatt

SEQ ID NO: 17893 - DNA, 1501 bp, Oryza sativa
tggattaatatccgtctcatcatctgacgaatcaccttcctctacacgctcgttgtcagaatcctccctctccatttcatccacaatggcaccacagtctccccctcgtcggccactctacctggttgaatgcccactggagctactacgcccctgtcctctcgtgcgttgacctcctccacagaagtctcatttacttcagcacttggtccctcgccatcatccatgttcatctgcacacctggatccttcgggtgaacaaacagaaccatagctagaggccacccgcgttgcaatgcatttttcacataccatctccacactcgagagttttgaactggtattagttcccaataaaaacccttagttgcccaacttactataacattgattgttatgtcacttgtctgtggatcaactctcaagcccctcattaaccatccttttatagaaggtacactcctctcagccggtctatcaattccccttttctgatacaataaaatctgacagatctaccccagttgacccgtaacggatgtttcctgggccatggtaaacttggaatatttgtttgttcgacatatctgtcaacgaaataactagattatattactctttcatgcaataaacatctacaacgtaatatcttcttgtgtatgccaatgcaacggtaaagtattgattccaaactagcagatctacgtagttaccgatatctgcaatacgcacttctagattagtacaactaaaaccctaaaaatataatgcatttattcaaacaaagttttaaaaaatacacactatttaactcaatagtcacatataggatctatgaatattacctgaaatcggcgtctgaatccggtagggcttcgccccttcttctcttctcctcccctttcttcttttttttcactggatttgagaggggaggaatgagggctgggagctgggcggcaggccttttataggcagcgaggcctgccgcccggccagagggcggcaaggggccgcctgcaaaatgccggccccgactggttttttttgcattcaggccccttgccgccccaacagagggcggcaagggctttcctgcaaaaaaaccctccctccgtcaccgcccgtcccttccccgtttgccacgtcagcttgccgctccaaaggtgggcggcagggtctatttttgcaatttttttggccgatagattacttctgtaaatattttttaaaaaaaatctaaaaatgaaaaaaattcggggcgtcactccaagtcgcttcttttatttgggccgggcagtttctgggctagacccattttactgttttggcccggcccatttagccgccgctactttccagcttccaaggaggccacaccacgcaccgcagctgcagctcatccccacgaccaaatctcgccgtctccgcctcgccgccgccgccgccgccgccaccgccaagagggggggaagcaacccgcagccgccgcgcggcgaga

SEQ ID NO: 17894 - DNA, 1501 bp, Oryza sativa
agaagcgtaacaccctactcctgtgttttggtggatctatgtatcaaggagctacaaagtgtgagccaacctctcccttgttctaggttctgaatctggcagccatcccccccttttttctgggcaaggtcctccttttatattttaaggggataccacatgcacccctccctttccaaactggacttttcttctctccataaatggacggagatttgcacggtcgtcctccgaacatcctcctgacgggacagcacacacctacctccacttctgcctgaggcgagcacgtcgtgggaaggtggctgtgtgctgacgacatgagcagtgacagaccggtcacaaatcggtcattcttgtccaccacgcgtcggtttagcaacgtgcatgtttgcccttcttcaaacaacatcttgcttgtaatggttgggatgaagcctggcatatatcgatcgaggttaacgtgtcatctctgggatgtaacacgctagctccagccggggacgagtgcctagaagctctcgtcttgacgggatggagcgaagtgtgcgtcagaccgcctgtcgccacctaacccgcgatttgaccggtctgtgactggtcacagaccggataatcgagtgcactgcactgcacttcgtgtggcgtgacacgcttagccgaggcgcaataaatgcggttaggtgagccccgctgtgctcacctaactcatacacgtggagtagaaacgcgaggggtcggggcgcctcggccctcgggggcgaggcaggagtggtccgaccccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcatgggaagtggccgggcgtgacgccactcctaaagcctggtgacaggtgggaccggtctccatggttgggcagaaacccaacggtctcaaaccatgcgcatcggtaatggtaacttggctgtcaataatgggcggtctctttaagactgccacatcacctgagcagcgcacaaatctgggcgagccgatttgcttcgcctggagatatggtaacgtcgcttcggtcggcgagcgtatttaacgcacgcacgatacgatctatctcgactgccgcaaccgcatatccacttcacgcgccgcaagcgggcgaatggggttagtggaagcgtgggtgcgagaagcgagggggcgaaataatgggcgcgagaaacgaggagccgggcacagcgttggcaagggtataaaggcactgaggatgggatttgcttccttcctttcgccatcatttcccttgccttcgccgcttgcgccctaactccttcttccctgcacccttctttcgccacacgcgctcgctctccatctcctcttcgtccggcgcca

SEQ ID NO: 17895 - DNA, 1501 bp, Oryza sativa
tgaactctggaatttactgcagtaaaccaacgcgtctattagtggatcatcggattcgttccctgtccctcccacagcagtagaggcgtgagatgacatagaacatccgcgctcatccctttgccctcaagaacattgcagaagtagacagtgaacacagatatagggtggggctctctctttattatagatttcatttggagtacaagccagccaatcttagatgtctcgccctgcccttatatatataggggtcttaggaaggaggagatagatcttacctctactccgtttggattagtccaaaaaaaaaagatcttatctccccgggagataatattccgtaacatttgcatctaccaaagttagctgcatagtttttctgtatttgctgatttgcattttgcagtaatttcctcttggcacaaggttttggcttctacattagctttttaattagaggttagctatgcgtttatttcacaagtcagtgcggggggcataatttcaaaacttattgttcagtgtttgagaaatcagcttaatatcaaacaaattgtgttataaaaaattctgcatatgaaatagagccctgttttttttacaaacattaacctctctaagctgcgtaggattgctgaaatccttattatcaacctggtcagggaagaacgcaacgacccacgaaattcgtgggctagtttaggttcacttctggccccgcagagatctttgcggcccataaatattaatggaccgaaagttccggttggaccaaaatacagatggtccaccatgaagacgggctagattaggtccatatatataggtgggccgagaataccgtatgggccaccagttgacctagctagtggacataaaaggatggtttgtaaatttgacttcccgttcaagttcagggctacaatttgggagttttttttcatttttattttttaatattcacagaaatattataccggtgaaaatatttacaaaaatagaaatattaaggtgacgtggcatatggtgccatgtgtgtattttgcgctgaggtcatatgcaattttcgccgcatgcaaaattcgcatgcccgctcagcagcctccaatacctggtcacacaagtcaccctgccaccctccccgagagcggcagggtttatttctgtaaatattttcaccggtataatttttctataaatattaaaaaataaaaatttaaaaatgaaaaaaatctacaatttggcgcatgatatccccgtggattgggctaaaagtagtaaggccgaggaaaaagctaataactggataaataaacaagatgggtaccacgcgcgttgctgcgggagaattgtgtgataatataatatatatatgagttctaaaattttctttcttacctactatacaattttttttcatgttttatatatttttatacctttatcaattatccaaaagttataaatgattgggttgtatggtgtgccttttaggaga

SEQ ID NO: 17896 - DNA, 1501 bp, Oryza sativa
aatcaaacttgaaatagtttgactttgatcgaatcaaaacgacttaaatctgaaagggggagtatttcaattttagtttctccattgagccactttagtttccaagtttagaaacgagagagttttatgcgaacacatagtcatattaccttggtttataacccttccatttgatttttatacagctattttaaaacactaataaaatacaatgtgcacaatacatccattcgctcttcttttcgaaaaatgaactttccattcttggaggtaaagccatactagctggtactatgcggaaggtatcacgtattcagatgacaacatttggattgttactagtggttctacgcgaggaacaaagggtaattaaatgagcaaaatcttacaacatggacccatcacaaaccgtggcatatatattgtttggttactttgtcaaaccacaccttgggcaaggttacgttttgccgcagctagtattcaaaaatgcattttgctaccctgtcatttttcaaaaatgcattttgctagccgcaactcagccaacactacaacaaacctttgatatatagggtcctagctatgagtaaaacttgtggctagccataataactatgataatgaaccaaataattgccaaagaaacagtgtcaacaaagttgaggtgtccgaccaaatataaatagataactggagtaataaaaggaagtttggtttgtaattcaatatagatttcccatttcaagtaatgttatgcttgagtaatactccctctgtccctaaatatttgacgccgttgacttttttaaacatgtttgaccgttcgtcttatttaaaaacttttgtgaatattattaaaaaaacttgagtagtagtagtatatttaacaatgaatcaaatgataggaaaaaaattaataattacttaaatttttttaataagatgaacggtcaaacatttttaaaaaagttataggcatcaaatatttagggacggagggagtattaattgtagaaatattcaaaataattctaaaaataatgagatattatatgccatgttccagggatgaacagaatcgatataatgtttttactatttccccaatgatagagaaaacatattttctaatagaaataggcttaaagttactgtatttatgtattttcaatgttttatgcatttttaaattactgatctttccttcttcattgaagttttacattcggataaatttaaaatgtaaaaaatttagttgtatccctctcatagatccgtatgtataagtcaagtgaggtaacaagtggcatataattaaggaattatcgagtactcactttgtccctaaataagtgttaatttagtcaaaaatttatccctaaaagaatttagctttagagtggtgtagtagaccactttacatcattttctttttatttgtagtcattaactaaaccaatagtgttccttcatcctccttgttttcttcccctcctca

SEQ ID NO: 17897 - DNA, 1501 bp, Oryza sativa
gtttcaacttttgatcggcatggcaagctctcatgcattaggaagggacaacctaataaaaaaaatcaatgtagtgcctcatcagcagcattaatgaagtatgcacattagctgtagctgcaccattggactttgacgagtcaaattgtcatttgtgaactactgtaatcactgttttccttttctaatgaagctgattgagatccaaatgctcgtgatgaaaagcacagcatgggatggtgcgccctgtttaagggcagcatgatgagcagaatccaataggtgaaaagattcggcaccatggtgtccctcgcacgcagcttcagcgaagctgcagccagcccaaatagcaagagtaaacaaatgcagccaagtacacagtataggtacatgtcttatgcatgtgaatttgttattatcaatttaccatgttccaacacctgttactactattaaccatgactggtgattgttggctttataatgatatttatatgacctcaccctgtccagttagaaatatgtctgatttagtcagccccaataagccacagccaaacaatatagtttggtattacccagtatcacagtataagtctatcctcctggcacacgatacaagtccatcgacaaaaccaagaggttatttaaccacttgatttttcttcaggtttttgcacgcacaagatcatacctaacgtacaggtacaaaaatatttttataagagccatctatctgtctgtcagtacctgtttctgctaattattagttcttgcttattttttttctctgtacacaaagccagtgcaaattaaaaagattgtactaattttaaactgggcagcatccaagcagagtgaagctactccacgcaagtgggagtttttcctgtcagcaaactcaaacacattggaattaataattgcatcctattgttccctgttcccttccttgtttttccccccgctgcctcctctcctcatatctgcccattcggttataaaagtagacctggtctcgtcccctctttgcaccaacacagcattcttcctgctccagttctagtcttctagggttagaagtgatgagaggtcaagataagctgtgggtaaacaagctcaatcactatggtgtgggtgtagagatctgatctatatatccaggtaattaattaaactaattacgttaagtttactttcgagccatctgtgatcttggcatgactgctggtttgcagctatggctttcaaaagcttgctgtgtcaatctcctagatctaatggttggcacagcaagtatataacacatattttggtttgttcacctagatctgctttcctttactgttccatgtcaatattgatccttgtggaacatagaatataaggggcagcacagatcttgttaaattacatagtgtgcttgatctgtggtaccagtttgattttttctgatacatgggaatctcatactaaatgccaacgttacttttcctttcca

SEQ ID NO: 17898 - DNA, 1501 bp, Oryza sativa
ctcaacctagcataataaactgtctagttgggcgtctcaacatgaacaacatgagcgtaataaactgtctagtagctttttccaaagtaaaactggtagatagtgcatcaaaacttgctatgacctaaataatatgatttcataattatgacctaagtaatatgattcgataattatgacctaagtaatatgatttcataattgctctcatgtacataccacattagcttgattaataggtagcaaaatttcaaaaactgacaaaaaaaacaagacaaatatgacacaccgacaaaatacaaaacataacatttatggttcatatatcatgaaggtgcacatataatagattaacaggtgcatacatacataaagttcacctataatatatttagcgcacacaaatgacaaggtcataccatggatcaacgtgtccacatatggtttagcacacagccaacaggtccatagtcctacagatgatagttgcatacatggccccgttcgaatctttcaaactgctaaaattctggattaaagtgtcacgcttttcaaactgctaaacggtgtgtttcgtgtgaaaactttttatatgaaagttgttctaaaatatcagattaatccatttttcaagtttgtaataattaaaacttaattaatcacatgttattaccacctcattttacgtgaaacacttaatcttcatcttcatcttcgggagattcaaacaccatcatagagatacatacataggaaaaaatccatattgccccatcaatgtagcagcaagctacatgtttcattttggccacacgccagctgccctttccgtcagcatcattgccattttcatcagcgctcttagctagctcaccttgaaaggccacaatggcatcattaacgatttcctccatgctaaccaatatattaatttcacgaaatagaaattctgaatctaccaaacttctcagtgaagcatcactagttagcacaaggtattgttcggtactatcaggatatattatgctagctttctaatgggttccctattaatagtgttcttcaatctcattaataatactatggcttgaattttctctttgataagtacgattcatgtccccgaaaaaaaaagagaagtaccattcatggtaaaatacaccagttgtctctatgaatttccaaatttaaggtcatatattgtatatttcacatacttttacttaattatactcatgtaaccgaagcatactttcacttaattatacaagttcaatacttttcttttgcaatacttaagaatatattaaatattaatgctaaaagagtaaaggtagtactcgaccagtaccaaacttctcagtgaagcatcacgagttagcacaaggtattgtccggtactatcaggatatattatgctagctttctaatgggtttcctattaatagtgttcttcaatctcattaatagtactgtggcttgaattttctctttgacaagt

SEQ ID NO: 17899 - DNA, 1501 bp, Oryza sativa
aggctccggattgtagtgatctcctgtgcaagttttacctcttcggcaaaaaataattgtcggcctacggggcaaactattctgtcccctctaactaataatgtctttgaacattttgatcatataccctcccattttatcaaaaattgaggatttattcttctgtcactgacatgtagggtttatctgagggcattgacatgcggaccatgagggtaaatcctcaattttaatctaatgggagggcatatgatcaagatccacattaaggaccagctatttaaaatacggaaattaaattcttaaaaaaatagtaagtagatctgtatacttgtaacatttcaatttattaggttactgcaacaaaattgatggagaaaatactccaaagagtcgtgtgtgaattatgaccagatatttgtacctttcaatacggtggaactttcctgcttaatgacagtagaaatcacaatgtaaatgaactagtcacttgattataaagcctcatttagaggatcacaacccttacatgggtttctttggaattcagatagaataggctcttccatagggattttggatttaaattttgtgaggtcatatgtcatgttttcatttctttgtttttgtaatcttatatttctagactttgtttcctacaaatgccttgtaaagttttcacgagttgttcattcctctggattttaaaggatgtgacgctattatattttttctttaagccacaaacaactaaatttcaactcatttcaagtgacaagctaatgccaacgcccaacgcatcattcgttggccattttcttgtgcatttgcctatacacagtttgttcttaatctagccttattcagatttatgtgaatggaagtcctctacgttatagtgttcatggctgtgtggttaacacttaacagtctataggattgtttaattcatggtaaaacctggttcgatggaaaaatagccaaattattttcccggtccttgaaagaggtaccgagagtgttgtgctgaatggatgaataactgtatagtttgtgataataattcgaatgtacaaacgaactaagggtgcgttcgttggattgggtgagaaagccccatcgtattccgcgcgcacgcttcccaaactattaaacggtgtattttttataaaaattttctataagaaagttgctttaaaaaattatattaatctatttttaaaatttaaaatagttaatactcaattaatcatgcgctaatggctcacctcgttttgcgtatcttcccaatcttctcaaactccttctcctcaaactcaccctaactatatattataaagttgaaatataaatttgaaatgtttttttaagaaatttatatatataaagtttttatgaaaattatgaaccatggcagtttgaccaaaccatcgtcaacccgacaaataagccttcctagatttttattgagaatctcactatcgcattagccactgataaa

SEQ ID NO: 17900 - DNA, 1501 bp, Oryza sativa
acgaggctctcctctccgaggggctgcgtctggtcaaccggcttgcggccggtgatgagctccagtaggacgacaccaaaggagaagacgtcggagcggtccgtgagcttgccgctggaggcgtactctggcgctaggtacccgaaggtgcccatgatgcgcgtcgacacgtgagtgtgcgtatcattcgccagcttcgcaagcccaaagtctgccacctgcgccaccatggatggaagcatcaaacaccatggaactttgaattgaagatggcagctggctggggagatcgatgtactgtatatgcgtacctgtgcttcccacgagtagtccagtaggatattggcggtcttgatgtcccggtggataatccgcgggtggcctatcttgccaaggagagaacaaaacgccttttttccagtgttagctaggtgatgtgtaacagcatataagatagatcgatgagcgtcaatgtggatcattaaacttacagtcctcgtgtaggtatgctagccccttggctgcaccaatggcaatccgcagcctcgtcggccagtccatcactggcatgccacggcctacatagaaggacattaattagttgtaagctgcaaacatggtttctaattttgttttgcatatttacgtcaaggggcaccggaattttttattttttttgaaatttgaataaattttaaccattttttttctaaatgacaaaaaaatatatttttttcacaaaatattagtggtgaaatagtgtcatgccgcaggctgaaattcccaaaacttcgaacagagtgcaaacactggctgtaaaacaccggcacctatgtccgggagtataggtgtcggctgaaaaaccggcgccggtttccaactgaaacctattaaagtttgtgtactagtgttatgaattgattaattaattacttaccatgaaggtggtgttcgagggtgccgttgggaacgaactcgtagatgagcatgcggtggtgcgcggcgatgcagtagccgacgagggagacgaggtggcggtggtggacgcggctgatgatctccacctccgcctggaactcccgctccccctgcccgctcccggccttgagctgcttcacggccacgcacttgccgtcgcttagccaccccttgtacacgcacccaaacccgccctcgccgatcacgttgtcccgcgagaagttgctggtgatccccgtcagctcctcgtagctgaaccgcgacttggaccccgccggccctgtcccctctccgcccgagaatgtccccgaattgtagtacccgccgccgtccgctgacgccccaccggagttgagcataatcgccgacggtggtgggtggtggttgcggcttgacccgccaaactgagacgatggcacgaagtagttgttgccatctgcatccgatcatccgatcaccgttgttaatttagctgcgatatatagttcacaatttcttgtgcttttgcatatatagttgcact

SEQ ID NO: 17901 - DNA, 1501 bp, Oryza sativa
agattgccgatgacgtatcgttcagtattaagccaatgtaacatgcattagatccgcaacgaaagatagattgcagaaacggttaaatgtacctgatcggctgtagatatcaataatacataatcgatacttcgaaatacgtttaaaccaaatgattgggatagatcggacagcacgccgagatagtataaaccacttggatccaaaaatacttcgaagcaaggatcatgtacattcatagaatagccgataagatagatctgacttgtatcggctagtactccgataccactttatactgagacatcgatatagatggaacatactgaacagggatcaatctaagatcgagataacctaacagactgatggcaagcttagtatatctcaaacaagtgagatcttaatataaagggcagatttagtatatcaagcaaacgtaaaaggagcaggataactaaaccaggtaagattggctgaaactccgacgctatctctattggcaatcataaggcgagctagatattatggttctaagtattacttaataggtcagacttaaccgatgcagcattaagcgcagatggaaacataagatctaaaccaactgatgatagccttttcaagatggtagatatactgtataatctaactcagccattaatgtttaaccttgttagctattttcgatgatagaggctagctgataagattaagcagcgggaccgatctagattatacaacatatatgataactcggcgattcacataagcaggactagagtatcatgaagatgtaagcactagtcccgagaatgcaaaccaccataacaagttttacctcttcgccggagatcgaaaccgatgcagctccactcaaaagcaagaactcgtcgaaaacaacgaaagtagaaaaaggttggcgatgcgctgaaagtattattgaactgatgttgtttgtttacaaggtcttgggtcatatttatacccgaaatacataatatgtcctcgccagacacgactctatctctattacaacttaaaatacgaacaagtcccttaggcggactcttaccgaaaatatctctaaagaaattaactagaaatatcctaattaatagatacagttgccttctttggactcaatccatacgtggcaatgcttgtgcagcgcctcaattgatcccatcaatgattctagaaccatcttcctgggatcggctacaacggcttctccctatccgatccagtatcagctgatgcagacaatagccgatgctgccagtagccgatgcgcactctgcttctgagaaacaaactctctcaaaatccgcttcgattttaactttgaatccgatgtatgatttaccaaatttggccgttaacaggtggtgatgcaccgaattgtattgatctgtgagatagtttacaatgaccacggaatgtacatacttatacccatgggtagatactagtctttgtaggacaagaaagaaacatt

SEQ ID NO: 17902 - DNA, 1501 bp, Oryza sativa
agcgcttcagcaggtgaccgtatagtgcttctttgctataatggaattgctgctacaactaacaagtctatttcaaccttcttgcgcccacaattataatgcttccttcagtcaacattaacttgtactccctgtgcactgcaaagttgtgctctcttccaaatacgttggactgtacgtatgctcatattggacacttcaacaactacatgtgtgctgcccgtttctacttttccatccatactttttgcaagcaacaattcataaatgccttgcctttgtgggtttgtcaattttctggacttgattggctcatttgcatttgcatcattttcttcttcatctgagtcgagcaactcgtctacattgaacacaacattgatagcatcggcgtacacaccatactcttgaatgtcatactccaaggcttgtagctcatgttgcaaaacatcgtcgtcatctacaaaattatttacttggtaagttaatgtggctaatcagattatgctgatttattcacaaccgaaatcaaggacatgaacatattcttaactaattaaaaagtcatgaactttacctagttcaataccttgtttctcatttgcgtttgcattaacatgaagggtgtgctccttgagttggtgatcattgtctgaaaaaaacaacttgctagtcagtaccctttacctagccacaaagcacattgtatatgtttaggatatgcaatgtcatgactcatactgtacgttagaacaatattatctattccatatattatccatgacttaggcatacaactatgcaactgaagtttacactctttttttagtattgattccagtactaccctatgcttgtattgatgtagcgtaatcaacaatgttatgttgtggcttcatgtctatatgttgattttcttttatgcattgtgaaagattagttgccctttctatgattttttaatgtagctatctgtcataattctattttacacaaccttttgaggaggaatatgtcatttatctggtccttttttctgtgatgaatcaggtggtgaaggcatacaatggcagttcatgcagatgggaaacttcatggatgggggtgcaacaaagtgatcattgaattaccttgtacttctctcttttatgataacttgaaaatttgtaggctgaattgctaatcaaattatgcacaaatcttgctttgtcgatgtggttgtgttgatgaatcaaaaatcttaaatatttaacattatttaggagaaaatggaagtagatgagctaaactgtcaaattatcgtagtaccaatcttttgttttgttaacatcatgtgtgtgtgctgatcatgaggggcagagggagtagagtgtgctgcacatgtcatagaataccatatatttttttctaaactagattgaataatgcaatcatcatcaagtattgcaaacaacatttaatgcactgataaagatccatgtgatgcattgagaaaaaatag

SEQ ID NO: 17903 - DNA, 1501 bp, Oryza sativa
attatatatcggcatattataattcagcttacattcatttggctcagtaatctagattataataatcttagaatgaaacaaacatggccttaatcattacgcagcaaacaccattttttttctcgacttaatttccacccatacatcataaaacatccaaccattaatcacggcaccgcaataatacacttcctaatataaacacatgcttccctaaaaaaacacacacgctttatacctatagcaagcatccgtgtcccccactaatcctctctctaacaacaagtttaatagtaaagctaaatattgactattagactgaattcgggaacctcactcgcaacaagcaaaatggagcggcagctagtgcttgatttattaagtattagttaaaataaacttgaaaaagagattaatataattttttaaaggcaacttttctatatttttttttcaaaatacacaccgtttagtaatttaggaagcgtggaaaacgagaaaggtacactggaaaaggtaggggaagaacacaaccttagcctatattgcaactaacatgtataatatgttaacaattgactatatttttttctccactccttttctcccactataaatttaatgtaaatatcttgaacaaacatgtatataactaactcttgcattgagatatacttggtagtgcagtggcaggggtgtgtgatttcaacttcgagtttccgtgtttaatccctagaacactcatatttttttaaaaaaaatatttagagggacatatgtccctcaaaatctcgtttttaactagctcttgcattataaccaatacttcttatttttctttatcttttttttcatataagtttatagttagcttagacccccgtcgtttagccaatacgtattaggaaagcaataataatttatatgcaagacttatgtgtgtgtgtttttagcgatttaaataccaatgctaaaaaataaatttgaatgaaaatcaactttaaatttgagtttgaaaattcaaattttagcagcgactgattgaaacaataggagcattattatcctcgctcaaatggactgatttggccgggggtgagtcagagtcaccaagggggtgtggatggaaatggaatccacctcacgtttggtgggccacccaaaccccaaaaaccctaccgccgaccgcggcgcacagagagagaaagggagaaaacccacgccacggcggacacgcgccccgaaagatagccccctcctccctctctcgctctcggtgctcgggctcggacacgagggaagcacacactgtttcttccgccgtgcgcggcgcacgaaaacccgcacctcctccgcctccgcgcgcccctgctcggcggcctcctctcctctcccacccatggcgcccccaccggcttcctccctccccacggccgtcctcgcatggtgagtggagtgctccgacctgctgcttcgctcccgcggccggcggcggcgctga

SEQ ID NO: 17904 - DNA, 491 bp, Oryza sativa
ctttttgcagccaagttcataaagattatggatattctgatttggtactccattttcttacatgatatttatcccttccttttaaaattccatttgtagtagtagttcgattccagtgaaagtttttcaaaaatcatactatgtcccaaaatatagctaatttaaaaaattgaagtagaaagataactatactttgggacggcggactatatttcaaaggatacctcaaagtttgaactatattttggaaataaaattgtatttctacgatggcatacctaactacctaggaatttaaaaactttatcactgaaatcattttgcttgccattagtatcgaagggttgatactcgactacaataacgcatgggtgggagactagtacgaagatacgaacgaagaatacaaaacgcggaagatacgaggttatatatgttttgcctataagccatactactactactctcttatcttaatatgtgaaagcagc

SEQ ID NO: 17905 - DNA, 917 bp, Oryza sativa
agacttattttccatatttgattgaacctttttttcatatagcgaaactcagtgcgacaatatttaagctctcgtctacaattttatttgtggagtctcaccaaaaaaatatctaagaatactccgaaagtatttaattttggtaaaaaccacattaatcgctcacactttatgaaaacatattgattcggttaagcatgtgtttactggggtggttttttcatcaaaacttaataggtgggtgggcatttgcaacaaaataacttatggggtgtaatgtcaaacttcaagtgatttatggggtggtttttgcaattttccctatttaatttgtacataggccatgaattcgtgcaacgaaacctcttctctatggaatggttgacgactaacccaattcttaatcaaataaattttgtcgtcgtcgatcgatcaattaattgacagaaatcacatccacaggaaaaataaggaaaacaaaaacagtggtcggatttgatcgatcgatccgttaatttcctgattaattagtcaatggggttcggttcattagccggattagctcgagctaatcccaaaagccacgattaattagcgcggcgaaattactgcctttccctcgccggggacgggcgggcgacgtggccagttgggtaaaaatttggcgcgaaattcacgcgcgcgccggtgcatggcatggcgcgcatgcaaaataagggccgtttagttactaaaaagttttttcaacatcacatcgaatctttgacacataaataaattattaaatatagataaaaagaaaaactaattgtacagttatgggagaaatcgcgagacgaatcttttaaacctaattagtccgtgattagcaataagtgctacggtaacccacatgtgttaatgacggcttaattagt

SEQ ID NO: 17906 - DNA, 1501 bp, Oryza sativa
ccgccggcgccggcgcttggtccgccgcgccggtggccaggtccagcaggttggagtaggaccgagaaaccatggcttctatctggttcaaagttttggatcaaagatttgggctctcggttggggaagaacagttgctgctggggaatccaagaattgcgaagaactgaatccaaacagcgccgcaattggggtttaattagccaagaacagagccggtgtgttcggctcactgtttcttgcaggaaagttgcacactcgcactcgcagcagtggttttttttggcctttcgggagaggtggcacacgcacctggattcaacaagcctccaaatgccagtatcctcactgtgcccttctctttaatctcgaatcaatatagttgtggttataatacaagggagagaaccttctcttgcaaattggtgatggtggtgttcctttccaagttctagcttggttggtgcaagaacatgggaggcactgagaaacacagctcagatactgtctctgcggtaaaaatccaatccttttcagctaataatgaccatcaagatttgatctcctgcaaataaggcaccacccggcaagaagaaagaaggaaaaaaatatcaggtaaaagtgccagaagaactcaaatgaaaagaacccaaaaaggaatctgggagcctccgtgcctcacacaacagttgctccaaccccggacgatctagggctgctcatgtcgtgtgagagggagcgaggagggagcaagaaaaacagcttttaataggagaggaaggatgactcacctcatcaccagcatcatctcgttgagttgtccttggattgatcaaacgaccgggacaaaataatcgcatgggacagcaggagtgatggagactgcaaaatttttctcttcctctcttttttgtggttgatggatcaattcaaaggcgagcaagcgaagggaagtacaagaaaaggcgcaaaagagacgcgagattattcggagattgagaggggctttgcttggtttggttttggtggtggcgtttggatctttcggtggctcacagtcacagccacgcagctgctagattagttgaactgagcaagaaatttacggaggggaaagagagaccagtggccgttccaatcaatcaatttaatcgttttatagtaggacacagtgaaagagcgtgcaggtctaacactttatggatttgtttctcttgtggaatttgttccattatggttaggataattttcttaggacaatattccaatcactggaatttgtttcatagaatttgtttcggaggacaatatggcatggcatggaacaggtaaagaactgaaatagcaaactgaactgactccacccacttatcagagccaaatacaggctagattatatgctctctacccaacagagagaatattgcttcctaatttaagctgccggtagatgagatctatccatcaaggcacagtcgccatcctcatcagttcgcaccaa

SEQ ID NO: 17907 - DNA, 1455 bp, Oryza sativa
tccgatccctgaatctcaagcacgtaaattaaattatctcaacaaacccaaccaggctatatccaacatgccaattgatcagggtcaatctgcgtagaaacacttaaactattcactgttcctgctaataataactctgtgacaaaggattcgatcagtcacacgctcacggtatctcacgtcgatgagattagcaaccgaagctcgttgatgaccaaagattagccatgtccacaaggcaaagaaagtgacacctgacctaacgtccgtcctgccttagctcagaaattcctccttcccctgtttcttctcgcattcaaccgtctctgactccagccgagtactttacttgcatccaagaaacttcccccattttctcctgtactgacatcctaatcgtgcaggcgattggacgccacgacttaatccgcatgcagctaaagctaattaataacaattttataaaatgcacacgtagtattgttactgttacataagatcacatgtcgttgactgacctgactgacggctagcttagctcgtttgcttggaaattcagagacacgcagtgacgcacaaaacgaatggagcatagtcaagtgcaacttgtgtcagaaagagggggaaaaaagtaagccaaaattaatcagagtgaggaagggtcaaagtttttgcatcgaatcgcatcgacttttttttgtgtgcaaacacacggtgagactgagactgtgtcgtgtttgatcggcaaatccattgtgctgaaacgagcagaataatcgcttcacggaaagaaactctcaggcactgtcaagggtttgatatttttcatattttggatgctggaatttgtgttatccatgaaggcagctggatatcttaaactgtgattagatgaggtgatacttgaagcgactgaaaactagtgaggccgctgcattgcagcaaatgtatgttaagcactgaacaattgttcgtgctctcgtttcttgatgcatatttctgaatatagctatcaaaatttctgaaaagaaaatgatcgtatagttggggtcattggggcctacatgaacaagttttcatcagcagaaaccaactcttttgcctaaaaagcgcagaggttgtctcctacacacttcatattctagccgaacgtacagttgatgtactttgttaggcataattccattttgagccttctttttcttctctcttgctgatgtgtttgtttaggaattatcttttgaatttcggctcctaaccaaatacattcatttctaatatcgtgtttctgggatcagattgtcagtgacagtaggaattcagactgctgacttctgaagaagaagaagaagaagcagtgtttaactgaaacacataaaccttttcagacaatttcacatctaggcaaagataagtaagaaagtaagaacaattgaacaatctcatggacaattg

SEQ ID NO: 17908 - DNA, 617 bp, Oryza sativa
attttttaatcaagacgagtggtcaaacgttgaaaacaaaaactcaaaatcccttataatataggacggagggagtatataatttaggttccagagaccagagcatccaggtttcacagcttaccaccatggcagattcattgcaccatgcattttaggctgtgtttagatccaaagtttggatccaaacttcagtccttttccatcacatcaacatgtcatacacacacaacttttcagtcacatcatttttaattttaaccaaaatctaaactttgcgctgaactaaacacagccttgcatatctgattgcgtgttcctctacagctctgctgaatcagtgagtaaacctgaccaaatcatcaatcgcaaaaaacgcatcactccctccatacctactcagatgctgcaaatttcaagaggaagtggggtacaaaattggatatcacatccatgacgcggacaatctccacggacggtggcagcggagcggcaggatgcaatatgaactcgtccggtctgcgcatttgagcaaaatcgttagtactaacaacggtgagagagtacttgatgttggggggcattcaggattagaatctcacctctcgatggcgtca

SEQ ID NO: 17909 - DNA, 1501 bp, Oryza sativa
gagaggcaaagggcatcgcatctcatcgccaacacacccaccaaagtttacgaagccggagtccacggagccaactcgctgggagatctcgtcgaattcctcgactacggtctcatcggcatcgccaattcggttactctctttgtaatctattctcatcatcatcaatcccatataaactgggctagggctattacctgataaggagcctgaaccagtataatccttgtcttttttctgttttgatgtcgtactacgtagatccctgttctaacgtaccccaataccctatccttccagtccacgagtactcctcgacagtggcgcgctaggtagggggacttggtgctcaaggatccactagtatgacttcaagactccccgacaacagcctcagcgccaatcaaggagtttctaccttgacaccgctggtgtggactcaagtcggatctatttccgctctacaccgttacaccaatctcgactggcccgatcgtcatcgggaacaagaagggtacggctacgactgagagaaacggcgccccgtcaataattcctcccactccgatggagaacggaacatcgacggccccaacacctgggacgaaccctcaagcggctgagtttcaccctccgtgtgaaaaatcgaagccgacaaggacaaccaccctgaaaccgagaacttggtgtcccatacataagacaaccaagcatgctctcgaggactgcccggtgatactccacgtgcaagctgaactctacacctgttgggaacgggggatacaacgcacttcaccaacgagtaccacctactgcctgattcacagatctagagtgcatgatctcaccaactgcagaatcttcctcaggaccctcaaaccagcgcatcatcgcgtccagcagccacgagttcaaactccgtgtgttgccaaggaaccagatgcggctccgatcccgaatcggtttgtgggatttgtcggcgcaaacgagccatccgtgttacacctcttagaaggctacgagtcctcctcgcagtcgcctagagatgtaaacgtggtcgacaacactgagacgagcacgtccgccgctgtgagaacgccagctcatcagttgcagaacctagacgcgatattgaggaaaagcccttttgatccggtaacaaacccagatgccagccgatggacagagcgactacgggagaccgtgaccaacctcaacaccgtgtttgctgaagccgcaggcggcccaaagccgaacagagacggagagcggcctaccggagatgcggaggatgaaaaccccgacggaaggcgtaccggcgaccgctcccctccaagatgtgaccctacaccaccgcgccatgaagatggtgaccttcgcgaacatctaaacggacgtcggcgtaacaggagagaacgcaacgagaacgagtgccgccgacatcgttctcctcgtcgtgaggatggcgatccgcaccgacagcatcgtcctcgctcccagc

SEQ ID NO: 17910 - DNA, 1501 bp, Oryza sativa
gtccagcccagccaatcggctgcagcctaaaattctacagcaactcttatgttttgaatgtgcacactgctgcagagggcagctgcttgttggttgccgttgtagttgatgcgagctggctgctgcagctctgcagcgctgcaacaacaatcacaagcgatcagccttattatatgtccaaatttatagtaatagaatgtgttatatctaattttagattcttttttataggacatagaaagtatacgccaatggccggccggcctgcctagtatacaatggaacggcgcatttgcgtcgtcttctccgacggcgttggtggacagaattgcaatgcgagagattcagctggaggcagttgcgttatccagcgcgcagtagcggaatacgtgctctgatgaagcaatataatagaagggttcatcagagatgcaacttgcaagatgctctctctatgatcctatccattctagggaccgtacgagataaggttgggattagtttcagtagaggtgtcatgtgccctgctgcatcttctgttcccaaggacgagaggagtaggacggagccgataagataatgaatattactactgcatctccttttcaaccaaacaaaaaaattctaaatctttgcttagggagtaatcaagcaatcatggtatcctcttgctggggaacgatggatggaccggtagcattgccattgtcagctctgatcagcaccggctactttgtccatctgtcttctttcaaaacgaacaacaacaacgaccagtctaaaaaaacgaacaacaacaacagaaaaaaaagcttgggcctttgtcctgtatactgcgaagtttattgggcctacattcttttatggcctgtttggggcaaaatgccaggctggttgggcctgttttggaagagaggatacaagggccttgtggctctctccggaagccagttactagttcaccaaggtccctcaatttaacatcaagatttttttaatattccttaatcacaaaacagaaatatatacacctaaactcacgtatgagcaagtttaatagtatagccaactactagctttaattcatctatagccaatctaatagctcatacatacaatagttacatactacactattaatacctgatcccacctgttatacacactacgtcttatagtccgtgctacagctggctataaatctgtagccagcttatagcctgctattatacctgctctaaaccatataactcatcgatgtcaccgttccagcgagagtgcctgagtctcgaggaaggagctgatggatgacaggactggatttttcacattttgatccttttaaaaaacttatttcgcaaatagacccctgaaaaaacttatcccagaaatggtcctttttggggcgccagagtggctggcgccgtcatccaacgggacggcgcctcctcctgccaccgtggcgcacgcgaaccgacgtggcaggaggagggcgccagca

SEQ ID NO: 17911 - DNA, 366 bp, Oryza sativa
gacctggattcaacttttgccgatctacacttaaaaacgcagaatgagagatcacaggcgagaaagttaaagatctaacacgctcacacgcatgtcaaatttatatgaagcgttccccaaattcattgaggttatagcagtgtcaatatatacaccccacagcagggtaaaagaactgaagagtgaagacggtttcagtcgtcaacattgcaaattcgtcttgaatcacatgggagacatactaaaactggagccttccagaccttcattctgcaacaacgttcattctgccagtctttgcctagggatgttgtagatcctatttaactctgacatactggaatgggttgaacatgtttcttcaga

SEQ ID NO: 17912 - DNA, 1501 bp, Oryza sativa
ggacatctacagaaaaagttacatccgattctcccccgctttgccgggttcggcgatattaaaacctccaaattccgcttgcaagattgtattttcgaggagagaagtttttcggtggagctttggaaaattccacatgccacatatttcgtccgtttgagtttattttttacgtggttggttcctgtgagttcctaagtgtgaaaaaaatataaaaaaaataaaataaaaataaaaaagttgcacatctctctcctctgcactagttcggagagaggagaggagaggagaggaaaaattctacatgtcatatattacgtccatttgaattcaatttttctatggttggtttttgtgtgtccctaagcgtgaaaaaaatatcaaacaaataaaacaaaaataaaaaatttcgaggggggcgccagccactctggcgcactccccctagccacctcagcatcgccccgccaagtcggcggtgggacggcgccaaagaggctggcgccgtcctgttgaacgacggcggcagccactctggcgccccaaaaaggaccatttttgggataagtttttctagggatctacttgcgaaataagtttttcaaaaggatcaaaatgtgaaaaatccaggatgacaggaaggggaagaagggtggtggtcggcgagaggcggctctccggtgaggaccagatcggcgtcggcgacggcggagagggataacgcagttagcgccatcaaccgttgcgatcgtggcccagatggaggagagcaaaagctggacctttctgaccgttcgatcaacgttagcaacggccgcgattaaccaaacggcaaagggaatttcgcaacggagccctgatttaactggagcttatcctcagttgcactaatcccatctggccgctacgctttccttcctcttgctccgcgcctccgccgacgagctccggtgaggagcggcggcgaccggcagccggcagccgagacagacagcagtgaaggattgccatcaacacgaaccaactggacatcgaaatgctcttgcgcggcgaagccggagaccagccgtcggccaaggtcttccgccgcttcgtccatgacgccatcgagaggtgagattctaatcctgaatgccccccaacatcaagtactctctcaccgttgttagtactaacgattttgctcaaatgcgcagaccggacgagttcatattgcatcctgccgctccgctgccaccgtccgtggagattgtccgcgtcatggatgtgatatccaattttgtaccccacttcctcttgaaatttgcagcatctgagtaggtatggagggagtgatgcgttttttgcgattgatgatttggtcaggtttactcactgattcagcagagctgtagaggaacacgcaatcagatatgcaaggctgtgtttagttcagcgcaaagtttagattttggttaaaattaaaaatgatgtgactgaaaagttgtgtgtgtatgacatg

SEQ ID NO: 17913 - DNA, 541 bp, Oryza sativa
acctaaacatttgcatttcacggagccctaaatttggagacggatggactagtccaaaacacctgcggcgcagtcgcgcaccacaccaccttccgagacgggcttgcacaaaaccgtcgtgaggtcaggtcaggtcgtctccggcttcccccaagccgaaccactttgactcgtcaagccgccgctgatatcatttgctagtcccacccccgcacgcggcacgcggctttccgctcccctttctttttctccgctctccccgcggctattccggggcgttgccagtgacatgacatcccggtgttggtgcggggtgcgaccgatcgagagatgtggcgcaaaagccccggcatttcgcggcggatgactggttgctgccgcccgcgtctcctgcttgctgcctcgtcccggtgccccgcctgtctcgtctcgtccctccaaatctgcgactttcccatcaaaagcgaagcatctgctgcgtacaacacccacctgcgctgcgtgtaacatccatcatcggtcgtaatttcctcgcccatga

SEQ ID NO: 17914 - DNA, 1501 bp, Oryza sativa
cgacgtggctaacttgtataaactgggcgtcgatataagaggatgtaactctagagcgagcttgcagcagatgtttgggtggttccggtaatggtgctgctagagggtgtctccagagagagagaagcgacgaaagcaccaccgccaccgacccaccgtccgtcgtggtctcaagaacattgactgggctttcacccggcagccccactaaaaagggtgagacggcacgacaacaccctcaagaaggggagtgacactcgagcgccatcgttgcctaccttgggttttcacccgccatccaccgcttgccaatccaccgttgacacaccgatgctccaccaccatctaaacctctgccggcgcgtgagcaccactgcaccgccgcccccgccggccagcctccacatgccaccaccgaccgcgcctcgtcgcctctcgctacgccggccactgcctccaccgacccgagcctccccggcgtacatcgctagtggccgttccggcgcctcctcgcgccgtgggcacctcgtcggtcgtcactgtcgccaccggccgtacctctagccgctgccaccgccgaccgcacctccatccactgtcattgccggccacccgctgtcactgccatcaccgcgagccctgcgttgtcgcgatctccgctcccgctcgctgccgtgacgggctctcccaccgcgagctcgccccactcgatctggccgctgaggggccagattgcctccggggatgtcggatccgccccgccgtcgccatccctaccgctgttggtcaccgtgtaacgctctgcttttcgtgagacgttaaaaactaattcggcaaaatcctaattgcgaaaatttcgttctttgagtgttgagtctaagttgtgccaaagatctcaatttaaatccctcccttgtctcgataccctgttatcaaagatcgtctcctcaaaatttccatcccaatatagtcccgaagctcgattccttatattcggaatcccctcttggaaccccatccgtgaactttgtcgaatgcccgaaccctaactccgtccaaggattcaccttcgcgtcataagctctctccttggttccttcaaaccgattctcaaattcgaattcaacctctcaggttttgattcatctatctttctccctgtattggttcatcaatctacccttgttctctttctcgaacttctgatccaagtctgaatatgcaaatcgagatcacttccacccttgaactcaaaatcccaagattcaatccctttcgccctgagttctccccaaaatgatttccgttccgaaataatctcgaagtccgaacccttctattcagacttctctccaaaatccttaccacatatctcgttgagtagtcaaacacaaactcccaagttacactctctttctctaaattatccatccccttttgactcgtctccgaatattgttcccttccttgactccttcctattctcccgagaccgagtatc

SEQ ID NO: 17915 - DNA, 1501 bp, Oryza sativa
tacggttggggggcaacctcctcttcacgctctttgtggcgggcgtcatcgccttcacactccttgctatggtccacaaccccgacgacccactactccaactcctccgatgtcgccggcgcggaggctaccaaggcggtcccgttcatcaagctcgacgacgtggcgaccaaggaggagtcagggtcagggccggcggtggtgtaggccatgaccattgacacagaggccagctcggacgtgggtgcagtggcggaggtggcagcggcggcgacagaggagaaccccatcatcgaggcggtctcctgcgacacggcggtgcctacttcgtcgcctgtctcctgattcctaaacacgacggccgtggcggcggtagtgtcgaggtcgacagccgcctactacatggtgttcagcgacgccgagctgataccgacggctgcgacgacggcggctgtgatgcagcaggcgccgctcctggatgacatcaagatgctgctcgacaactactagcctgcggcggcggtggcggtcactgagaacgggattaggctgctccctcgatgacgatgacgctctcggcctaacaccacacgctgagaaaagtgagagagagagagagatgaagggagagaagagaggaaaagagagaggaggctgatgtggctgtggggcccacatgagtcccacactgactcaaccgccatgtcagacaaaactagagtcaaaaccactgaaggacctgaagtgaacggttttgttagttgagggacgcccggtatctggttttgtagttaggggaacgattttgtaactcggcgacaagttgagggaccttcggtgtactttttccaacggatggaccctagaatggctccgaagtgaacgggtcaagcctagccaacataagtacataacaggccattcatgcttaggcgtatatgcggattcggcctgcatgcccaatattcttgggaaaaagtgcaccgaaggtcccttaacttatcagcgggattcaaaaacgtgctccgaccgcaaaaccagatatgtggggtccctcaactatacaaaaccggtcacccgagatccttcagcaattttgatcctggttttagtctacgtgacagctgagtcagcgtagaccccacgtgggccccacgtgtcagccaaccactctctctctcccctcctctcccatctctctctcacttatctcctctcgggcaagccggggcgggtggggaggagatcgctagggcggccggcgacgcggcagcggcaacacgaggcgacgcggccggcgacaaggcggcgggagccggggcggcgccgcatccacgaccgcctgcctctggtctcccgccgtccctcggaactccgacgtcggaaaattctaacgacgcccgctagctagtctgaccaccatgagcagactccctcgggattccacgaggttacgagcaaggacctgctcctcctcctcatcacggcgccagcaccgacg

SEQ ID NO: 17916 - DNA, 192 bp, Oryza sativa
tagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatttgaaaga

SEQ ID NO: 17917 - DNA, 403 bp, Oryza sativa
ttacctaaggttcatgaataaaagttgttttttgttgttcttgtttctacccgtcttgcccccatcatagcattgtcagtcactttagtcacttctgaggttgtgttttctagccactgttgtagccattaagtacatgccaatctagttctggacctccacatatcaaagtcaattttctttttttattattcaagatatttaatgcaataaaaaaattaaagaacgattctccacagagatatgtacataaggggatccatattcttttatcctgtaatattactagtagtggttactgtagttactaagatcaaatcaagatttatttattgagggttttgctaaaatttcagatgcttatgttacaagcttaagcatatgctaaatatgggttaattgc

SEQ ID NO: 17918 - DNA, 1501 bp, Oryza sativa
agtttcggcccagcctcaccgaaaggtaccacggtagtgtcaacccctccgagtccctccagatccacacgacgatcatagaggtggcgtggggtgacgaccgggtcaaggcgaatttcttccccatggccatccagggccaagcgcggggatcgcttatgaacctgccacctgcctcggtctactcctaggaggactcttgcagttgagctccgggtgccgtcgaagcccgggaccccctgtgctggctcttccgtagcggctagctttggtcccgccggctggctacggtgcctagcccggctcaactaatcgtcctttcaagcttcaagtattttaaatttttcaattcatcagcttaatacagcttgaagtctcatatttatttttcccccgttcttttctcatgaccttgcgacgctcgcgtgttacgcatttgtttgctcccttggtggtaagatcccaacctctctcccatctacatgaacgtttcctcgctaagtgtgggggctaagttttctagccctattccagccttaagttgagcgtcgggtgccgtcgaagcccgggaccccctgtgctggctcttccgtagcggctagctttggtcccgccggctggctacggtgcctagcctggctcaactaatcgtcctttcaagcttcaagtattttaaatttttcaattcatcagcttaatacagcttgaagtctcatatttatttttcccccgttcttttctcatgaccctgcgacgctcgcgtgttacgcatttgtttgctccaatggtggtaagatcccaacctctctcccatctacatgaacgtttcctcgctaagtgtgggggctaagttttctagccctattccagccttaagttgagcgtcgggtgccgtcgaagcccgggaccccctgtgctggctcttccgtagcagctagctttggtcccgccggctggctacagtgcccagcctggctcaactatggacggggatcgctggctctagagtttttcggctctcacactcgtgcgaaagtagttgtccgtgtagaagggagagatattggaaggaggccaccgaaaggaaagagcaaacagaatgtgtagcatggggacacaggctcgtggaaacctcacctcgtttgctaagtggtcgcaggcttcccaaaatggttaggtacccatggtgggaggtcctcttcgagccaaagatttgaaaggttgcgacatccaaacaaggataaacaaaggtaacaaaggaggtattacaatacccggaccaaagccgacctctctgggaaagctcagcgttggccggatgatctttttgagcatagcatttgtaatacttcctttaagtttatatccactttgtccatgcttatcagcaaaattattatggcttatatttatctctcacccatctcttactcgcggtcccacggtacccacgtgtcgcgcgctggcttgcctcccttggtaacaaaaagtttgtattcgc

SEQ ID NO: 17919 - DNA, 1501 bp, Oryza sativa
atcttggtcatcgaccacactctccatcatcatccaatccttgagaaggtttaattgttgcaataccaaatctgatatgactaaagctatgaaagggaaagaacgatggatacgcgaatcatttcaagcacattttgtgcctcatgcaagataagttatcgagaggatataactcttagcagctatgacaaagctcggaaaaatgcagaacatgcttcaggagtattactaccagatgatttccagcttttgtttatttttcttaaattttaagtacccaaaagtacttcagagttctggtctaatggtcagttggattcactacatattccctcgacaaaatcacatcttgttcagctactgctcaagtgctcagatggcatttaatatcaaatagcctcatgtatcaatcttatcatcaatgcttgggctttctaattgcccagaaaacagctcaaaataagagcctgaccacaggcatcacctcagtgtttaaaagagggaagttacgaaaggtaactcacactaaataggactcatcaatggactctaatttcttcagagctcgtcttaacagcatgttccgaagcgctaacatcggtccaagaagatcttcatctcaaaaatcccaacctgtatttttctctatctaaaaagcttatgatcagaaacagacatgccttgctcatcagttactcagttaatttcactattccaatttccaagccaacggaatcgtttttgcatcacaacgcccaccatccagcatgctgcaaagctgtagcatcggttttaggaaattccataaacaccgagacatagcttctccactacctaaaaaggctagatgatcgaaacaaaaaaaaacatgcccttgatttactaatctcgccacgcaaagttgccaagccgacagaactgcctttttttgcatcgcaacaccccactaagcccgaaagtgccgcatcatcatcatcatcatcatcatcatcatcatcatcatcagtatactagtttatgcaaccgcacggcacagaaggcggcgggcggatcacgcacgattcgtggctggcattctctcttggagctagaaaaatctcgccgccaaacaggcagccggatctgtggggatccccaaatcatataactatgaaacagtgatgagggtgatgtcgtgatgaggtgggagagggggggggggcaaggtacctgatgagcccgagcggcgaagggtgggcgatgcgtgcggcgccaccgaggagcgcgcggtggcggcggcggcggcggccatcgccgccgcggcggtggggggtgggacgcgatgctctccgcggccgggcttccttgaggcgagccagtgtggccatccttttcgtgggccgcactctagacgttgcggcccagtataaacggtttcgggctggcccatttagctgtgcaaaattcgtgctttccttttttttctctctccccttttagtggcatttctcttccatcaacg

SEQ ID NO: 17920 - DNA, 1297 bp, Oryza sativa
cgacaataccatagtcgagttggtccgactagatcacccggaacttggctcctgtaggctccgacttcgtaggctgtgatcgttgtgttggcggtgagattcgatgccttaggtcctcccggggggtctgtcggtgacatgggaccgggagtatcatgactagaggcttgaggcagacacaatcgcccacgtggcctggcaccctcgggggacgtcgggcccgagggtgatgtgtggcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaagatgttatttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatctggcgcgccaggtagggggctcagcgtgtgttttctgagctctcgtatttttccgtgtgcgtcaagtttttcttgatcagcctca

SEQ ID NO: 17921 - DNA, 1501 bp, Oryza sativa
cttgcggaggacgcagggaatgtagcggttcaacaccggcccccgcggcaggaagtagcagccgccaaccaccgacggcggcgacaccgactgcacggtgaagaaccaccggaacagccgaagagatgggcgcaccccaatgaacatctcgcacagatgtgcgaagatggccaatgtcatcactgcgttgggggtaaggtgcgccatctggagatcgtagaactccaggacatccatgaagaaagaagaaaatggcggaaccagcccagccattgcaaaggggagaaagaagacggaccgccccgggtagtctggcgccgggcgtccctcgcccagcatgactatctcacggccggtggcagactccggcatgaagcggcgcggcaacccagcctgcttctcgctcgtgatgcgggaaggcggcagcacgctaccatcaagcagtgcggagccccgtgccatggcgccggacgaagaggagatggagagcgagcgcgtgtggcgaaagaagggtgcagggaagaaggagttagggcgcaagcggcgaaggcaagggaaatgatggcgaaaggaaggaagcaaatcccatcctcagtgcctttatacccttgccaacgctgtgcccggctcctcgtttctcgcgcccattatttcgccccctcgcttctcgcacccacgcttccactaaccccattcgcccgcttgcggcgcgtgaagtggatatgcggttgcggcagtcgagatagatcgtatcgtgcgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgt

SEQ ID NO: 17922 - DNA, 1501 bp, Oryza sativa
tcatttggtcttcaggtgtaaactttagatagttaagcagctcagagataaccatgccgtgtggtagtaatttcaattttaggttcattttaatgttgcacaaacatgaggtttcctcctatgtgtttattcagagttagtataataagtgcggatatatgtgcagccatctggagtgcatttcagagagaaggaactgcagtcgtacatcgccaacttgcagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttag

SEQ ID NO: 17923 - DNA, 1501 bp, Oryza sativa
atacatgcttacaaggctaggacttagttctgcgcaccctggtacaactgagagaccactccctgctagcctgccaacatggtaatgacattttacaaactcttatgtcatacctagaagtggaggaatacaaaggacggatagagttgtcatcacctgccgcctaactcactttccgtggggtatacccgcatccaatggaatttaactaacctaaacaccatgtttatgctaataaataatgtcatgagttagagctagtgcaacccattagtattggaccgttaccatggcatagatcgactagcataatcaagtgaaacagttaaatgaagtacaatttgtttgtagaacacaaaattaataaactaatatatcaactatgaacactaataagtaaataagataattttttaatgcaactatagtcttacaagaagagtaaagtactgaagacataccggaatctccgagaagacaagaggaccaaagattactttaagcctaactacaatatgtggaatgagagaattgctccttgagtgtgtgctttgagagagaagaagtgatttccttttatagttgcttatgacgggaaggccggtaactcgcacaatcgtcatcgggaagcaaccatgaagcgccacgtggagggtggatatgagaggaggtgatggcggtttggccgaaccctgggccccaccccactcaatcgcctttcttcaagagctgacgtgtgaacccctagaatgttgcactgtggtttggccccactttagctttatttgatctgacttgtatgcccattaatccgtgtgctctcacgtgattcgtcggaagtgtgtttcttcgcatgccattgcaatttctccttaatttgtagcatacccctgcatacatagtatttctccaagaacaagtggaactacattatttagtactaatatacgtgtaagaaatgttagttctccctttatttgttctaaggtagttaacggtcaaaaccgatacttaacggccgttaacaacaccctcaagctaaacttttgctcctcctcaagtaaagataaaatttaggttgttgatcaggagttgctaccatgttttatgccacaatagtaccatgcctacaacgtatccttctacctagaaattaaacaaattggcaattgtacttttacctttcttaccttactcccgttggggcttttagcttctcctcatcttgggtaattgagagacagaacgaatcatagagcacaatcacttactctttgtttaactttatttctagaggttttcaagaattttataaataaaaggaaaaagtacgaattaccccccccccccgaactattgcggtcgaccgaattaaccccctgaacccgaaaaccaaacattgcacaccctgaactttcaataccggacgaattaccctcctcaacctaacctagagcagttttgtcctacgtggcttacgcgtggcaatctagttagcata

SEQ ID NO: 17924 - DNA, 1501 bp, Oryza sativa
cttctcctccgtgcggcgcacggccggcgaggccacccagggttggtgacccaaggggggcgagagcgcggagacgcggcccccccatccatctccgtctcccccgtccggatcgaatccgaggtatccgctcttctttctctcttgtagcgctcgctcgtcgtcctccgcgcatgccatccccatgagtgagccggcgtgcgcgtgggttggagatccatcagtaattagaatatctagattggtttgtatcatccccaattaacctgtccacgcagcgaaccgtcttccggagaattggtgagcggagtggtgctgctgatatcaaatcatatagttgcgtgtaatttttgtatgtgttgctgcaggattgatgtagaggtgtggaatcaccgtaccatgttggcacatagtatttgtcgatatggccgtatggggtttatttagcgtgaaaccgattggcattacttggatcatgtcaacatagtgtttttttgttcagatatagccttttactgatcggtctgtgattgtgtgcctacctttgaagttacttccttcatttttttttctgctttcatatgctgatgcagcttctcactaaagcaacttctgcaaatattttctgttggatgtaaatgcacacttttttcgtcgaaataaatcttccataaaagaggagcacggtattaggtgtacccctgacactcactacaacttaagtgtgcttctgagattcttccttttctcgcaatttcataatatacataccaactactattgtgctacaaagatctattgtaactctagcattacacggtgggacttgctacctttttctttaacataaacggtatacatcgttggacaattccactaataagggattttctcttcaccttgcataatgtttttggttgtattgacaagcactgttttaatcctaaaactctctctctctctctctctctctctctctctctctggggtcttatatgtcctgctgttttgttgcctgctatagcattaggcatcaagttccttccagttactatgtgctggtccttttgttaggtttgtaaaatcatagttagttaactagccagatggacatattgcacattatctctctttttccccactttctgatatattacagctggtatatgctcatccatgccacacgttattgtataagtaaaacacactgtggtgaacaaaaatgccattctataacgcgcagctgtgaacattttttattggtgattttttttttggaaaatttatacagaaccagagcaagcagaaatatgccatgtttttccttctttattctactgaagaacaggacaaaattgtgtatatatgttctggtcacacaaaattatattgaaatcctttgaacacattggttgcttttcatttgtcaagtctaaggatgatcaagctggtcttttgtttcacaaagtcacttgtatgcttcttccatgagaagtccttt

SEQ ID NO: 17925 - DNA, 1501 bp, Oryza sativa
aaaatcagtactattagacgtggcacaaaaatcttgagaaagctccagggtgccagtctgactagccatggacccggtctgatcggcagtcagtgaagcggtcagaccggccacaggaggcacagtctagctgacaaagggcacggtctggctgacacagagggaacagtctgaccagtgtcatgcgcggtgtgaccgttggctaggttctgtgtgtagtttattcctgtgtaatcggttgtgtaaatacccttgatccatccatgttactataggcatgttgtatgggagcaaaactggaagtagcattagattattgataattgactattttggagccaatctattatattattaaaggaatagaaaaatgagcctctacgttcgctctcatggtctagaaattctcacattaatcggagaaaaagaaaaagcaaagtccatatagaaatacaatttaaaaatagctgaaattcagaattaaaaaataaggaatattaggagaggagattagagtccatatagaaatacaatttagaaatagttgaaattcggaattaaaaaataaggagtatttgaagaggagactagagtctatatagaaatacaattaggaaataactgaaattcagaattaaaaaataagaaatattagaagaggagactagagtccatatagaaatataattaagcaataactgaaattcagaattaaaaataagaaatattagcagtagagtatagagtccataaggaaatacaattaggaaataactgaaattcagaattaaaaataaggaatattagaagtagagtatagagtccatataaaaatacaattaggaaataacagaaattcagaattaaaaataaggaatattagaagtagagtatagagtccatatagaaatgcaattaagaaaaaaaatagaaatttggaattaaaaaataaggaatattagaagtagagtatggagtccatataggaatttaaaactaactaaaatttgaaataaacataataaaattaaaagtagagtttagagtccgtataaaaatataatttagaaataactaaaattataaattaagaaaaacatgggaagaagagttgaaggtcagtataggaatacaaatataggaatacaatttagaagtaactgaaatctgaaattaaaaattaaagaatattgaaagatgagtttagagtccacatagaaatacaattagaaataataaaaaatcagaaataaaaataaaaaatattggaagaagagcatagagtctatatagaaatacaatttacagaaaattcggaattaaaaaatattaaaagacgagtctagagtccatataggaatatatataatttacaaataactaaaatttgatattaaaaataattaataactaacacgtatataaaatataatatgaaaaatcagaaataaaaataaataatattggaagaagagcatagagtctatatagaaatacaatt

SEQ ID NO: 17926 - DNA, 1501 bp, Oryza sativa
gtttggagcccgagacgagctcgaatcgagcctaggatgagtcgagctctagcagcttgcgagcctcgagcttttttgacagccctacctaacctcaatgaagcaaaagacaatatagaagaaggaagggttgtttcccgggcagcttaccttgctagagttgcttggcatggaaatgaacatgttgtactcccttttgatctgaacttgcaaacttttgatctcaacatggaagctgcatggaagctgcagaagaaggaatggatctaggttatttttacgtcatctattttttctcaatgcatcacatggatctttatcagtgcattaaatgttgtttgcaatacttgatgatgattgcattattcaatctagtttagaaaaaaatatatggtattctatgacatgtgcagcacactctactccctctgcccctcatgatcagcacacacacatgatgttaacaaaacaaaagattggtactacgataatttgacagtttagctcatctacttccattttctcctaaataatgttaaatatttaagatttttgattcatcaacacaaccacatcgacaaagcaagatttgtgcataatttgattagcaattcagcctacaaattttcaagttatcataaaagagagaagtacaaggtaattcaatgatcactttgttgcacccccatccatgaagtttcccatctgcatgaactgccattgtatgccttcaccacctgattcatcacagaaaaaaggaccagataaatgacatattcctcctcaaaaggttgtgtaaaatagaattatgacagatagctacattaaaaaatcatagaaagggcaactaatctttcacaatgcataaaagaaaatcaacatatagacatgaagccacaacataacattgttgattacgctacatcaatacaagcatagggtagtactggaatcaatactaaaaaaagagtgtaaacttcagttgcatagttgtatgcctaagtcatggataatatatggaatagataatattgttctaacgtacagtatgagtcatgacattgcatatcctaaacatatacaatgtgctttgtggctaggtaaagggtactgactagcaagttgtttttttcagacaatgatcaccaactcaaggagcacacccttcatgttaatgcaaacgcaaatgagaaacaaggtattgaactaggtaaagttcatgactttttaattagttaagaatatgttcatgtccttgatttcggttgtgaataaatcagcataatctgattagccacattaacttaccaagtaaataattttgtagatgacgacgatgttttgcaacatgagctacaagccttggagtatgacattcaagagtatggtgtgtacgccgatgctatcaatgttgtgttcaatgtagacgagttgctcgactcagatgaagaagaaaatgatgcaaatgcaaatgagccaatcaagtccagaaaattgacaa

SEQ ID NO: 17927 - DNA, 1501 bp, Oryza sativa
gatctagcggcgaaactattctagatagaataatctaagcaaaacccaaaccctaaagatgatggcgggtactgatatatagagtttagggtcatgcaaccaacccttgatgcagccctaatggcctccaacacgatacatggcccaaaggcccaaatacggtgacgcaacaccgggacagattctggacgtcaacttattcggtcgattcccgttgactcgaaaagaatttggacatgggaataaaagcattagaatcttagctttccatccatataaagatcgccccaatccgagcacgtatgcgacctgggcacccgttttagtgtagactggtcctgaactccgagttgcactcgaagtcgatttggtttggacctctaccttgacttggacgtcctcgatgatcctccatgactctaagtccttctccaagtgtctccttgtcccctccattgtttctaatcacaatataatcattaggtagcaatctattctaaaattcgtacaaagaagaacatagaaacgagctcacctctaaattcaattgtcgcgcacgagctcttgttatcggtccttgaatgaccgttggaggattgttgtgtgtatccgaaggagtgatgttcacatcacgtaagcacaccatgttacaccctttgataatttaacccttttcatggcattttagatcctctacagttgcatctagctattgcaaagattgtgttaacagtgaaatttggtaagctccgaagtcatcatcggcctaaagtcagtatcggctttagagtcctggaatcggccgataggaattatcaagttgccaatagtcagattcttgctatattcggttaaggaaattaatctattcaaggaagcttatccagaagagaccaagttcaaggaggatgcagcatggtaagttatctattaattaaaaagactctgttagtttccttttatctttaggaaagtgtgtttagtgtccgataaggactttatgttttccttttatctttaggaatgtttctttcttgtcctacaaagactagtatctacccatgggtataagtatgtacattccgtggtcattgtaaactatctcacagatcaatacaattcggtgcatcaccacctgttaacggccaaatttggtaaatcatacatcggattcaaagttaaaatcgaagcggattttgagagagtttgtttctcagaagcagagtgcgcatcggctactggcagcatcggctattgtctgcatcagctgatactggatcggatagggagaagccgttgtagccgatcccaggaagatggttctagaatcattgatgggatcaattgaggcgctgcacaagcattgccacgtatggattgagtccaaagaaggcaactgtatctattaattaggatatttctagttaatttctttagagatattttcggtaagagtccgcctaagggacttgttcgtattttaagttgtaatagagataga

SEQ ID NO: 17928 - DNA, 1501 bp, Oryza sativa
tgagattcaagtatccaaaaacacctatcagtacttctctggtgaaaaaaataatctctctaaaatatgcaagtgatctgtattaatggagaaatgtggtgtcctcgtcgccagcatttcatagactagaactttgggtatgttctcaagggtgagcagaaaaaaatgttgcatagctgctcggcaacattgactatcaaactgcaaaaggttgtttcatgatacgatactccaaagcacagaggcataattgagtgattatggacttgcgagtgcttatagcagttctaatcagccattattttggttcactcaaatttgtttgaaatttgaaatatttgtctattttcatttgcataatttacaggtggtattacactcaaatggggtcaagatgacaggaatatgcactcttggtacaaagtaactagtagctggagagaaaaacacttacagaaaacattcgtccatcacgagttagcgcaactgaatgggttcctccacatgatacctgcacgcaagaaaatgagtactggtgctcaacttggacaaaaaaaaatccattacctcaggcacagcataggagaattacctgaataatatcctctccagcaagaagctcaaccttttggggaaccatgtgactacttttatcatctccaaatccaagcctcccatgctctcctctcccccaagcatacacctatagaggtccagaaagtgaacagctattaatcccttgtgcacaaagcaatgtttatttgccatccttctggtggcttggcagaaataagctcaaacatgatgtttcagttaaagccaaaggaaggaaatacctctccctctttagttaatgcagttgaatgccaacctccagcagcaatgtcaacctgcaaacaaatgtacaaatgagcaatatgtatgaaactataaacaagaaggtaagatacaaaggcatgatccagaaaattgtgcagacgaatatttatttatcagcatacagtggtagcctataatcagcacaaagttatatgtatagctagaatcaaacatactagtgtaaatggttaggagtggaggtactgaacaccatggcttgtgagatgaaccgagcacaactgaagtgactgtaagcaaacatagtttaacgcaggatccaaaagactaggttctgttttgggctttgttagtaatgtcttgagaagacaaccaccctgttataaactttatttcacaagttatcagaattagaagaaaccaaatcagtgtggctcaccaatgaaaggtcagataatccttcaacacggattggttgcgatcttggttgagtatctccagtgcccagttgaccatactcattgttaccccatgcccacaaaattccatcttctgttagagccaaattatggaatgcacctacagcaatcacctttacattctcaaggccttgcacccgcactggtgtagatatttgcttgctgaaaaaggactaatggtcacc

SEQ ID NO: 17929 - DNA, 1501 bp, Oryza sativa
caatactaaaaggggtggctatcaagctggaaaagtggatgggtttagagacaaggaattttatacaggttcaggccttcttaataagaagtaataccctactcctatccagggattgatccaccgagtatattattgatcgtatgatctgagagaaaaatcgtgccccaagaggcacccagacccttccttatataggggaaggagtccgtattacaaagtacagcccatattcctaacggaataggcagttatagataagatacagtcataaccgactgaaatcccgggtgcttccttaatatacaagtttaaggaatttaacccgaaaccctttaaagatattctatctatacatggtacccctatacccagtcggatataaatgccgtgtggatatgtggtatccataatctccacagtagcccctaagacctttacagtcgacgaaatagtcttttctcgtaatccaaaacgacaaaacgataatccgagtgcttcaacttctcctgccttggtctcccgagtacttaaatcaaagactgtgaagggttgaaaattaaaaatcaggtgcatcgactagatgcacctaattaggtgtagcccccaactatgtgattagttgaataaaaactaaacatatagtcaaggtacattaaacatccatccgagtgatcttataaccgaatcactttagggattatatacttaagctcatgcagcacttgataaaatatccaaccgactgctttagccataatacgcccaaaaaggcataaagagatccgagtgaaaagcactccaaagatctataaatcaacatatatgacaagaatccgagtaaaaaactcttaaaggattcatcaactgttgtataaagaataacaaatgacaagtcaaaatagcctaagctgcgacttatgtcaatatcaaaataagcatataacatgctgagagaatagccatctgaaattaaccatctcaacaaaacccaagtagctttgcaacctaaaaaggtcaacaaaattagtattacacttttctgtcgggcacctttttatttcgcatcgtagtaattccaaagaattatctagctgcatcaaaaaggattttaacggtattgggctatcctgttgtgagcaatttataccaaggcaaaaatatatgcttaaatccctaaggaacacaaccagccacgccaatagtgaagttgggctgaaagcactgtgcaggcctaggcccattagtacctcccgataccctaacaaaaaacactgaacaagcgtcgcttcgtcttcgccgccgagacctccgccactttccccattctgtgctatagtacaagaactgcgccggtgaaaactagggtttgcaaatcctcaccaatccaccttcccaaagcctcgtgtttttgcgaagatctcccgcacaactaccgcatcgattccctctccaatcactaccaccctcacgctagatttcatcatccatcttgcatcca

SEQ ID NO: 17930 - DNA, 1501 bp, Oryza sativa
atcttccctttatattaagatcttgctgcgtttaagtatattaagctcctgtttaatgtattctacttgctttaatatcttaatatagagtggtatcggagtattagccgatacatgctagatctatctgatcggctatgctatgaacatatataatcctattattaatatatatttccatctaagtgatttatactatctcggcaaggtgaccgatctatcccaaccacttgatttaagtatatatcgatataaggattacatatgattaatatctacagccgatcgagtagatttagttctgatttgtttactaatacttgccgatcgatgtacatatgacatcggcataagataaatggtatgtcatcggcatctagccgatcggctatcatttatagatttaaccacgaattctttgtctctatttcttgttgattacaggatcaaatcaactggcacgctcatacatccgaaggcgagctttggacctgcacaggagttaagcagatctcctaggcctcgtgttttctgtcaacaggccggcgctatgagatagttcgtcggtcttcgttggtgggttgggcgcgacgattctgcatttgtcgagatcgttctcgataatatggtgtacttgaccacagcctactcgagtgctcaattgttcctgaaaaatattttctagaagacaagacatatatcagataatatcgagtatgtactcaaaaactacatggatcttctagcattatcaggatatgacgagcagatataaatatcaggcattatgtaaaccgtaagcaagcatgatttatacgaaagaaaatagagcgagcccccagcattaaactgtagtcgatttaacattggggacactcgcgcaataggtattgtataaaaaacatgtaataggtaaacataataaattatagatctgacaatattgtatgatctgagtaggtacgataaattgtatataaaatattgcgtacctgtgaagatacatgccggatgtatctacggaattagtagatcaattaaaaattaatcttactaaataccttgtttagccttggtagccgatcttaactgtactctgaacgcacaataattagcatatatcggtggcctgcatgggccccacggtatgcatgctaatatttttgtagatggcgatgcgatcggtcggctggttggttctaatacggcaaattgtctggcttcgacatcctttgctgcggtggggttagtcgaaccatggtgaagcaccacgactgacaaccctaaaatcgacgtgatccgcggtggtgacgtcttgaagcttggtcgatctcgagagatcgaattgttgatgacgatggttccgatattgtcggaagacatactccggtcgtgttagatctccacagccgaagtcgtcgagtagcttgttgtcggagaatccatctcttaaacccatctcgtcgaaaccttgaagcaccaaaatgcccctacgtggcgc

SEQ ID NO: 17931 - DNA, 1501 bp, Oryza sativa
gattcgacatgaacttgcaagattgtttggcctttagataggcggattgatttgttcccgtgaatcttttgtataacccatgcgtgttaatggagcggatctgatttctaccgtattaggtctatcagggcaggaattcaactttgcatccttttgttctctctgttgcgaggagttcatttctggattcgttgggttcaatctgctgcggcgcccttctcacctgattcgtgaggaggtagacagcttgttcgtatctcgtggttataggagaagagtacaaacgtttgcgataacccatccgcttatggtcgattgttgtatattagaaacttgttgctttgaacccggatttagctattgttcctttctattggaggggtttgattctgtttctatttggagggggaaatatgttctatttagagggcaaagattgacaatttttttcctccaaaggcaccttttttacgatataaccctcttatgacctgcctatgatttgattcggttagacatatcttatgtcagtattggaacacttatgctagttctagagttctttttttgtcaaaataactaatttatatgagttgccttgcggtttattctagaaagctaacaggattttatcataataagatgtataattcagtcttatattggtaacctgtaaatctcatgccttctccttttccataggattatggagaatacatgtgtgacccagtggaagccgctgcaggtttccctttttgggtcgattgtgtaagcatgcgttcggaaatatagagaaaatgaagcggcagcgtgagttgaaaggcaatcaggtgccattttgttcttcccttcttgtggcctcccacgagacacccatggaattaatccgtgtaaattgaatgcttccgtaatctgcccaacaatggtcaggaaatcctccaattagttctgtcgatgagcttttgtaggaactcttacggtgtgctgacgcatcaacttgtcaatgcttctgtttaaatatgaaacggccttacaaattagaagtcacctccaactctgtttgcttccaactgctcttggttttaaccttggtggtgtgcggctgtgcgtttcatcttcgatttttttttgtgttgttttcttcttgtgttgcctttattttttctgaatcacaagtgtgctactatgttttaaaccaatgttttgatgatactcctgttgcactgtcttgtatggtaaatttcttatgtctagtgcttcttttgcaggatgtaattacggatcttcttcaatgtctaataggttcaatgaaaatccatatgatgacattgagttcactgatgttgctgcttcaaaggtatagagctatttcaagataacttgcccttcatccttctagtatgtccaggatatatttctgaatttccccccattgctaattcattccatttttgtgtgcttaggatgtttcacatacatcatcagtaaggaataactcaaa

SEQ ID NO: 17932 - DNA, 460 bp, Oryza sativa
atattaacttttacttttacatacttataataaaattttaacagatattaaatggttagacattatgaaaatcaacgatgtcatgtatttaaaaagaagatagtatatatgtactactacatctgtcttattacattataagtcgttttaacttttttttctaaatcaaattttgatcaatttatatagaaatatagcaatatttttaatataaatccattcaaaaaaatatttttaatatgaaaaagaaactatcaaaatatactgaaggttagatttaataaaattaatttagtgctataaatgttgctatattttttgataacttaactatacttttaagaagatttatttaaagagaatcagaactatttgaaacatgaaacggaggggaatactagttttagcagcagtactgcctgcctgggtcatataatggaactggacgggacgggttagg

SEQ ID NO: 17933 - DNA, 1047 bp, Oryza sativa
gcatcctagtcctagtcctgcaatgcggtatggctagaggtgccatcaggtttatatggtgtggttaaaacttcaggtgaagttgtgtgcaaaatgtatcttgatatgcatctctctcctctcttcagctcctatctctcaattagcctatttatggaatgctgaaacacatctcttctcttcctcaaccccaagttatatataaagaagagagggtagcaatagcatcttgaatttgatccggtattgcaatcatgtgttaccatgtgtgtgaaagctctgcactacacacatggtaaacagttggtgtacaggaggtgcactaaagttcagggtaactgcctatctgcatcctcaagttgtgctgcaaaattgctgggacaaaatgactgggagtgcaatcattatgcaattagtaatttctactatggaaggtttcactattttttttttgtctatgacaaaataaaatgacttaacaatgtttgactccctctgcgcctaaaatactgtagttttagctagtaaaagatatatttagatagtcaacatatctaaataagctccatcctttctcccatttcgcgattggctttagaatgcaacatgtgaaccagccaacttggacactaaaagttttataattgtgaatcatgcatgaaaatgatcttacctaaaccgttcaaggtattctcaatctcacttaacctaagttgaattaaatctcttaatgatggacttatgtaaagcctaggtaattaagtttaattacgatgtttcatgagctggacagtaatatattattaattcttggaatacggtcagatagagttgttctctgtaggagcagtttgtcttggatgctgtatgaaatatttctgtcattacttggtcctacccatgtatcacaggctaccatattgcaggaatcagtaattcagtatttgaattgcctactccacctctcttatatttgttgtagatgtgctggccgtatagtcaatattcattgactgatgctcacccatccaattttactgttctagt

SEQ ID NO: 17934 - DNA, 433 bp, Oryza sativa
aaaaatcactgagtcatctctcttctaattcgcctgtcaccactctagtgagggctgagtaaaatattactgcctcatctaataagttataaggtgctacgtattaaataacacctgatacagcctctaacacactcgccttgctcccccccaggtacatagcatgcagttaaactttaacgtatgacatgaggcagtcattatttataggagttggataatctgcacgtgggttcatatgcacccacgatctgcaccctacacgtgtgcgcacgaatcttaaagcatggtacatttacccctagtgaagtgtatctgctctatcaaaagtagctctttcgcctaataggagctggtgggattggacggtgggtacacaatggtcctgtagttttacccgaaatgcccttctagtcctactcgggctgtgccc

SEQ ID NO: 17935 - DNA, 440 bp, Oryza sativa
cccatgctgtattaatttaattgtactccgatgaaatccttgtccatgcagttatatgatgatcaaattgagaaaatttggttttcaatatatgatgatcaatttgggcaagagtgagtaagtcttaaccataaatactccatccatcccattttaaacatcacataagcaaagaacacaaagatcatggacaactaaacctttatcattctgtaattaattctcatcagttataagagcatctccaatagcctctccaaatcggactctccaaacacccatatagccaactctccatcttatttggctagtcaaactacttactcgctccaacagcctctccatctacccactctattttaagtctatcacagtgggtccccacatgtcagtcgcttgcttttctttattctctccctactttctttttcttccgcagg

SEQ ID NO: 17936 - DNA, 900 bp, Oryza sativa
aatttgcgacttatcacttatatgaggaaatggcccggggtcccccaacctattggggagagattcagccataagaccattagatgcgcattgcttgcggttaccgatcaaaacacgaaaaactacaggcgataattttttattttacttttacaaggatcggtttggaaggcattttgttggctacaactattattataatccaaagacaatgcagctaatattcaggtgcattagtcagaattgcattattattattttggatgaaggtagtataaccgcccctgcccgctcaaaaaaaaaatctaaagtgaagttttaaaattcaaatttcgcaacggcttaagcatgcacttatgcatacacagaagcatgactttgtaaacattaaaagaaattatgacaagcagaactttaaatactcctttagaattgaatgattgaagtgcttcctgtgttcttttcaattgtccatattttcttttaaaagagtataaaacagtaacagggcaattcaattgtccatatggatcggctctaacctacgataaaataattcttagctgttccgaaaataatacaatctagtcaaggcaatatagtattacccatatactcttagccagtcacgcagagcgacgaaaacaaaaaagaaacccgtaaattaattctaaaatgaaatgtcaaaattcaaatttggcatacacagaaatatgactttataagcttaatagaaagcatggcctacaataagcagcattttaaatataaaacagtgacaggtcattgggacgaaccggatgtaacctgcaataataaaaccttttgttcctccatgattataacaccctaccctactccttcccccactatatttagtctctgcagaaagctgaacac

SEQ ID NO: 17937 - DNA, 296 bp, Oryza sativa
tactccaactccaagactttcacttgtctgagatttcttcagaatgcagagtcagtggaccctaattattttctttatcaaatcttcttggagtacaagctacccctccggtcccaaaaaatttgaacagccttgtactaatatatcctatctaattaaaatatatcctccgtcccataatatacactcaaaatatcttataatatgggactgtgagagtatatgttagtgggtagtattggttagccgaccaaatcttaccatttggtatttcttcatgtcatgcagacggcaga

SEQ ID NO: 17938 - DNA, 358 bp, Oryza sativa
gtagttagccatcatactatctaagagggtcgatgatttgtgcagtaatagtattggcaacgtacccaaattaagagggtcgatggtttgtgcagtaatagtattggtaatctgtacccaaattaaaccttgcttttgcaattctaattaagggtccgtaaccaaaataaaccttaccaaattttgatattttgataatttagcaatattactaagttttagcaggatttcttatgtatttaacagagtttgataaaaaactaaatggatgtatatatttgacaacataccaaaaatggtatggtttgaaatgacatcaatctgaataacccctaagtaaaccgatattttttttaga

SEQ ID NO: 17939 - DNA, 219 bp, Oryza sativa
cctgctgagcagccagttttccaaaaccctcggtatgcattcgacatattccgcatattcaatctgttcatactttactgtctagtttacatgtgtagatcgtatgatgtgattatgtcatttgcaatgtcatgatttatttatggaataaatgaaataattatgtgctaatattttcaacaatccaaaaaccttattataggcattgtggttttacta

SEQ ID NO: 17940 - DNA, 174 bp, Oryza sativa
tgcagccctatttaaaacattttacttttataaatattgctggtcaaagtagcatcttgaatactgtatcaggatttaaaaatacttatatttttggacgagtagattgccgggtgacttgtcatgacatccaaagaatgaaaattagaaccacaaatccacggtaggcagcaa

SEQ ID NO: 17941 - DNA, 1501 bp, Oryza sativa
acgaatcttttgagcctaatttgcatttgctaatgatggattaattaggcttaatagattcgtctcgctgtttacaggcggaatatgtaatttgttttgttttagtctacgtttaatagttcaaatgtgagtccgtatacatcaattttttttcccaaaacaactaaacacggcccgaatagcaatccgcgtgtttttttggccttttgcccctaacaaaattgtgtttgcagtttgcacatagagatgcagagacatagagagaatagaataatcaaactctgtgttctattgttcagggtgcccagctccaggagaggcagacagagaagcaaactattccgtgttctccattactcagatcggaagaagtgggcgcggcgatttttctggtcaaaatttgcttacacacgaagaaagcccacacacgttgatccgttgatgggcctatccttctcctacatatatatgggctttgattccgccaatcccaagtaaacccgaaaatacgccttcgacagcagctgacgtattcctcgcttccgaaagtgcaatttccaaccgaagcgagaggccaccacaaagacgaggcccccgtcctccgccgctcgtcgacggcatgcagcagcagggcgccgccgcgctcacgccggcgaccggcctcgggagccggccatccctcaccgtcaaaaccagccgcgtgtgcaccaccgctgctctccctcccctctgccgctgtggccggcgccacctcatcggctccacctcggccaccgctctcctccccctgctcgccctcccgtcgcccgccgcctcgcccgtcgaccccgaagtaagcttcttgccggccctggccctgatgaggccctccatgtttggtggcttcatggccatcttctgagctgcccgtacttgggtttttggttgttgtgcaggtgatgcttgagcgggtgcaccctgccaggccggagtggtacgagaagttctatgccacggccatggacaagttcatgaaaccttacgaggctgaggtatttttgcttttcccctagtttcagactttcagttccactactctgccattctgaaacttgtggtttgctagtagatttttgtctatacgaacaactgtattggtgctcagtgctcactcaactcagtttgcccaattcgacatcagagttaatttttttccatacatgacatgttgaccatttcgatcacatatctgttaatctgtataagctctaacgtttgattttcagaactcggtaatttgtcttagtatctgaatttttttccatagatatcactatatcagaattcacaagtaagcacctagagtgtctgcgagtagcagacatgatcttaaatcttcatcagtaattttagcttccctgttaaaaaaagttatcactgttttttttctcagggattgtgatgtgattttgatcatctgccgtgatcatgctgatcttatcacaataatgagttttgcaga

SEQ ID NO: 17942 - DNA, 1501 bp, Oryza sativa
tataccgagtcaaggaagatcaacaccagcctactgtaacttgccctgctcctgatgatgtgcacgacggacagcgggatggacagcaccaggtacgcagtaacagccgaattcgccaccacgaacaacctggtgacaacaggaaggaataaacgagcttgcaaacggaagtaatgcagattgacgattgtagctagaaggcaagaatggtcgcacgttaaggtcgggaggtcactgtactgcgccttgaaccggaggaactgcgtgaagaacgggagcgtctggttggtggtgcccatggcgatggcgctgtcgacgatggcgacgaccgccacgacgcggaggatgaggtcggccacggacagcgctctgctcgccgctccgccgcggctgctgccgctcaccacggtgcgggccgccgttctcgaagcctcgccgtcgccgtgctcggtcgacgtcgtcactgcggcttttccttccattggtgacgcttaattagttcaagcgaaggtgaaggatgcagactcgctgttcttgatgaagcaggatatacgacgtgttcgtgttggcgtgttggtgttgcaagcttgtgtggctgtgtgccaaagtgtaatattctagtattacgaatctgatatatatatatatatatatatatatatatatatcatattagaatataatatatacggttttaaatttgtattttataggacggagatagtatacaggaagggacagggccgaggcacccatgaaactagcgcgtgtggggttaggtgattgtgacgtgagtaatacatggcatgatgcgtgccccgcgctcaccggccggtgcatggtgtttggttggtaccaactgtcgcttgctccatcgacataaacagcatcagctagacttgttctatgttcagtactccgtactgctaattggacctttttccaatgtgtgaaagtatcacttggagcttgcgtccttgtgtttatcacttatcagcttgcaaaaatgggctgccgagcttagtgctatgcctgtagtttgtgaagtgggttgaaacatctccacaagtgatgaaagaattatttttaaatagttcaacataagtttgttttttttctagaacacatatatttttatcaaaatatattcatgtgagatcttgttataaattatagattggatatatattttagaataaaattatgtttaaagtttgattaagagagacagagtaatgatgcctcacgtcatcttggcaaccaggtctactcctgcatgcatgcatgcatgcgacaacctcgctccttcaacgtgtccctgcatacaaacgaggagcagcgtctttaaaaaaatattgaacgtacgattggtaggctccgatatttgaaaaaatattgaacgtacgatttgtagcgtccgatttaaaaatatttcaacataattaagtatttgtgcaaaaatattttatttttcatatgattttttttatgtttcactcat

SEQ ID NO: 17943 - DNA, 1501 bp, Oryza sativa
ctggttgctcctcaggaacaacaaagactggatccgagttctctatctggagatagaatcacctcgcccgccatttgctacgagaagaggggcactggaaggggatgtatcgcgacttcaggccatcccgaagtcggaaaccgacacatctggatacctttttcggttccatccagcgcaactcatagtaaaagcgaaagagaccaagaaatggctctaccccaatgtaggcctaacaaagataagagaagatactgaggaaggtgatggaattggggttcagatggagcaaggaaaggccataaaaattcaagacaaggagaagaaacttggagggcggaggaagaaaaccacaaagaatgtaatcctcaaccgcaaccatgcggcccaggacaggttcgggttcagtacctcctgtttctctctccatggtcccgcgaccaaggaggaaaccgtcgtcctacagcttcttcagggacgcattggtggtggtggacttgtcgagatccatcaccgccggagatcgccggagaacaagacaagatgagaaagctagggtttttttctgcgggagcggagaagacgaggggcgcttggaggctgggaagttttgcagcaaacggacttcaaaatggatccccaaaactcccttaaataaatgcactaccgacggtgcgaattccaaggaaaggagagagaaggccgctggaaatttctggatccgttacgcgcagcagttttcggacttcaatttaaattcactcatgaccgttgaacttcgtgcaaagttatcgataactctatgtctctacggttctcataccgagatcgacctgttgagagtgataacgattccgacatcagaagtcgcgatcggtcacatgagttcatttaagcagaagtcgggggctactgccagggttacggataaggtataccctttacccttggatgtatgttgtataccgatacggttagggatggcaattttacccatgggtccgggtatccgtggatacccgacccgatgggcacgggcgtgggtgtgactttttacccatgggcacgcccgcccgagacccgaagacgttatgggcaataggtgggtttcattttttacccgtgggtaacccatgcccaacccgatacatatgtattagctaattttgactcatttcttaattcttataccatttctctcagttcatttgtgatgctaactgatactaagttgtgatgtaattcaaattattgttgataaacgataatttggtaaattattgattttatttctctttgttaagttacatatcttttaagttattattcatgtgagatccattgggtacccgccggacatacccgcgcccgccgggcatgggtacgggcacgaagttttgcccgctaactctaatgggtagggtttgggtgggcaatgtcgggcatcgggtcgggcatggttttgctctacccgtgcccgacccattgtcatccctagata

SEQ ID NO: 17944 - DNA, 1501 bp, Oryza sativa
ggaaaggaccaccattcgtgcaagccagccactgaatcccagccagcgtcgttgtgaggaccagaatccgattcgattccgacctccagcagcgtccaccatgacaccaacaccccccttccctcaaagcggccagaaaaatacaacggcgagccaccggcatcagcttagccccagctgccggccaccaccaccatttccccttttgcagattcttctaccgttctctcttctccggcgagccggaagccgacgaccggtcgtcgcgcgccgccgccaagtggacagacggtgttcatgagtggcaaggtgattatggtgaattggaagtgcagagggggaatggtgtggtgttttgttgtggagtaactgaagctgtgttcagttttctctgcagttctactgcatgaccgtcaggatgagcatcgactgcaatgggtgctaccagaggatcaggagggcactcctccagatgcaaggtgaaaaaccggaaaatccaccagagattaccaccataaatattccttttggtctttgatgatttgataatgctcagtacagaacgatagcaggggaacaaaaaaatgggcatcaggaacagcatattaagcagcaaaaaacatctatcaagattctcttgttgattgtatttatttactaaaacaagcagaactgcttacctacacattcaacattggttacctgattggctacaattgatgtcctttcgcatcaacaattttccgtgcaaaaaatgtggatttcatctcacatttttaccccctgtgtatgtatgtatgtatgcaagaagatctggatagccacctgatcgaccggaagcagcagcgggtgagcgtctgcggcgccttcgtgccgcaggacgtcgccatcaagctccgcaagaagaccaaccgccgcgtcgagatactggagatcaaggagatcgacgccggcgacggccaccggctgtgaagtcgccggcgtcgcacgagatgggacggcggcggcggccgtaggaaaattctttgtaaataaatcctgtatattatagcgtatatcatttgttttaatcagagccgataaacttattcagctaacccttttaacacaaagcgagaatggtacgattgcgaatcatgaggaaagtagagaatggccagctgcatgcctgcatcagtatctaagctttgagatgaagcattcatcctcccaaagcatccaggtgaggaaggcaagctctgcaagcgtaggaacatggccaattctgcttggagtgcagcttcaggaagggcctaagtagccccaaccatatgcacagaggtggtccaaagatatgcactctcccataccctaacaacataacagaaactgaactagctctacagattcggtaccgacgatgatctcgtcgcaattgcgatcacatgactgacgatactgcgaaaatgacacaaaacaatagcagaaagcgattgcgaaatcgcctcgagaactatcatat

SEQ ID NO: 17945 - DNA, 1501 bp, Oryza sativa
ctttaatttttaatttcaaattacagttgcttctaaattttattcctatattgactttcaactcttcttcccatgtttttcttaatttcgaattttaattatttgtaaaatgtatttttatatggactctaaacactacttttcattttattatgtttatttcgaattttagttagttttaaattcctatatggactctatactttacttatgatattccttattttttaattccgaatttctatttttttcttaattgtatttctatatggactctatactctacttctaatattccttatttttaattccgaatttctattatttcctaattgtatttctatatggactctgtactctactctaatattccttatttttaatttcaaatttcagttatttcctaattgtatgtctatatggactctagtctcctcttctaatatttcttattttttaatttcgaatttcaactatttctaaattgtatttctatgtggactctagtctcatcttctaatactccttatttttaattccgaatttcagctatttctaaattgtatttctatataaactcatatttcaatattctttaatttttaacttcaaatttcaattacttctaaattgtactcctatattgactttaaactcttcttcccatatttttcttaatttcgaaatgtagttatttgtaaattgtatttttatacggactgtaaactctacttttaattttattatgtttattccgaattttagttagttttaaattcctacatggactctatattctacttataatattccttattttttaattctgaatttcaattttttttttcttaattgaattttatatggactttatactctacttctaatatttcttatttttaattccgaatttctattatttcctaattgtatttctatatggactctatactctacttctgatattccttatttttaatttcgaatttcagttattttctaattgtatttttatatggactctagtctcctcttctaatatttcttatttttaatttcgaattttagctatttctaaattgtatttctatatggagtctgctttttctttttctccgattaatgtgagaatttctaagtcatgagagtggacgtggaggctcctttttattccgaattttagttaattttaaattcctatatgggctctatactccacttcccatattccttattttttaattctgaatttctattttttttgcttaattgtatttctatatggactctatgctctacttctaatattccttatttataattctgaatttctattatttcctaattgtatttctatatggactttatactctacttctaatattccttatttttaattccaaattttagttatttcttaattgtatttctatatggactctagtcccctcttctaatattccttattttttaattccgaatttcaattaattctaaattg

SEQ ID NO: 17946 - DNA, 1501 bp, Oryza sativa
taataaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactacattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcacaaaccggggctaaagatcaccgggatctttagtcccggttggtattaccaaccgggactaaagttagcatctttagtcccggttggtgttatcaaccgggactaaagataccgggagggcctgacagaccctgacagcattcgaaccgggactaaagatcatctttagtcccggttggtaatacaaaccgggactaaagatcaaatatgcccgttacccttttgaaccgggactaaagaacatctttagccccggtttttattgcatccgggactactgtggaaatcggccgaccgacgaaagatggtttctccaccagtgaagacagccaactcatgagtccataagctttgcaaaaaagggcaggcagggccagctagttaattagccagcaagactaattagggtgacagagtatcatgaagatttgctttacttagctaattattccacatcttcatgaacctcgtcagtcatcacaccttcctttccaaaaacgaaactcagaaaaacaataaaggaaaccgcattagctagcaacctaattaaattagaagctaacctatagcttacgacaaacacagctgaattaatcaattaatttgcagcattatgatggggcatcctctcatgcacgcgtcggccatcgatacgatgaaggttttgatatgtttatcatggcacattaacaaatgaggacgaggtagacgaaagctaaaaaagggattaattgattgatcctggaagaccctgcctgcatcgtgcagcctccaaacgcgccctgtacttgtttaactatatattttttttattttatgtcctctcttggaatactttcttaaggaagaagttgtagtgcatcagggctagctacctagctagctaaccagccttgattagagaaatagagctacctgtaaagagcactctaaggagattagcacaagattagagatagatagagagcttggcttgaaagatagccgaggttgttgctgctgctaattgttatttctgcgtagatctgtaagagggaaaaggaggaggagatcgaaggggaaga

SEQ ID NO: 17947 - DNA, 1501 bp, Oryza sativa; identical to SEQ ID NO: 17699

SEQ ID NO: 17948 - DNA, 1501 bp, Oryza sativa
ctttttgttaggagtttttaatctttcaatgagagggggataacttctatttggggaaggagtgacgttggcagtctgactacaactaccacatggggtgttgcaccttatcaaccaatacaccaactccagttttttgttgttcttgctgtgccaagaacaatattaaacctgcaattaatcgaagaacaagtaagaacaagttgataagaaaacagttcacatcccctgccaatgatgaaaccgatacacacaaagttggggttttgaatgaagtatctgggtgatctagccagcaaacacaattacagtgaagtagctgaagctaaatctgtatctagacaaaacgcaggttgcaaaaagaggctactaggggtttttataagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgagaagctttttgccttgaaaatacaatcttgcaagcagaatttagaggttctaatttcgctgaacccgacaaagcgggggagaattggatgtaactttttctgtagatgtccgtggatatattatttgcttgattccaagtttgtatgaaaaaattacgcctgttttaagaaatgacacccaaatgtaaaaaaaaagaacacaaaccctaacttttttttttggtttataggatgtaaaaggtataaaaaaaaggctaaagagtgttcgaaacctgatctactttttttttttgggaggtgggggggggggagaggggactatataagggctcacacatgcttacccccgctcgaacataaaccaatgtgggtggtaggagcgaaacgtggctagccttgctgcgtatgtgtcgaaacatgatttcggcaataataaaagggggtggcgctcgagacctaaaagtggatggatgcggagacaaaggatttagacaggttcaggccctctcaatgagaggtaataccctactcctgtttggggatttgaatccgccgagtgtgtattgatctgacgatcaggttgtctcatatatatgccccctagagggcctcctgcccaccttatataggatggggggcaggattacaagatagaaaccttaaccaatacggtatcggtttcctaaatcaggactctaggccgttccgtaatatacaaggaaacgt

SEQ ID NO: 17949 - DNA, 1501 bp, Oryza sativa
gctctttacaggtagctctatttctctaatcaaggctggttagctagctaggtagctagccctgatgcactacaacttcttccttaagaaagtattccaagagaggacataaaataaaaaaaatatatagttaaacaagtacagggcgcgtttggaggctgcacgatgcaggcagggtcttccaggatcaatcaattaatcccttttttagctttcgtctacctcgtcctcatttgttaatgtgccatgataaacatatcaaaaccttcatcgtatcgatggccgacgcgtgcatgagaggatgccccatcataatgctgcaaattaattgattaattcagctgtgtttgtcgtaagctataggttagcttctaatttaattaggttgctagctaatgcggtttcctttattgtttttctgagtttcgtttttggaaaggaaggtgtgatgactgacgaggttcatgaagatgtggaataattagctaagtaaagcaaatcttcatgatactctgtcaccctaattagtcttgctggctaattaactagctggccctgcctgcccttttttgcaaagcttatggactcatgagttggctgtcttcactggtggagaaaccatctttcgtcggtcggccgatttccacagtagtcccggatgcaataaaaaccggggctaaagatgttctttagtcccggttcaaaagggtaacgggcatatttgatctttagtcccggtttgtattaccaaccgggactaaagatgatctttagtcccggttcgaatgctgtcagggtctgtcaggccctcccggtatctttagtcccggttgataacaccaaccgggactaaagatgctaactttagtcccggttggtaataccaaccgggactaaagatcccggtgatctttagccccggtttgtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 17950 - DNA, 1501 bp, Oryza sativa
acggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtccgagtaggactccttccatccgtggactccatttctgttacgtgacggatttccttaacgtgtacaggaaacatccatatacgcgcaggtataccgtatctagggatgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgccatccctaaccgtatcggtatacaacatacatccaagggtaaagggtataccttatccgtaaccctggcagtagcccccgacttctgcttaaatgaactcatgtgaccgatcgcgacttctgatgtcggaatcgttatcactctcaacaggtcgatctcggtatgagaaccgtagagacatagagttatcgataactttgcacgaagttcaacggtcatgagtgaatttaaattgaagtccgaaaactgctgcgcgtaacggatccagaaatttccagcggccttctctctcctttccttggaattcgcaccgtcggtagtgcatttatttaagggagttttggggatccattttgaagtccgtttgctgcaaaacttcccagcctccaagcgcccctcgtcttctccgctcccgcagaaaaaaaccctagctttctcatcttgtcttgttctccggcgatctccggcggtga

SEQ ID NO: 17951 - DNA, 1501 bp, Oryza sativa
ctgtcatagtgacaccaatttagttctaatgaaagttaaattggcttctatttattttatgattgcgtttcgcaatgtaattcaatcttgttttcccgcttgtcatccgtgggcatttaccttgatgctaatctcttatagatgtttcatgattttcttctttcagggtcgtggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaacggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaggtgcgcgggtgggtggggttctcggtgcagctggcgcaccggatcacggcgggcgccgacgtcctcctgatgccgtcgcggttcgagccgtgcgggctgaaccagctgtacgccatggcgtacggcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaggcattgtcctggtaaatggtggagacgagatggccgggtcgcgggagttatatttgtatatgttgccagct

SEQ ID NO: 17952 - DNA, 1501 bp, Oryza sativa
cttggtacggactgatcactgatcagacgctcatgaccagtgtggagtgcggacagctggcggcattttgggtcagacttaattagcagtgtgatgtaggagtagtaacactcaatcaaagcttaatttgtgctcctagctactaacagcatatattaattcgtaccagtaccgttttccataagttgtcctggataatactcccaccgtctatttttagtgtagctgtgggtttcattttccttatcaatttgatcgttcgtctaatttaaagatttatgaatttctttttttaaaaaaagtcatgcataaaatgctattcatattttatcatcttataataaaaaaatattaattataaaaaaaaatcaaataagacgttggatataaaaatccataagtcaaaatgggatgaagtatgtgtgataaaagtttgttcataccaatgatgtttccaaatcagagtaaacgactataccgatttcccgtgattgaggatggacttatgagctctcggacggctggtccatccccgtcccgtcgaccagatcacataatcgattacgaatgtgccgtggacaaaatttaaaattaaaaagtgttttggagtcaattttatgctttttttttcagcgcgtatttttcagtcttaaatttttaacgttgaaaccataagtaaataggtaaataacacatctaatataaaaagctttattcgcaaataatttttctttttttctacggctgataattcttgctcaaatcgattagagcctttataacctagagccaaccatgcattctactcctataaaaaaaaatatgccgcagcttacgagaaaataatcggaatgattttaagtcaacggcgtcgaaacatttcgaaacggagggagtacaatctagctagctctatataaagggcctgttcactttgacctgatttcttatatagttaccaaaatttggtagcaaactaaatatagccactttttttttggcaactttaccaaaatttggtaaggttgaaaatggcagcacagtgaacaggccctacatatctcacaaaagtttttaaataagaagaacggtcaaatatgtgctaaaaagtcaacggtgtcacacatttcgaaacggagggagtatatatatatatatatatatatatatatatatatatatataaaagtcaacggtgtcaaacatttcgaaacggagggagtatatatatatatatatatatatatatatatatatatatatatatatatatatatacatacataacacacacacagaatcctgttcaatatacaaataatttctatttcttgagcgaacccaccatttctatattggtcaatgatgtttctacaaaacattttattgtataatctgtaaaattaaaggtgtttttgattattattctgtgataacaaattgggcattggagattattggttttgttatttggaatttatttatgaagtggttttggaga

SEQ ID NO: 17953 - DNA, 1501 bp, Oryza sativa
ggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaggcattgtcctggtaaatggtggagacgagatggccgggtcgcgggagttatatttgtatatgttgccagctttctgagtttttcaagccagtgcggctcttcagtgcaggttccaagcaagttcagtgccggatgttaaccatgttctgaatcttgtcttttctttcatataagcagtgaagcacagggcttctactgacactaccatgtcatgctgctatttggaactgtgttaggggataggaacaccattaaacaacccgggattcgcgcgctcgtgttaatgtcaatgactaaatgactgtgttccaataattgccatcccaagatactgcacgtacaaggaagaaacacagccggagacatctcagtcagacggccattgcggctgctagctcagtagtaccaacagtagtactctatccgttttacgatataagactttttaatattatctatattcatatatagatatcaataaatctagatatataactaaatatatatatatgtttatggtaatgcttaggttgtgaaaaggagtaagtagttttttttttcgcctgagcctgaccacaattaagcggcctaccaaacacgttaacatctcgcatatattgctcctactatcacacaggctgtcatacgcatgtagtagatcctagcctgggtacctagctagtactggctcgcatggcaccaacacaagtcagccaaccgcgtgggatgcggatatggctaaaaacacaaattgaccacaggtcaacaaagcatccaaaggctcacatggcagccataaaccaaaggcaatacttacccagctataaccatatgcaattatctccgataaaacaatgttacgcagcagctagcagctttgcataaatatcagctaaattcagcgaagagaacgtgccaatcgtaaacagcgccgtcttaccctagatctggaatatgcccatgtccatgtacatccaaagcccgattcaaccagtaacagtgcgcccattgccgtcatggccattcatgtcttaaccaccactgcaccaccacttgctctgctgcctcctcaatcaagtgtctgaaactgcacaagggccaggaagcagcagcagcaatgcaaggtagtagtacatcaatattgcattttgttccttctgatcctaccagcactagtgttcttgacttcttgtctccgactccaagaggcacctcacccgtgcacgatcgccgattgcatgcaggtgatcttgcgt

SEQ ID NO: 17954 - DNA, 1501 bp, Oryza sativa
aaccaggagaacaaggccctcctcgccaagctcaacaccaaccacgccgccgcctcctcgacgtcgacgacgacccagcaccggccacccaccgccgcctccgcggccggcgccggcgcgtcgtccaccctcaagcccggcaagcagcagccaaagtgatgcattgcatgcatgctgcatgcattagtgcaaggagttcatgcttaattaattaatgattagtttctgtaattactctaagttagtagcagcaagttggtgaagtagcttaaccagatgacgcataggagtagagtatttagcttgcaccgtgttttggcttgattagcagcagtacaccttttgtttttagtacaacttggtacggactgatcactgatcagacgctcatgaccagtgtggagtgcggacagctggcggcattttgggtcagacttaattagcagtgtgatgtaggagtagtaacactcaatcaaagcttaatttgtgctcctagctactaacagcatatattaattcgtaccagtaccgttttccataagttgtcctggataatactcccaccgtctatttttagtgtagctgtgggtttcattttccttatcaatttgatcgttcgtctaatttaaagatttatgaatttctttttttaaaaaaagtcatgcataaaatgctattcatattttatcatcttataataaaaaaatattaattataaaaaaaaatcaaataagacgttggatataaaaatccataagtcaaaatgggatgaagtatgtgtgataaaagtttgttcataccaatgatgtttccaaatcagagtaaacgactataccgatttcccgtgattgaggatggacttatgagctctcggacggctggtccatccccgtcccgtcgaccagatcacataatcgattacgaatgtgccgtggacaaaatttaaaattaaaaagtgttttggagtcaattttatgctttttttttcagcgcgtatttttcagtcttaaatttttaacgttgaaaccataagtaaataggtaaataacacatctaatataaaaagctttattcgcaaataatttttctttttttctacggctgataattcttgctcaaatcgattagagcctttataacctagagccaaccatgcattctactcctataaaaaaaaatatgccgcagcttacgagaaaataatcggaatgattttaagtcaacggcgtcgaaacatttcgaaacggagggagtacaatctagctagctctatataaagggcctgttcactttgacctgatttcttatatagttaccaaaatttggtagcaaactaaatatagccactttttttttggcaactttaccaaaatttggtaaggttgaaaatggcagcacagtgaacaggccctacatatctcacaaaagtttttaaataagaagaacggtcaaatatgtgctaaaaagtcaacggtgtcacacatttcgaaacggagggagt

SEQ ID NO: 17955 - DNA, 1501 bp, Oryza sativa
tcttacctcgccgcccgcctcacctagctagcccggaccagctacgtacgatcgagtactgtactagcgctatactagcaacatccaacatactcctactagctatagtggccacagtactggtcttcacagtctcgtgtatatatggccgccttaagtgtttcgttagtgttttttttttatttttcgaataaagcgtatggccggtttttaaactcaggactgcaatcttattaacatagatgtgggttttagaatttgttaaattgtatcattccggtcctaaggccctatttagatcccaccctaaaatttttcaccctattacatcgaacgcttaaatacctatatgaagtattaaatataggctaaaaaataactaatagcacaaattgcaactaatttgcgagacgaatcttttaagcctagctgttccatgatttgacaatatggtgctacattaaacgtttgctaatgacggattaattaggcttaataaattcgtctcgcagtttactgacagattctgtaattttgttttgttattagactatgtctaatacttcaaacgtgtgtccatatatccgatgtgacatgacaaaaaaattttacccttaaacctcgacccaactcacttgaggggtaggaattgggactgccgccggccccgtaggggcgggtaaccactgggtccccatcctcatcgaggaaattgccacacctatcgtcatacctcccaccattaccggcctcaatgccgacaccaccaagaattcccctcgcaccactacaacagccgtggcaagatcttctagtgcccgaggcagcaagcggtgctctggaggtggcggttgtggaggacgtcctagccatgctcaggttgctccttgagaagggggaggattttgcagcggtggagtggtaggagtagctagcgcttgctcatggaggtcgtcctagccgtgctcggggattttgcttcccttctcaccaacgtgctggctctggaagctgctgcagcagccacatattggcccatcagtgcgactgtcgaaccctccctcttcggtgccgtcaaagcctccatacattgcaaatacaggtctcaagcacatgtctagctaattcccacattataaattaacctttattatacattgtaactgagaaaatcttttcaatgtagcaaaagttctacacattgcaaacacaggtctcaagcactaacatagcaaaagtagtgctcttcccttaagaccaggtacgtactttaaataaaaaaataatattttattataagtatggcatgagtccatcttgatactcataggtatgtgtcccattatagagttgatgtgttctatacattacacatatctctctattgctttatgcatagtagatggatcttatcttattaccgtattacataggaataactaactatttgccactcttataaatggtgataacagatttgtcaccggtttaatatatcata

SEQ ID NO: 17956 - DNA, 876 bp, Oryza sativa
ccgtggtgcttcatgcctatcactgcccacgaagaccaagccaagaagaggaggacataagggcatgtacaaccaaagccacccctagagtgtcctcactaactgagggcactctcaagggcactcatcttgtgaccaaagccacacttagatggactcttcaaaatttgaagaaactggctaaaggtactctaatccacagtgcgtatcctagcccaaagaagcctcatgtgaaaagtttccaaaatacccccacattctcgaggggaacgggcacgcgagagagagaggggagaggggtggaaggggaatatggtagctggagagatcgtcgcctgtggcgcccgtccccgcattgtgtccctcgcgcatgtcccctggccgaaaaggagatagagccgcgtcccccaaccagggcgcgcgacgactcgtgaggggacgacgcgggcggaaaaactcatggcgatggacggcgtgctctggggtgacaagttagaggtacgcactacacatgctataacggcggcgtcagttaatagtatttgggtgaatagtgtagtggaagccttgctttgaaattccaattggacacgtgtcgcataggagacaaagtctttcctaggagcaaaggaccgcagtcctatgaaattttcttccgccgccctctcgtctccccctcgcaccgccgccgccgcctcccccttgcgccgtcgccgtcgccgtcgccgagggtgggcttcaaggtggacgcggagaaagcgaggaggcgagctctcctctcttcccctctcgccggctcgcgaatcagtgctgcgcggagagatgagatctgacaggaggaagccgtaggcgttagctgctactctgcgttggcga

SEQ ID NO: 17957 - DNA, 1501 bp, Oryza sativa
tattctacaactacagtttctcagaatctggatcaaaagctgaattgtttggaggagcttctaatcctaggagaagctacagcagctagaagcttcccctaaacatacccaaagagtagttttcacgcggtatatttgttttatgagcgctcgtagtaggatattattagagttatggcctatattaactataccaagtagtgaaaattcctacaatgtataaatatccctaggaattattatggggcccaccgatatagataaaatatattaactatataaacacaacactatgatcggtggagcccacctgttagattctatcttctatctgataggtgggctccatatttttttaataaaaagcactgattggactgccacgtaggatctgaaccactatgaatcgagtcagggggttatttgtccgatttaaatagttgagaatgtaaaatatatagtatttgagagggggggtaattcagtcgaccgagatagtatgacagtactatctttttagggtctactcaaactactcgcatagagaaagataccataatatgataatttttttattgcaaatgctcttaatattgcaggctgatccaacaaagtgaaatatgcggcacaattaaaaaccttgttagatctataggctgatcaagtttttacataccatatcctatcttactatacatttgatgtccactgactcctaaaacttaacatgcaagtgtgtcatatcaacatgcaattcagattctgggtagatttggttaagaaaattaatcaattaaagtaagtttatctaaaagaaaccgagttcaaggagaatgcggtatgggggtttatttattaattagtaaatgtctattagtttcctttaattgttaggaaaatgtgtttagtgtccgataaggcttttatgtttttctttttatctttaagaaaatttgtgtcatgtcccataaggactcttatctacccatgggtataaatatgtacacccagggttgctggatttatctcacatatcaatacaactactcttggcgcatcgctaccctcttttttgaggttttctttaccaaccggcagaatttggcaccttgcacacggggctgcattggctttcgatcttcggcgaaggggtaagtcctacgtccgtcagctttagtaattgtatcggctacattggcgttgttcaagactacatcgcttcgacctcttgtatcgctatggtttggttgatatatttgcctacctgtttatcatatatcttagttaatccaagtcgattattcaatttacttgtatccgtcagatcttttctagggttttgccagtatcagctaaattattttgttgatctagattagctaaggtatccaccaccttgaaaatcaatcaaaggcttgattgtcaagatattatatttctttttatacttagtgttgtatcaattgggtttgacctactaagtcgtgcttagaaccatagt

SEQ ID NO: 17958 - DNA, 1501 bp, Oryza sativa
aatgaaattgaacttccagtacctcaaattcagacattgcttcgtggccctatagatcaactatatggtcaaatttaaacattctacaaggaaatcaaactcaagtgcaaaactagtgaagtgccactcatcttacctttgcagcacgtcctctcctcttcctgtgtcttggttgcctatgagcagtccgtctgcccaaggacaagggcacgcctccaccaggagaaggggtgcgcctccaccccttcgaacacgccgtcgtcctgtactgatctccgccccagcccccaagccaaaaccctaacctacctatatagttgccatgacgaacagagaagacgaggatgagagggaggcaacggggagcctgaaacgccatcagccatccaacatgtaaagaattgagcgaggggcaggacggacatttcgcatgtctagctggccacgtggcgtgctatcaaggggaactgacgagattgagttcgaaatcaattgttgaaggacgaaattggacaatttgatagttcagggaccaaactgagcctcgggcgatagtttagggacgaaaatggctattttgccatacaaatcaatgtcgcatttggtgttcgactgttcgtttctacaaagaatgaagttatggcatagaaagaggaaagaaataaccattaaagcataaaattaattaaattttaattattataaaacccaaaaaaattatctgatatttcatagcagtttttatatagaaagtttttacacaaaatgcacccttcaacattttaaaaagtgagttaacgaaaacctaagaaaaacgtattattatcttagagatgaatcatcgcccaaaggggctgttttcttaaccaggtaaatttcccccctcaatcctcatcactgtctaattaacctcattatcatttcatttcacaacttcttttgggaggacggtattctattcagacggatgagctatatcgactgtctcagaggtatcatcccgttcgaatagagtatcagccgatatctaccaggttatcaggtatcagataatacatgtgaggtatcattccgtccgaacggaataccattaagtagcattttctttttttttcctccttgggttttctcccaatctccctgcagacgcatgtccattattagtccatcgttatcaacaacctgaacctgctactgcaatgctttgtggcgagaggaagaaggaaattaaaaaaaaaatctgagggggggatcaggatcagtggcctaggagtccggaccccgaacaggtggctccggcgacgccaacccaacaacccaactgggccacaaatactcccccctactctcctcgccgcacgcacgcccacccgctgcatccacacggcccaccgagccacaccaccgccgccgcggccgcgaggccaccacactccgacgacggcgagagagagagagagagagagagagagagagagagagagagagggagaggcagcca

SEQ ID NO: 17959 - DNA, 541 bp, Oryza sativa
ctgccatgttgtttcagaaatgcatgaataatgattgctctgttgtttataaactgcacgaaaagtgtagcattatatgcagttagaacaatgttgagtgtttctaaaaacatggtttaatcctcatctaagaacctagcaaagggttcggaattggcaaaatcctgacatgtaaacaaaatacagaggacacaaaattaccagtgatttcaccaattattaaattccttatgttaaacacccaatcttttttataagttaatatgcatgttgaaatcactaaaatgtagatccaaaccacaaatttactatagtgttgacaggcaacaccacatcaccataataaagcttcaattagcaatcaacagatcaagaaagcctgagaaaagagtcaatatgtatcaaagatatagtaggagcagtacagtaccttgtcttggcacatatggagagttagatccccatgccaatggtgtgtgtaaactacgggaaatggaatagatggcatagcatactatgcatcagatgacattcaccataa

SEQ ID NO: 17960 - DNA, 291 bp, Oryza sativa
tgctcagtaagataatattaatttcatcatacatctatgtaggtttgtagaaaatgataaaagcagcaagcatatattgttagggagtaacatacttgccataaaagaaacagctcaatttagtgggaatgctcttcccaagcgaaatgaattatgttagataggtgacatttattacttgtgctgatgatacttatctaagtttttttattcacatgctgccatcaacccatccttgtttgaagccatgggacactaacaaactttgctcttgtttccacagcaaaaatt

SEQ ID NO: 17961 - DNA, 176 bp, Oryza sativa
aaatggttacgaactatgtaagagcattgtaggaaagagtggttaaaatttacaagggctcgtaagccgtcgagacactgcgcaactcggaaaaaggaaaaatgagaaaacattccaggcacgcatgctgttggtgcgatcgcaggctaggaccaaggaggcgagaacacacaggg

SEQ ID NO: 17962 - DNA, 179 bp, Oryza sativa
ttgttgcttatataatagtctagatactcgaagcgtctgtgttctttttctagatactcgaactggttgatctatgaaactgcttcaagttagtggcaaaaataagttcgatctttccgctattctgagagcatctttttatcttttcagaaatcagaatggcattataacttttaaga

SEQ ID NO: 17963 - DNA, 1437 bp, Oryza sativa
  unsure (1)..(1437): unsure at all n locations
accattagacatagacatcaactaagcaggacaatgatagcaagaaaaagaagttatagaaaaatcanatttgatcagcttggatttttnttcgttttttccattctacctagataatgcaggtgtagggctggaaaacatggtttttcaacagtgaaatcatgatctgggcaatggggaaagcaagccttacaaatcctaaaaagcagagtagcagagggttacgtaacctgtatgtatattcaaaggttaaaaaatattcagaaatataattgttgttgacaaacacaggttagcattaacggtacctattcttgattaaattctcaaagttacccaaagttgttgtattcatgaaattgggatttgtagtatgtaatgtatgagtttcttcattgctactttggggttaccggcatgcaacatactattatgccctgaaaatttcaggttttcagttagccctatagttgtcatgctcaacatagttttatccagttaagactgagttattaccattggctgaattcgtcaagaaatatatggatagctatacttatcgggctttctcatagcatgtgcagtaaaccagaatatgaaaaacctccttcaaagacaaaatccctgtggtgctgaactatttataacagcaacattatgagaaaaaaacagtgatcgacaaatcgacacatacatttcttaagggttgaacacaaatgaggtgttacatttcctaattgctgacatatatacttgatcctaacatgtttgacaattcttaagggttgaacacaaattcagttactacaacagaaattcagaactcatgtgaatcctcctgaacttggatgcattttgatttttgaaatgtattatcaaatttcataatagcattagcatggggagagaactcatgtgagtactcctgaacttgaggtaaaaggaaatgcaggagtcatatattacaaattaatgtcctctcttgaggtgctaaactgtcagatatttttccagaacacagcaatatataaatttgaattcctcagattacctcatagcagcctagcatgtagccttagatttaataaatctccaattgcttcagctggaaccacaagttgaaactacaatgcagaaaacaaacaagtcataatagttgcttgaagtgcttgaagatcatactatttattcacaaggaacatgatgttctgaaattaatgtgaatatcaactttcctaagctgttctcagagttaatctcagaatcttatttttaactctcattagtgaagtgattaacaggaatgtgaagtgattaacatgaagaaaatttgattcagaaataaatcaagaaacggttgctgattgaaaaacataagaggaaatttgattcagaaataaatcaaatggttgttgattgaaaaacaaaagaggaaga

SEQ ID NO: 17964 - DNA, 350 bp, Oryza sativa
ttttttgaggggtggggatggggggcttcatctgcgcaccacttcaaaaaaatttattgcgtcctgtaaattgccagaatcaatatgattccaactgttgtttagagtgaaaactggtcttcatctttgcattagtgcatgttgtcatattcaaaagtttcaaactcataactctgtataatatgtttttgtatgttcacattcttgcaaatgagaattgaagaacttagttgtactgtccaggtgaataatggcaggatttaggcaaagtatctaaacaatctgtgacataacacatgccaggggttgtaggccatgtctttgatcgtcataatattcatttctttagt

SEQ ID NO: 17965 - DNA, 181 bp, Oryza sativa
tccctccctccccatctctccctccctccccatctctctctctctcccccgctctgcccgtgtgccgcgcgcgcgtgcgtgtgggccgcgccgaaccgagcgccctccgccctcgctgccgcttcccgccaacgccgccaaatcgtcgccgcacgccgttccttcccgcgcgcgcgcgcca

SEQ ID NO: 17966 - DNA, 264 bp, Oryza sativa
gactgaatgcgacacatcctagggcctgttcactttgatgcccaaaagttgccaaaattttggcatatatagttatcaaaatttggcagcaaactaaatatagtcacttttttggcaactttaccaaaatttggtaagattgaaaatggcatcaaagtgaacaggcccctagtataataaatttgggacggaaggagtaagctagataaaaatgaagtcatttatttattgttgcatatttaatcataaatagagatatcacca

SEQ ID NO: 17967 - DNA, 1501 bp, Oryza sativa
ccgcgcgcatacgcatgcatgtaggccgcccatgctgcattgttcacgtgccacgttgcttgcctcccctgtatgtgttgcttgcgctgctgcttgcatacgctccctccctctcccttctattattacatgtgcctaattttttcctcaaattttaaatatttttttctccaaaattatatattctgatctaaatttcaatgataccattagattcatcatcattaaatctttataacaagatctcacatggttatattttgataaaaatatacatgtgtctcaaaaaataacttgtctcaccattgatagaaaactgtttcatcacatgtacacaaatattacaactcacctcgtgaattgtttcaaatttagagaaatacaacaatttactaactgaaacaatcacaaccactacacaaaacgttaaataccaatgagtgaaacataaaaaaaatcatatgaaaaataaaatatttttgcacaaatacttaattatgttgaaatatttttaaatcggacgctacaaatcgtacgttcaatattttttcaaatatcggagcctaccaatcgtacgttcaatatttttttaaagacgctgctcctcgtttgtatgcagggacacgttgaaggagcgaggttgtcgcatgcatgcatgcatgcaggagtagacctggttgccaagatgacgtgaggcatcattactctgtctctcttaatcaaactttaaacataattttattctaaaatatatatccaatctataatttataacaagatctcacatgaatatattttgataaaaatatatgtgttctagaaaaaaaacaaacttatgttgaactatttaaaaataattctttcatcacttgtggagatgtttcaacccacttcacaaactacaggcatagcactaagctcggcagcccatttttgcaagctgataagtgataaacacaaggacgcaagctccaagtgatactttcacacattggaaaaaggtccaattagcagtacggagtactgaacatagaacaagtctagctgatgctgtttatgtcgatggagcaagcgacagttggtaccaaccaaacaccatgcaccggccggtgagcgcggggcacgcatcatgccatgtattactcacgtcacaatcacctaaccccacacgcgctagtttcatgggtgcctcggccctgtcccttcctgtatactatctccgtcctataaaatacaaatttaaaaccgtatatattatattctaatatgatatatatatatatatatatatatatatatatatcagattcgtaatactagaatattacactttggcacacagccacacaagcttgcaacaccaacacgccaacacgaacacgtcgtatatcctgcttcatcaagaacagcgagtctgcatccttcaccttcgcttgaactaattaagcgtcaccaatggaaggaaaagccgcagtgacgacgtcgaccgagcacggcgacg

SEQ ID NO: 17968 - DNA, 1501 bp, Oryza sativa
gtcatcactaacctcgcggcacagaaggattaattcgtagcactaatacagaattgattattactgcaatataacagaaaaataaatcagtaacaattctaaataatttaacactgccagattaatttaccattcatcagcaagcatcgatattgaaaaccaacctttcatggcctgcagatcaaacacataacccctgaacaatctcgttgccatcaatattcggctcaaacgccaaagagtaagggtgcgatcctgatcataaacctcatccagttagctggataggagatcaagatggaaattaagtcgactaattgcaatatcgcgtggttatcttatagatatcgtgatgatctcgtggtaactttctcatttttaaaacctcatggttttccacgataactaagtaccgtagtaattatcatgatatcgctgagtagcagtagccatcataaaaagggtaaggaagacgatggctgatgcaatcgatctggtgagctttgaactgaattaatcaaaattactagtagttaattactctatttgtttcatattataagccgttttgaaattttttttaatttaagtttgattaagtttataaaaaatatagtgacataacataaaataaatatattatcaaaatatattcaatgttagacttaataaaaccaatttggtgttttagatgttgccaaattctttttacaaatttaattaaactttgaaaaatttaactaggaaaacaatcaaaacgaaatgaaacggagtaagcgctatcctgagactttctgatcaggcagctgcaggcaacaaagcgtgttgattcagcaattaactgcgatactatcattattatcaactttacttttaattagacattgtcataacacacatgcatggatcattgaaaaattaataggccatttggaacaaatatacgaaagagacccacttataattaattaagttttataaaaaagtaatttaaaaagttcggaacccttcccacccagtaaaaaaacgaagcagtggattaacttattaattaaatattaattaatacgattttttaaagcaactcgaccatataattttttataaaaaaatacagtttagcacttgtgaaacgagagaaagatgaaaaagatcggcatgcatgacaggcatgcactaaaataatctaactaattactcggccaaccggttgctgggaacataacttgaatccatccactaatccatcaaattaaaatattaaagagtttcttgcccagaagcaatctaccaagacgaggacttcagaggagagatgaaccagtcgctatagatcgatcttctagttgaccacttcagaaacatctaacgctcagaggctataaatatggctgcatcctttccatatggccaaagcatcagatatagctccatacacaaaacaacaatcgactacttctacaggatctgtagatcaagagcaaaagttccatcaacttaa

SEQ ID NO: 17969 - DNA, 1501 bp, Oryza sativa
tctgatgcagcgacctctcaacttccatctgctgtctcctcgctctcaaggaatagggctattttttattgaagccaaaaaaatgtgaacttatcaatttattggcatcttgaatagtgatagtgtatgtttggatgaagccaaataattgataatgctcattaacaatttggcactaattggtagcaattcaaatatgtaccatgtatctctaccctaccaaagaattggtagtgccaatatagtgaaaatttggcgctaccaaagattataaggtaaaggaccaaacaaccccatagtaactttaagttggcaatggtggtttatcttaaagagtactacatccgtcacaaaataagtgcagttgtgggaatccgtgttgaacgtttgaccatctatcctatttgaaaaatttatgaaaatattaaaaaaatagtcacacataaagtattatttatgttttatcatgcactaacaataaaaatactaatcatagaaaaattttaaataagatgagcggtcaaacgttagacgcgaacagtgcaaaactgcatttgactgcgttcgtttggagaacaaagggagtttgtttgtttcgttttctacgtgcacgcttcccaaactattaaacgatgtgttttttgaaaaaaaaaattatatatgaaagtttgcttttaaaaaaaacatattaatccatttttgaagtttaaaatagttaatactcaattaatcatgcgctaatggctcacctcgttttgcgtatctttccaatcttctcaatcccctctccctcaaacacagccttattttgggacagagcgagtattgactttgcacacataggaggagggcataataacttatcttcagatcgaggctgcatttggcacatacttttatatatattataataataataagtagtggttaaaattgtttttagacatgtctttataaaaacgataagataatcaacctagagaaaatatttgtttttttatataaacttcccagcaacgcatgtggtgtgatccagtttctctttaatcaaatttccatcaaaatttcaaaccaaacatagtacaaatagccctcagacatcataggggcagatctgggagagagtggctttcgctgcaaaaataataagaaaagaaaagaaaaaaaaaacaaaaacgaaaaggcccctcggcctcgccatcgccagccgccgccgacgagctccatccggcgagcagcggtggctgccgccggtaagcacccgcccctacccacgtccccccccttcccccctgcctcttcttctctcatctccctcgttctacccgcacctcatcttctttctcttctagatctagaagctgctttttctctctgtcataaccttggtagtaatgcttgctgttctttgtttttctcccaaaaaattttgttaggtccgcccgcccgtgccaagtgttgggtgttgatttgttcaagtctggaggaaattcgagcgaaa

SEQ ID NO: 17970 - DNA, 1501 bp, Oryza sativa
ggggaggtagaaggccgcggtggggggcgcggcggcgatgaggaggaggaggagcgcgagcgccgccgcggcggcgggccatcggagcatcgccggcgggcgcatctggtgcggggattcccccggatctggggcgagcgagcgagcgagcaactggtacctcagcctcgtgtccttttcctttgcttgtgtttttttggggctactgctactcacgttcaccggtcgactgggggcaaattggtcctataccattttcaggcccttttttattttccaatttttttaaaaaaaattttagaaacgttgttcaaacgcaagaggcacgtaacatacgcatccaaataggatctagaactagattatgcctgtgttcggtacccctcttcctcttttttttacgcgcacgcttttcaaactgctaaacggtgtgtttttttgcaaaaaaatttatatgcgaaagttgcttaaaaaatcaaattaatccattttgaaaaaaagtttagttaataattaactaagcacgtgctaatgaaccgctctattttccgtacacactattcatgttgggaaccaggcgtgccgaacatagcctattatagggagactcatctcattcttcctccttcggcccccacacccaacccccacaatttctcatatccctttttttctcccttttatgtcttcttctatcaatggttatccagtggggtagagggactcgagcgactcagcacccacgttggatcaaatgtaaaagtaagataatgtggctttatgaaaaaacacaagaaggaagataatttagaccatacatctaagaactacaaagaattaagatgatatggctttatgggagaagaaaagaagagagataatttgaaccatagattaatcatctgaggactaaaaacaatttatatgatatgacttaatgagagaaaagaaaaataacatggaattagtgaggatgaaatatatagatttatatgatattataaaaagatgatggagatatatattgaaatattatgtgaaatatgtgggatgatttaacatgcttacattttaaatctctaaaatttaataaactattaaattatagataatataatatgcttgcatgatgtttaaatgtaataattgttaatgggtaatgatatagcatctgtaacgccccgcttttcgcgagacgttaaaaactaaatcaataaaatcctaattgcgaaaatttcgttctttgagtgagagtctaagtcgtgccatggatcttagtttaaattccttgttccctcctgtcaaaatcaaaaatcgcctcctcgaaattccccttccgattcaacttcctatatcaattccgaaattcaaatctttcctttgaatccatgccaaatacttttccccgtttccaagaaaatatcaaatccttaccttgaatccctccctgtctattgatagatctatctacttatctaacctatcaatccatctatctatc

SEQ ID NO: 17971 - DNA, 1501 bp, Oryza sativa
ccctctctaagtgggcaaggtcctccttttatatcttaaggggataccacatgcaccatctccccctctctttcttccaatttgacttctcttcattaacagacggagatttgcatcgtcgccgtccgaatgaccttctgacgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggcccaaccccttggggagacaaagagaagggcggccgtatcaccctcgggcccgacccccccccgagggagttaggccacgtgggtgatcgtgtctgcctcaagtctctaagtcatgatactcccggtaaagaggagggcgaacacatcaccctcgggcccgacgccccctgacggtgccaggccacatgggcgattgtgtctgcctcaagcctctagtcatgatactcccggtcccatgtcaccgacagtagcccccggcgttatgccagggcgatcgccctctttaagggaagcggtcgggcgtgacgccactcctaaggcctggtgacaggtgggaccggtctccacgattgggcagaaacccaacggtcacaaatcacgcacatcggcagtggtaactcggctgtcaataatgagcggtctcttcaagactgccacattactcgagtagcacacgaatctggacatggcgattcgtttcgtttggagatatggtaacgtcgcttcggtcggcgagcgtaattaacgcgcgcacgatatgatctatctcgactgccacaaccgcatgtccacctcatgctccgcaagcgggcgaatgggattagtggaagcgtgggcgcgagaaacgagggggcgaaatagtgggcgcgagaagcgaggagccgggcacagcgttggtaagagtataaaggcactgaggaagggatctgtttccttcctttcgccattattccccttgtcttcgtcgcttgcgccctaactccttctttcctgtgccctaccttcaccacacgcgctcgctcttaatcttctcttcctccggggcca

SEQ ID NO: 17972 - DNA, 1501 bp, Oryza sativa
attgctaaaaaaactaatcacaatttcattttggtaaatgctttcaaatataactatggtatagttgtagtaactataatataattacactatacttacattgtaactacattgtaattacaatatacctacattctaatctctatataacttagctgtaaagttgcatatttttttaatctttacaagttacattgtagttatagtataattattgtagaattatagtacaactatactgcagttatatttgagagtttttcactttaaaaaattgtggtacctttttttagataatcccttttttatgcaaaacacactcctgaagatagaggaaggataatataacaagcgctaaaaagataaatatttctatatattggaagctagtatttgttttaactcctctcctagctatccatatgcagctggccaggggaatgaagagccgccggccgatgtaattgatgatgtaattgatctggtgagctttgaactgaattaaccaaactaccaatagttattagcttgaaactgtctcggcagctgcaggcaacagagagcgtgttgatatattcagcaattaactgcaatactgacattatcaacttcccttttaattagcatgggtgctagctcttgactaattaatcagacattcagacgttatattgccataacacacatggatgcctgaatatgcggagacgaaagggaccaagtatactttacatggatagagaagacatggtcaatctactcgttaacgtacattcacggttatttttgttacaacttgaatgtcatattaaacttgtattgtatatttgtaaagagatatattttaatttaatttaattatcttatcatttttttaaatcttcttgagagataaaaatccatctccctatctttatcataatatgagcctgttcactttgatgccattttctgataaagttgctaaaattttaactacgtttagtttgttgctaaatttttagtaagcacatataaaatcttgccaaaatttagcaaccttgttaaaattttagcaaacataccaaaatttagcaatgctaaaacttggtaaggttgaaaatggtagtaaagtgctctgtgtttctattcacctgataacaaagacagccaagacatcatcaatctaatgcatgcatcatgcatgacaggcactggaataatctaattaattaattagtcggccaacctagctgttgactgggaattaagatagcttgaatccatcaaattaaatagtttctttcccagatgcaatcattaagagttcaagaccagttcagacttctgaggagatgaacaagtcactagctagctcatccttttcttattgaccacttcagaatcatttcatgctcagaggcctatatatatggatgcttccatggacaaaagcatagactacagctatacaagaagcatcgaccactacttgtacacaagcaaaagttccatcaactta

SEQ ID NO: 17973 - DNA, 1501 bp, Oryza sativa
gcagatcttcccgggtcgaaggagtcgacgaaggagtggtggccgaatggcgaacagcggctgccgctcgccgcgcccttcgtcttgacgacgcggagccggtggtagcagcaccagaggccttggtggcggaggaccgcccaccagcatctagacactgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccatagacgaggaggcgacgctccccatctcgccgccctttttcacctccagtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcaagagctcagaagatcactcgcagagtcccctacctggcgcgccagatgacggagcgtggggctcctcaccgggagaccgcactggcccccctttgccggttcggccggggaccctgggtgagactctaagctcccaatctgtggaaggttcgcgagacaggaagcacacaagacgtcggcgatgtatacaggttcgggccgctgagaagcgtaataccctactcctgtgttttggtggattcgtgtatgaaggaactacaaagtatgagccagcctctccctcgttctgggttcccaatctggaaaaatccaaaatcccctctctaagtgggcaaggtcctccttttatatcttaaggggataccacatgcaccatctccccctctctttcttccaatttgacttctcttcattaacagacggagatttgcatcgtcgccatccgaatgaccttctgatgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaagg

SEQ ID NO: 17974 - DNA, 630 bp, Oryza sativa
tttttccctctgcccatatttattaagttagtcgttagaagcttttttcttttaaagtttacttctgggctttcctactctgtatcatatctattttgggataaatgcttgcttatgttcgggttaatgatatttccagtttccagataaacttttttgtggtaaacattgtgtagttatagctttgtgtgagagaagataaggtactattcaagaatgcagggatcccttttctgtttgataggtttatattttacttccagactgtgtcatcagcttctcctttagatagctgatgcttatcaatattcagctctgtcagtgctgattagctgataagacattcatgaattatatagcagtttgctgtctgcacctctttttggtagccaatgattgttatggtccttggttccatgcattatggaggttaccatgcttagtccctttccttgtccccttgagaagtggaagccatgtttcctttacataggcacttatgcaatggaagaattacattggttgttagtattgtgttacacttttagggcccctttgaattgtaggaatgaaaaaacagaggaatagaaaaaacacatgattctgacaggaatacaattgtaaaacaga

SEQ ID NO: 17975 - DNA, 1501 bp, Oryza sativa
ttacctcaatatcgtatatatcctagtaccaacaatccccatactatgcaaataccgtagtcgtgacatcaaacgtcgatagatagatagatggattgataggttagataagtagatagatctatcaatagacagggagggattcaaggtaaggatttgatattttcttggaaacggggaaaagtatttggcatggattcaaaggaaagatttgaatttcggaattgatataggaagttgaatcggaaggggaatttcgaggaggcgatttttgattttgacaggagggaacaaggaatttaaactaagatccatggcacgacttagactctcactcaaagaacgaaattttcgcaattaggattttattgatttagtttttaacgtctcgcgaaaagcggggcgttacagatgctatatcattacccattaacaattattacatttaaacatcatgcaagcatattatattatctataatttaatagtttattaaattttagagatttaaaatgtaagcatgttaaatcatcccacatatttcacataatatttcaatatatatctccatcatctttttataatatcatataaatctatatatttcatcctcactaattccatgttatttttcttttctctcattaagtcatatcatataaattgtttttagtcctcagatgattaatctatggttcaaattatctctcttcttttcttctcccataaagccatatcatcttaattctttgtagttcttagatgtatggtctaaattatcttccttcttgtgttttttcataaagccacattatcttacttttacatttgatccaacgtgggtgctgagtcgctcgagtccctctaccccactggataaccattgatagaagaagacataaaagggagaaaaaaagggatatgagaaattgtgggggttgggtgtgggggccgaaggaggaagaatgagatgagtctccctataataggctatgttcggcacgcctggttcccaacatgaatagtgtgtacggaaaatagagcggttcattagcacgtgcttagttaattattaactaaactttttttcaaaatggattaatttgattttttaagcaactttcgcatataaatttttttgcaaaaaaacacaccgtttagcagtttgaaaagcgtgcgcgtaaaaaaaagaggaagaggggtaccgaacacaggcataatctagttctagatcctatttggatgcgtatgttacgtgcctcttgcgtttgaacaacgtttctaaaattttttttaaaaaaattggaaaataaaaaagggcctgaaaatggtataggaccaatttgcccccagtcgaccggtgaacgtgagtagcagtagccccaaaaaaacacaagcaaaggaaaaggacacgaggctgaggtaccagttgctcgctcgctcgctcgccccagatccgggggaatccccgcaccagatgcgcccgccggcgatgctccga

SEQ ID NO: 17976 - DNA, 1118 bp, Oryza sativa
  unsure (1)..(1118): unsure at all n locations
cttttatataaacatcaagatgcaaagttttgccaaaagcttatcttttacccattgggatttattagctactttaatttatacccagagcaatcatttggctagtgcgctggttgattattgtatgcccatttaatgagaaaagtgaaattcacctaaaaagctaaccaatatttatatggatcgtactgaaactttttgaagtcatttggagatttgattgatatgtagcgaactttcatcgtccaattctttttttttggggggtggggggggggggggggcntactgcaatcaaaagagtgtatagtgtactagtactagacagacaaaaaaatttttttggacaagatgaaatatgcgttaacaggatgtgctaatataagggtgcttagagagaaaaaaaagagtgtgtagtagacaaaccaaatgaaatatatatgtcgtacataattaaacacatctcttctccagtgcaagcgtcttctcagacaaatataatgtggtgagatttcaacataagctcctactaatcatcgatgcttcatcaaagcatcggtggctcatgacaaggaatttagcaccttcctatcctacaagagaaaacggtaccccctccgtttcataatgtaaatcattctagcatttcccacatttatattaatgttaatgtaaatgggaagtatttggcatgcttcacataagcatgcatctatatgggggcacttgcattggagataacctcggaacgccatgcatccaacaccgtctcaagacttggagatatctactccctccgtctttttaatagattatgtcattgattttcagtcttttcaataaataacaacgataacttttagatatatttttatcattcgtcttatttataaagttatgcatatataaaaaaatctaaattatacttaaaatatcgttaatgataaaacaagtgagataaataataattacataaatttttaataagattatgttgaaaaataaaagttgtagtctatataaaaaaaaagagaggcagtattgattattgggaatatctgcctatgtagtaccggctgcgtattgagttacattgttacatatgtaatgtttatagg

SEQ ID NO: 17977 - DNA, 412 bp, Oryza sativa
gcaccttatatttcctgttcttccggggcactttctggatatgtttttatcaggtaggttgaccaatggcactcttgttcaagtgtaacggaaggttaagagctttggaaaatctggggcagacaaataatgattgtgatttttctgcaagattacaatttgaaacatagttgtctgaagaagaaaaaacttagaacacattgctgttgtactaacttatgacaattggtgatggtttcctggaaacccaagacataaaaccatcatcggaatttatttgacagatggactgtatcgtgcactttctgtgcattttgttttggttagagtgggcttttgtggagtagtctcttttcattagtgttgcatggttttatcctaaaactgaatgcatgtccttttatcctccagt

SEQ ID NO: 17978 - DNA, 1501 bp, Oryza sativa
gcttttatctactttgaaagattatggtcttacttttgataaagtacctctcttttgtgataatactagtgttatcaatattgctaagaatcatgttcaactttcacgcacaaagcacattgatattcattttcactttttgagggatcatgttgagaagggagatgttgaattgcagtttttagacacaaagttgcaaattgctgatattttcactaaacctttggattctaatcgttttgcttttctttgtggtgaattgggcataattcatccttttggcatggtttgagggggagtttgtacctcatggttttatcaagtaataatatgacaatgaaaaattgagaaaagagagctttgtttatacatatggtattttcttgtgcatgctagcaatactatgaaggtttatttgtctctagcatagcttgtctgtattctaatcttttcatgagatttagattttacttttaagggagatgatgcatgacacttaaattctatacttgaattaagtaaatatgcaatgttgatgctagcatatggtttgatttgtaaatgctctatatatatatgctttattgacttgttattcctcaaatagctttaattgctcattgtgaaaaagagaataaaaatatgaaaaaaatgaataccgaatccttggaaacagtcttgacgacagggatgtattcgatgtgagaaaaataatgggtgccgaatctctagaaacagtcttgacgacagggacgtacctggaataaaagagaaaaatatgagcaaaaaggctcaagaaaaagaaaagttaaaaaaaattctcttggttattttgtgctaaaggttatttgagaaagagtgataaatgcaataggtgtatgagtttagtgtttattcttcaacctatgtgcttgttaagatgttgcattataaatcgtatgaaatcatgaattttgattgttgattcaagcttaattgtaaaatctttggttcatggttatactttaatgcatgcttgttatattatagatggatttatcttctttttattgcaacacatgacttgatatatatgtatgctaagcccttgaatattaataaacataattcctatgcttgatgaaatcattgtcaaaaggaggagaagtaatgtgaaaatttttggatttttggagaagcaaggtgaatttttgacgagttgttgagaagagcatgtttttttttgggttcatgagggaatttctttcttttaaaaagggggagaagttttcttctggattttcgagcacgatgtgtacttttgtacgaagtgtgctttttaccaattttgtttttatttttccaaacaccaaaacatttttgatggatttgccaatgtgttcatcaagggggagattgtaaaatcaaatgtgtttttgattattattctgtgatgaacaattgggcattggagattattggttttgttatttggaatttatttacgaagtggttttggaga

SEQ ID NO: 17979 - DNA, 292 bp, Oryza sativa
tttttttacttcatcatttttttaactacacggtagacgcatacgtacagacaccactacactcgaaacaccacactcacacctacacgctaacacatgtttaagagatggaaaccagcggcatatctctgatcttactaaaatcctgttaaaagctcacttgtatatacatgatattagtgggcaccacctcgactgttgagcttctagcttaaacgtgaaatttgcaacttttgttgaacaaacacacgcttattcatggttcctaactttggaccaacctcattctaga

SEQ ID NO: 17980 - DNA, 1501 bp, Oryza sativa
gtttaatgcaggcttcaaggaaaggctgttgtttttgcaattgattttagttgaactcttttctaaaaacaactaagtgagtgcttctcaaacgacacggatgagacagtgcgtctcgtccggtcggagtatgtgcaatgtatcagtctttaaaatttaaaacaaggttggcacccggccaacagcttttcaaacggccacccgggcctataactttcaaacggccacccgggcctagctgatcccatcagctgcagatttttcaaacatcgaacccctttccacaacagcaatttcacaagcagtagtcaaacaaactacgctaggaatcacctcacatccgcccatgaccgtgggcacggctgttcgaacagtttgttaacctctgcagagggggtacactttacccacacgacattactaacccggatcacccagctcgtggggatcagccacgtcgagagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccggcgaatccacatgtctctcgacatcaaggctcccctgataagctagttactcagccaggggtgtcccattccacccatgtggtcgtacttgtcttatgtttggatgaaatttcaaggaatcggtccttaagtgcgagagcgggaaaaaccgtacacccggtacgttccccggtccgcagttttggaaattcatttagttcgcaagcgccgacccaggtgtcgggttttccaagtcttttgtaaaactccagttttacccaagttgttacttagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcaaacgggacaacagattaagtgcaatcctatcaatgcataatattttgcaagcaacataattaaatttcaaatataggctcaagatgttcaaaggtggcttgccttgctcgagatctggagcttgatcctcgaaatcctcgcactgcgggtcttcgggctccgaaactacacgcgaaacggggcaactcaacaaacggcgaaaataaagccctattaatgcctctaagcgtgccattagatagatctcgagatttgaggaattttggaagttgaacggagtcaaacggatttatggttgggaagatattgaatttctaagattattggatttttggtctaaaggaaaaggatttaattaaatcctttttggaaaagaaaagaaaagaaaataaaagagggatggaaattagacttttcctcggccggctagggcgcggcccgagagagatggggcagtccggctgagctaaa

SEQ ID NO: 17981 - DNA, 955 bp, Oryza sativa
tccctcctgccttgagccaccaaaatgtggggtccacctgttagcatcatcctttttcttcggcttgagagccagcaaccgtttcccacatcacgacctctccggtgggcctccccgcttccacactcgggtctccaggtgcgtggacacagtcttgtaaaatcaaaggtgtttttgattattattttgtgatgaacaattgggcattggagattattggttttgttatttggaatttattcacgaagtggttttgaagatgattggatttcacatgtgatcgcaggattcgtcattttatgtgatcggtcagaccgggctctggtagccggtcagaccgacgtgtaatgcgcggtcagaccggccgacactgtgtcggtttcaattttgggttgtttatttggatatccgaatttattttatgattatgacttctagatggatactatacgtatgtaatactattgtttgctgctgatgagtcaacttggagatagcttggtctcggaatatggtttctttgtttgttccatgtgtaggtgactcgatgtctcaggggagtatttgcggtgatggaccgggagtcggcttggggataagacgacgtccgtggtggtcagagatcatgcgagatacttaggctagagttgatgcacgtggttgatggagattttatatggcatacgatggagttattgtgtgcgtatgggatgcggagtcaaatttagaaggagtccaaatatggtacgattggttatgtaaagtttctttcttgtactagagggtttcctaaggtgtttaggactcctagtatgagtttggttcgtggctttaggctgcctacctcgggtataaatagagagggagcgtgaggcttcccggtatcgcttttgagagcaattgagttgagttttgagttagggtttcgagtttagtcgaaatttttgtaaggagt

SEQ ID NO: 17982 - DNA, 1501 bp, Oryza sativa
agaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgacctgtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacaccaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacatgtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggtcggcgagcgtaattaacgcgcgcacgatatgatctatctcgacctcatgcaccgcaagcgggcgaatgggattagtggaagcgtgggcgcgagaaacgagggggcgaaatagtgggcgcgagaagcgaggagccgggcacagcgttggcaagagtataaaggcactgaggaagggatttgtttccttcctttcgccattattccccttgtcttcgccgcttgcgccctaactccttctttcctgtgccctaccttcgccacacgcgctcgctcttaatcttctcttccttccggcgcca

SEQ ID NO: 17983 - DNA, 1501 bp, Oryza sativa
acgatcttgtacggcaggtgctcggcagctcgccgcacctccggcgagccaaacctcgtcccgaggaggcgcttgaagccggagatggcggcggggtggttcttggcagcctcgccgacgagggcgtcgccgtcgccggtgaaggcgaccgaggtggggatgcagagccggaacagcggcggcgcatcagcctcgtcgccgtagccggcgacgcaggagttggtgttgccgaggtcgacggcgatgacggtgcccagccggtggggcaccctcggtggcccgtacctgatggtatccgccatcatcgccgtcgccggcagatgaaaacagcatagcaacaccagcgccgtcgccgccgccgccgccaagatgtggcgagccatcatcgatcgatcgatcgagcaatctctgtagagaaattcgatcgctttggctttaaatctgcctcgttgaatcctaatccgattcttcttcgggttcgttggatcctaatccgattcattttcgggttggattaattaatccaggacgatgagaatgagatagaacaggaagggttttgcctgttgggcccacatgtcagccaaacagtagagaaattaagtggatttctaggggagaaaaaaaaagaaatagcatattcatcgtgatgaaatatctgttattgttggtagttggagcatgcatattgtcaggcagcatgtgttaattaaaacccatataataaataggagaattagagacatttcattttattactcagcacctagcttagactttgtgaagatcgacatagttgatggagctgttcttggctgtcatggtgatttcgctatggtgcacaattcgactgtgcatgagcattactagtccagcctcctcatcaacctacggtaatcatgtttccgttttttttcccccgattacatgaaaaacgtatacatgggtggccgcgatttgtatgttatacaaaattcagtcaaatgtgtggttaatgacttttaattttttaatttcaactgtattatgctatgatcgtttaagctatgggcagaacttctatatccatattattagcagtttaaaagccaatgctgaaaacttgactatgatgagtaaagcaaaaaatcaactcagaaatgaagtttcaaattttactgctatatgatgctatggcttctagaaaatgcgctcgtcattccttttttttcatctaatctgttaattatgctcacaatcgaagctaagaaagctctgctttacgttggaatgccataccaaagtgccatcttttttttcccccaaaaaagcttggcaggtgaaatactaattttttttcttttgctgtcagaagtgatcttgtaaacctgatgtgcaaggtagttttattttgcaatttgcatgggtattctattccatcagaatgcaattcggttaggtatggatttttcgtattaaatatggaatcatgaaaaataaacacacttatgacacgaggcaa

SEQ ID NO: 17984 - DNA, 1501 bp, Oryza sativa
atgcaaattttttttataaaaatataccgtcggtctcgctcaaccattgcgcgaaaatgacatcgcggacggtatcgcgcagggaaagcgcgagaccgcacggtctcgtggaatggaagagcgagaccaaacggtctcgcaaaatcaaacaactatagtatccaacggctcgatttgattagggattaattatttaatatacaattagctaataataattagcggttaattatcctaatcagtgattaatcaaatcactaattaggataattaatcactaattagaattaaccgctaattacatcggcattgaaccgctatcgctcatgcaatgagcgagaccgcgagacatccctttcaatctgctcagtattgatattctaatccacgagatcgcgcggtctcgcgctgatgcccgcgcggctcgcgctttctgcgtgcgataccgcctgcgacgtcattcccacgtcgttttcgtgcaacggttgtgcgagaccgacggtttatttctgtaaaaaattttgcatcccgaatattcgtgagaaaaaatcgaatgaatagtatattttcaaatttaattctcccttgagattaaattacatcctactgagctcaacacaatgaataggcacatttctaatctttgaacgtcagctattaaaaaacagactaaattatagtaacctaaaatcagattagacacctctactacaaatctcgataaagccagtacatattcgtagtacggatatatcctatcttattctatgctgttatattttgagacagaggcactacatgctaccattgttcacctaattttgactttcaacttacagaagcgtgtgcatctacattcctaatccccattatgcttgtgtgaattacaatgaagtgaaacatcaaaatcacctgtacacactgcatttggcaccagaatcaccttcacgcaccacacggatcaatcacttccattttcattgaccatctaaatgagatttgtagttgtcttatttccgtttcataaacggaacacgcggacaaatttctaaacaaaccgctggacgaaatctaaaatacattaaacccattaattacttatagctttgtccagcactatatcgacacaaattttgtagcttaaattaaatctgatctttacactatctgatctagtgacaactaatctgcaagtagtagtagtggagagagagagagagagagagagagagagagcatacatcgatgtggccttccttggcggctgcgacggctggcggggagccggcaccaccggcgtggtcgcggacttcggtggtccactgcacgtcgatggagacaatggcgccgcgcaagtagcgtggcgtccagaagcaggcggtgtacctgccgtcctccgccgcctcgaacctgaactccccggcctccacgccctccgtcaggtgcagctcctcgccgcggggccccgccacgcgcgccgagaccgcggaggacgccgccg

SEQ ID NO: 17985 - DNA, 1501 bp, Oryza sativa
tagaactaggaaaccaatatggatacaatccgagtagtcattgtcgtttccatgtagaactgtggttgtcttttcttatccggaactcctcctatatccgcaggttattggtactgccgagatttaatcaactactattaggtatgtggtatccataacccctgacaaagacaccgtataccgatactaactttaaaatagcatatgctgctactaattgaaaaataggatatactgaaactaactttaaaaacagtatatactgctagtaaataaaaaacagtatataccgacgctagcttaaacaaaagaatataccgctacgaactgataaatagtatataccactactaaaaaaacagtatataccaatgtaaaaaaaaactgcatatactaatattgaccgaaaaccagtatacactgcagccaactttaaaacagtatatactacttgacgatgttgtagatcacgactacggtatttgcatggtatggagatcgttggtaccagggcatatgcgagattgagatataagagatggagataaggatttctatacaaggtctatacaaggttcgggccccttatctgtaaggtaatagctctatttctattggtcgaagctggtagtgctctcatatattagtatcacttgagtatcatatttgggaaaacctacctggtcgtcgtcgacttggcggtatggtacaccacacgtggtcgacaatggtgaaagcttaaagatgtagcctagaggggaggggggtgaatagatgttgctgaaaaggaaaaagtacgaattacccccttaaactatcgtggtcggccgaatttcccccctaaacccgaaaaccagacattactcaccctacactttcaataccggacgaattacccccttgaccaaatccagagcagttttgtcctacgtggcgtacgcgtggcaacccagtcagtattttccctttttttaacatggtggggcccacttgtcattctctcccatctcctttttcctcttcccctcttcctctctctcgtgacttcaggcgcggccgcgcgggcggtcggcacgcgagggggcggtgggcggcagcgcgtcattaggtgctgccgcgcggttggtgggaggtggcgcaggtattcaattatggatagtatgggcaatctagtagttaaccaaactagggaggaaacagcaacacattatcaagaaaacattcacatcacaacgacgaggaaatcggaagaacacctaagagtatcctgaacgcgttggacatggcgtcaggccggccgtacacggcacatccaatcgaagtactccaccgccttcctgcaaagaccgacatactcgggcgtcagcgccggaagaggaggctcgtcctggagcgtcgagggataccaatgaagcggttggcagacatcgccctgccacggaggccgccgccaccgctgcgggagctcgtgatgttccccgtggccaccgcagtgggagca

SEQ ID NO: 17986 - DNA, 491 bp, Oryza sativa
tgcatgaattaggatcaagcacgaaggcccggttacttcgttgcacctagtcgtctcccgcgtgggaagaagacgacgactaggtctaacggcatcgtgcgtgagattagtagggacaaaggaggggtgctttgagaatataacctaacacgtgtcatgtgcagggacaaagtccttcggatgagcgaaggactattgtcctatgcaattttcttccaacggcgatggtggctagggttagtgggtgtcgttttgcgaaaacgcctctcgtctgccaatcttttacagctcgattctaatttgcgatttttctctccttcacatagaatattcggtctttcgaagggtttctctacgtaaaacattggcttcaaactacacaaaaagcaaaggctattgtagaaaaaatccgacgttctcgccccttctgtgcaccttaatattctccgataactggaaatcccgtgccaactactaactagtaaaagact

SEQ ID NO: 17987 - DNA, 1059 bp, Oryza sativa
ggagatatctctatatagagtgcggagcataatcatggccaccattccagataagaaaagcacgatcatgagagagttcacaatagagaaccagtgaatttgatcatctgtcataagcagataggtgtcccagcgagaagcccacttgatatcactttcctacaagacccagcgaagaaaaccaaaagatattgtttaaataaatataacattggaagcatagctgtgaaggaaaagagtcatagtacaaaaggaaagaagagatgccatgaaaatatcatcacctcaaagccaacatcatatgtgaatatgatatcctttccagcttcaacctcttgaggagtatctgagtttattactattttgttggcatggggatgacatgtgctcaaacgagtatttgcatcattccatttctcttcgaattggtgtttaacactgagtcagggaatttagtaaacacatatgagggattaaacataaatttgcccaatatgtcaaagacgttgtacgaaacaaacataaaaaggttaagggaatgaacctaaatggtttgacctcgaacccaacaattctagagagatctgaattttcatccttgtgatacttcactaaaaatatcaggtggttatggataaagtacttctcatccttgctctgcaaaatatatttttgtaagatcattactagtcttccaaacaaaagaaaaggtaagctgagcacagagacttacaccagcatattggcccttaacaccaacatgatatccaccctgaaaaacaacatcatccctatctggccttgcaataggcacaactagcgggaggttgtcaagaatcctgtaaggtaatttaaccatgttactccagaacccatcatataaaataaatttcaatcaaactaaacaatccatacaggcatacatgttcacccggtactcatcctctatcttttcctttagctcctttgcttgtttatcgctaatggttgctttgcagacgatctgacacatcttgggctctctcatctcaaactatagtccaaagaagtaaaatagaa

SEQ ID NO: 17988 - DNA, 1115 bp, Oryza sativa
atgtcaccaaaaatgtcacggggaaatgtcactgaatctgcgtccgtgaacacgtgtgagttcatgtgtgcagcgtgcgtacaccgagttgacagtggtggggggattgtcgagcgcacacacctagtcacatgtatcgggagcacgagagggcgggagcggcgtcgcgcgtggcagacgcgacgacaataagtaacgctctcgcgtcctcttcatgcaaacttgagacggaatcgcgacctcctaatcacgacaaaggtgatctaatcctgtaattcttttggctgtagttataccaacgcaaaaaaaagctgtaaacaatatattattttcttattaaggatgtgttcatttggaattgttaatccttctcccagcatgtaaaatggaacaatagatcaatatatgattaattaaatattagctaaaataactttaaaaaataatcaatataattttttaagcaattttactgtatatttttttaaaaagaaaatactccatttaacaatttggaaaacatacgtgtgaaaaaaagaaagtagaagtttggaaagtgtattatagaacacaatcttaagacttggtaagacttaagactttagcactaactcatgattgtcttgatatcttctgcatgctttctaactattccctccatctcataatataaggcatgatcaaatttggcacagtcttcaaaatacttaattaggctgtgtttagttcctgaaaagagttggaagtttggggaaagttggaagtttggaaaaaaaaagttggaagtttacatgtgtagaaaagttttggatgtgatgtgatgtgatggaaagttacaagtttagagtagttggggatgaactaaacacggtcttaatcatgcaataatatgagcttcgttttgcgtgtcggggaggaacccctcctcccgaatacaacctagctaagtgagcctaaatattgtttagggtgtaaagcataccaacacaatagttcggggttgcaaattagacttttttttcttaattttaaacagatttcgctgctttaattattttagcggatgatctggtggcacgctttcatcgacgctagttaatcgatctgtacttcca

SEQ ID NO: 17989 - DNA, 1501 bp, Oryza sativa
tgttgtttgcatattgattttgaactaaactcaacaataaaatcatccacgttcatagaaacataaaaaaatcatccacaaattcagagatcgaatcaacatactcaaattgttataaaaaattcacatcacaaatttacagatgcaaaaacatcacaaatcatccacttgtctacgccggagaaaaagtcgcgcaggcccacggcgccaggccaccttcgctcgctcctcgctgttgctgctacaagaaaaggagaggataagagagaggagagaggaggaaagggaggaggaggaaaagggaggaggagtttgtaatcgagaaggagaggataaatgtgagggattatatcccacacgttgatttagtcccggttggtaatatcaaccgggacaaaagatagtaggggttagacgttttttgatccgggactaaaatgatctttagttctagttaatgttgttgggcttttcaaccggaaaaaaaaagatgtttagttcctgttcctattggaatgggactaatatgatttttggctgacccagtagtggtaacaccttatttttgtctgtcaatcgtccgattctcaatctctccataatagccgactcgggaacgacgagatccggctgttgataaaaactacttcagtttatcccgaattcgttgggatgggaactgagccgaaatccacgggatttagcgcaagattgatggagctttcttgaggaaattgtagaggagattgggaggaacctattataatatccaatttagaaaggggagcaaaggggaggtgggattggaaggagaggcagcgccggcttcgcacgggcacaggggttcggtctggaggagcgagcgggaagaagacggcaatgtggcacgtgggccccgagcgatagagagagaggagggaccgagggaggctcctagacttgctctgctgctgctgtgccgaaggggaaaggaagaaagcaaacaggccgaaaggaggaggagacaaattagacttgaccggagagaaggcaagcctgctggagagagggacagaaaaacagacttcactggaattggtccaagaaggagggaggattttaattacttttccatttaaattaatcactgaaatgatctttgaattttcaaaaacacttaaaatgcttaaataattccaagaaaaatcaagaaaatagttggacactcaaaagtatttaaaaaaatatttatctagatcatttaatgattaataattgtttaaataattattgaattattctttgtattgttaaaattaataaaagaaaatttcagagagtataattaattatggagaatttaataatgattaaatccagccatgttttaattaggaaattgtatttctcacattaaacttcacttgtaaattagtgaacaaaatccacaatcccttgtgagaaggaaaataatattgacttggacattcatttatgttcttcaagggactacatgaatgga

SEQ ID NO: 17990 - DNA, 1501 bp, Oryza sativa
gcatcatcccgatcactactccaataatgtcaaaactgccaatgtattaatttcctccatatcttctatactctctacttctcatcagtactgccactactagaacaacgatttttgcatgtagccaaaacgaaacagcagttggacgtggtggtggtggtcatcattgcagggaggattgatgccgccattgccaccgagaagccgatccggaagccggctttccatggacgccgcttctaccaccacctccagtgccaacattgtcaccaagaccaccacgaggaagacgaccacaaacagcgcgaggagggtgcgcccttgccaccatgacgaggaggaggccaagacgaaccatcgccagatccgccgcctccgccgccctcattgctagatccaccaccctcgtcggagaaccgtgcgccacggccgggggagcaccaccgctgctcccttccccgccaacactaccgagccccgccgttgctgccgttcgggtgaggaaagaggagcttgagagaggaaaagggagggagttagggacttagaaaaaactggtgtttcagtttccttttgcgtctatttaaatgccacaaccaaatttcaccatatggcttaagaggcccgcctgcaaaaataagggtattattgcaggcggcccttttaagccatctgcttgcaaaaatgggaataggatattcccaggcggtcggccattggactcctctccacacaacaactacacagccaggcaatcatagtcgaaaataagatcttcctgtgaaaatatatgtgttcattgtagaaaatcgtttttctagtagtatgccacccatcatcagccgcaaggagagagagatgaagcaatgagcaatggctgatcttcttgcaatgctagctatctactgtggctatgaacaagaaggcagacatatggaaacaaacctagctataaaaaaaacagggagaaaaagatgcctactaaatttgggcataaattaaataaaaaaatcatttacactctttgaatggaaaatatgaataggatcacatttttcccaatacttttgtagaggaagctagcaggtcctagtccttgaacactaaaatacattatgtaatgacaaatttaattagtttatcataaataaaagaaaatgttattagggatggaactctgctaattaagggttgttcgagttcaggctgctccttaagatcatctcggtgcggttttatggattggcgaagcatggtaaaagaagattcaaaaagcttacttttctacattttttttgaaaaaaaatacctttgttttgttttgttgtttcttagttaagatatttgaaaactaacgatttttgtaagttttgtctatgtatagtatatctatttatggtagaaggtctgggttctctatctattatattgagacagagagagggagagaacaaacaagtgcagtgctttccttccctcttttcttcattggcccggttct

SEQ ID NO: 17991 - DNA, 1501 bp, Oryza sativa
agaaaccacagaggctttctaatgccacaccagcaagagaaaagctgaagggggataatgcgaaacgtataggatctagaacaagcccacgatcatccacgtcccctacaactgaacctaaccaaacgaaaaccagaaggcctaaagctcagcaggtacagattggtgccgagcgcaagtccagtgattcaagaagaagcagaaaaaaacctgctccaatttccagcatcttgtctcatttgcacatcggctacctgtttgcctggccgcaatattctccagatgatagcacggcaatctgctgtcattcgcatttctgtgaacggagcagcaagatcaacattcgaaggtgagaccttgcaagtacatgtccactgttgaatagcaactaagcaagactgaagtggtgttccttgcttcacctctgacaccattgacacattagcctgccattgagtagttaattgcttttgattgacttgactgagtttgtgtcctctccactctccaggaaagtctcagcgagtcatgtgttgtgttacagcttgtaacatgagccaatgtgttaatgtttctgtaaagttggcgtagcgccatggccattgacgctataatgttagtaatgttgattagtgcatggcttatttggttgcacatccatttttcctaccatcacatatcttcaacctgtactgcttgttatttagatagctcactccaattacatattgcaagcttgtaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagcaatggtgtctctccgcgcggccatcgtcctcgtcgtcgccgcctcgtcggtcgccgtcgccttctctcgtacgccacgcaccccgaaactaattgcatcgatcgatcgatcagcaatggcgaatggcgattgaattgatttggatggatg

SEQ ID NO: 17992 - DNA, 1501 bp, Oryza sativa
gtcggccatcgttaccggtcaccacgcaccagtcctcccctctctaacccctcctttatcttcctcagatcgaggccgagcccgtccgccccttcccgagcgacgcccgtcgccggagctccgtcgcatcgtcttcctgaggagccccaccgccgccggtccttgccgtcggctgccccttcgccgtcgtgcccctcgttgagcactcccttccctctcccttttcctccccttcgtcggccacctccaaggcgtcctcgcgatgcgctgccgccgccggtggccgtccgaccgggtcactgccgccgccctccgcgcccgcgccgttgccggtggtgccgggcagctggttgccgcctcccccttgccgcaccgcgccgccgctctctcgcgtgcgccgccatcgcccgcgtgagtcgttgccggccgtcgccgcaagtggccgcgccgccgcgagccgtcgctcggccgggccggcctgagccgtgcccgtgccctgccgcgccaccccgtggtcgcccgatcagctcgggctgatctgggccgtcggttcccgtggaccggcggtggaacatcccatggtcctggtccacggtggaccgattcccttgacacgctgacgtgtggggcccgcttgtcggcgccggcctctttgatgacgtcagcgcttaagccttttcctttgtaaaaataattaataattgcgcaataaatcattgataattatagaaaatcatttaatggctcaacaacttctaaaattcatatctaattcattcgaactccgaattgagccgttcaacttgcaaaattcatctaaaattaagctctacatgtttgtttactttttatgtactgtttgcttggtttttattagagttttttctcgttttgtgtgccagcgtgtagaatccgtcgtttcggaagattgcgatcgcaaggggaacgagttcagaagatcaaagtgaagaagcaaagcaagtcacatattccccttgagcatgttgatcccaatttataaatgttttaccgtttgcaaataaatatgcatgttttgctaattacatgggatccgggtgttacctatctactcgcttgtgccatgtttacttgatatctgtcatttgtcaaccatgagtaataaatctcctagcttgtgttacttatgtgaccgagctagaactatatgcttagccatgcttaattaccactagctcagttgatgggataattacagtattagacctttttagtatcagaatgagctgcatgctcgagacatctggccaagcttcatggtcatatttatccaactaaaaaagcgactgaatggtgggctgtgggtgtatggttttgctagtcgcacccatggcgattaaggaccggttcgcgggatgccctggaagaacttatcatacttaccacaagccagcgtgggcaacggctgggcttgtagtgtagctttcctctagctaacgcatccaggtaagggtgggcgtga

SEQ ID NO: 17993 - DNA, 1501 bp, Oryza sativa
gccggtgtcaatggtcacaagattgaagacaggtggtgtgccaaggctgatgcccatgaaatacttgttcttgcgcatgctatcatcgcctatgacggtggaggagtctgcaggtatgtttgctggctggatcattgtagatatgaaggaattgtttatgtggaacacagagaatgtaaaggctccattcgtgtttaaaccaatacctgtgttgttcaggagaaaaacagtgtttcatgaatcaagaacaagaacacataagtatgatgtgttaagaatgtttggcttaccaatattaatgcaaggactacaggtaaactaccatgacatagttgcaaaagaagtacttaatcttggtttgttgatggtttttatatgttgcctcgtgtcataagtgtgtttatttttcatgattccatatttaatacgaaaaatccatacctaaccgaattgcattctgatggaatagaatacccatgcaaattgcaaaataaaactaccttgcacatcaggtttacaagatcacttctgacagcaaaagaaaaaaaattagtatttcacctgccaagcttttttgggggaaaaaaaagatggcactttggtatggcattccaacgtaaagcagagctttcttagcttcgattgtgagcataattaacagattagatgaaaaaaaaggaatgacgagcgcattttctagaagccatagcatcatatagcagtaaaatttgaaacttcatttctgagttgattttttgctttactcatcatagtcaagttttcagcattggcttttaaactgctaataatatggatatagaagttctgcccatagcttaaacgatcatagcataatacagttgaaattaaaaaattaaaagtcattaaccacacatttgactgaattttgtataacatacaaatcgcggccacccatgtatacgtttttcatgtaatcgggggaaaaaaaacggaaacatgattaccgtaggttgatgaggaggctggactagtaatgctcatgcacagtcgaattgtgcaccatagcgaaatcaccatgacagccaagaacagctccatcaactatgtcgatcttcacaaagtctaagctaggtgctgagtaataaaatgaaatgtctctaattctcctatttattatatgggttttaattaacacatgctgcctgacaatatgcatgctccaactaccaacaataacagatatttcatcacgatgaatatgctatttctttttttttctcccctagaaatccacttaatttctctactgtttggctgacatgtgggcccaacaggcaaaacccttcctgttctatctcattctcatcgtcctggattaattaatccaacccgaaaatgaatcggattaggatccaacgaacccgaagaagaatcggattaggattcaacgaggcagatttaaagccaaagcgatcgaatttctctacagagattgctcgatcgatcgatcgatgatggc

SEQ ID NO: 17994 - DNA, 363 bp, Oryza sativa
agctgcaggggccactgccaatgatcaccatgtatgggctacctccatgattccatggggggttttcacgaaaccgctaggtgttagtttatgaaaacgggtcaatattagtcggttttcgtacggcgttgactaaaagccatcggtttttactagtttttttcggatttcggtaaaccaatgagatatgatttttaattcgaaatcgaaaaagttaaaccctgaatctccatctccttgttcaagttcatcttaattttttttttgttcttttttcctctcctattctcctctacaagatccgaaaccatttctctcatctatacagaagtatatccattccgatctagtatgtctgaataa

SEQ ID NO: 17995 - DNA, 224 bp, Oryza sativa
cttgtaaaaaacaaaagggagtgttcattaaaattattttttgcagtagcgtcatgtcttgatatgatcatggatcgagagtgcgatgaagcacttagcaggatcaggcattgtcgcttgatatgtgccacaccgaaacaaagctgacatgaggcatgcgatcccggatctgattagatatgaagcagaaataacgagtagtaggggtctgtttgggaaaagaa

SEQ ID NO: 17996 - DNA, 167 bp, Oryza sativa
ccaatgcaccattttgatcagttccaagaagaaattttcaccttacaattgggcagatcaacgtcatgaacctctctgatggctaacggtttgagcgaattgaaggaaattgctgggttttgtttgttacacgtcctatatatactgtgatgaagacaagtatgaaa

SEQ ID NO: 17997 - DNA, 1501 bp, Oryza sativa
accaaaatataccgatctagttttttagatgtgcttatagggataagcaagagtggatccaatgtgggtgttgggtcactcgagcccctgtaccacactgaatcaccattgatagaagaagagatggaaggagaagaagagggatatgaggaatagtggggtttgggtgtgggggccgaaggaggaagaaggagatgagtctcacctatatatggctgagttctttacctcacttttccaacttatttctcttgtttttcgcgcgcacgcttttcaaactattaaacagtgtattttttgtaaaaattttccatacgaaaattgctttttaaaatcatattaatccttttttgaaaaaaataactaatagttaattaatcatgcgctaatgccatgtcgttttgcgtgccgcacccctcctcccgaacacagctaatctagttctagatccctatttgaagatagggtgcatgtatgtctgcgtttgaacaacttttctaaaaattttaaaaaaacttggaaaacgaaaaaaaggcctgaaaatggtataggagccatgtttagttaaaaacaaaaattttcacactgtcacatcgaatgtttggacatatgaataaagtattaaatgtagaaaaaaaactaattacacagtttgcgtgtaaattgcgagacgaatcttttaagcctaattgctccacgatttgataatgtggtgctacattaaacatttgctaatgatggattaattaggcttaataaattcgtctcgcagtttacaagcgaaatctataatttgttttgttattagtctacgtttaatacttcaaatgtgtgtccttatatccgaggggcgggcccacctcaattcaaagggtattcaaatgaatacccaagatttttagacaaaaaaaatacatatgtgagatatatatttcgtatgtatatagagaaataaagaaaatatacgttattgatcgaaagaagtccaacaagaaagcctagcaggctggatccctcaaaatcgaacccaattatgcatggttgtctaatttgtgcattaaccatgttgtaatggcatgacgccaatcgatatatacttggttggtagattgtactgtatatgttttctcacaaagtatatcataataaattaagaaaattgctaaaagccttgtcgcaagttctaattcaataagcagtactaaaatactatactattgatcattcatacctaatattgtgctcgtgttgtaaaaattatttttttatcccctttacatttctaataactaatctcaaaatcctgggccgcccttagacgtgacaaccacacacacacacaaattttcgcccaacaaacaaggcccccaacttgccccccaacacgaccggtgagcgtgagtagcagtagcagctcgaaaaaaggacacgagggagggagagggagtttgccagatccggatcccgcaccagatgcgcccgccggcgatgctccgatggc

SEQ ID NO: 17998 - DNA, 318 bp, Oryza sativa
ttactgtgatgccaacttgtggcccaaactggagcgccgcaaaatcttccaatcaagccgacatgcaaatactccatgcaataagctaggcatggacaccctataacaaggtaggtatggtgatcaacttgatgatcgctcgatttgtcttgactttgcctataagtaaacgctgcaacctgccttgtcgttttgggcgtgcacatcgacggatacctgatgaccatgatgcctctcactcatcaagtctctatcgtccgttgcaccgcgagagagaacagcgttactactagttgtactactactacgtgcggtaga

SEQ ID NO: 17999 - DNA, 436 bp, Oryza sativa
agagcagtgccctgagcacgagttgccttagtcctattgggacactgatgccctccgtaaggcatcgggagtctccatggagacacgacgagacatggttgagttagagccacggctccaacgtggcgagccaaagcggcgcgctgtaaagggcctaatccctatcacgggaacatgtatatgtagtacactctccataaggactaaatgtaagtttagaatgatctcagaatattttttttaaccaagagctccaagtttgagaaccctatgtcaagaacattgtgcttttgagtgttaccaacggtgtggcacaatccagcgtccgctattggtgtaccatcgtaaccatcatatactttgcccatcggcacctccccacaactccgtctctccattctccaattctggaagaactgtctctttttctcgtaga

SEQ ID NO: 18000 - DNA, 348 bp, Oryza sativa
ttaccaatgatttgttccggcggatgtcgtctttaaatgtgcaaaggagcagtgacttctgaagttgatccatgttctgtatcagtactggtcgaagttgtaatctctagaggaccatctcaaacagcatcaacagaaccctcagccgacgaccctggccggtctgaccgcacctcctatgccggtctaaccggaggtgtgccggcggtctgaccggcctggcgcccggtctaaccggccgagccgaccttgtcgttgtcgttgtcgttgctctcgtcttcaaaaatacaatcatcctccccctgaacctgtgacagtgtacctgcaatatcgggtctagtacctgga

SEQ ID NO: 18001 - DNA, 1501 bp, Oryza sativa
tgtaagatatattgccgacttttgatccctatttatattgccaaagtcatagtaaaataacatccaaattatggtatggcaaaaaaccattattttcttaagagttactccctccgtcctattttaaatgcaatcataagtattcgtgctcaactttcatcgtccgtattatttttttataattagtatttttgttattacgagataataaaatatgaataatactttactcgtgacttatgtttttattttttttcaaatttttttaaataagacggatgtttaaagttggacgcgaaaaaccatggctacacttaaaaatggaacatagggagtaagacatactcctattctttttgtcaaatatctaccataaaatacatttaaggggctatttgaatcgtagaaatggaaaaacgaaggaataggaaaaccggaggtctatgacagtaatgtaagtgtaaaagttacaaaatactagaaaaaaacaaaaaaacaagaataactgttaaattggatcacaaaaaatacaggaatcgaatgaaatagacactcaaagaaaattttccaacaggttgaatctgttacaaacttttcttcaaaatctctatagcattactcattcaataggagtttcataggaattttttttcgaaggattgaaatcctccaaatatcttataatttttctacgaataaaaggggctaagttatggtattacgtcgggaattgctgagggtcgaaacaaagcgtgacggatgaagtcgtgtgcttagggaaacggtgacgacataaaagcgacggggggcggagaaggagggagctgcggtgtgtgtggttaaccggtggggaaatggagccaacatttaatttgttcctctctgatactactagaccccaaatttcagaagcaaacattgccccggaaccccttaaaaaacaatggcaattacacaccgccccatcagccccgtactcgctcgtcccgcaacagtacaaagtcccaagccccaagaaacccaccctcgccggtcccccgtcccctgtcaaccgacccccgaggagaagagaggagacgagaagcgaggcgaagaggccaggccatccgctgtgcctgctttgctttgcttaatagagggagcgtgaggtgcacggtgtggtgataggccgcggctaagcaccaaagtttcggaaatggagctgctcgctgccgcagctccgggaagcggaggctaccgagcaaccggaccgagccaaagcagcgccagctagttttgtttttgctgcggcaactgcgctacttaaggctgtaggcactacacaacaccagcggaaaaggaggggtaaaggtgtgtgaggtgaaggcgaggggagaagcgagaagctcgtgagcagcagcggtgtgtgtgtgtgtgtgtgtgtgtgcgtggggcgaagggaggggaagaagaagaaggagaaggagaacttgttgctccgggcgtttcttgggcgcggcca

SEQ ID NO: 18002 - DNA, 1501 bp, Oryza sativa
aagcaaaactagtaatgttttggaagaatcatgggattacatagaagatattcagccatcaatccatcgtgttcatgagtgacagctcctagtttttccccctaaacttgaacagaacctctgctgtggtgaaagcagcagcagcctctgccgccgctcgagatcgccgtctctgccagcgcttcgttgattgatgtcgttgtctccgttgaagcattgtcgccgctgcctccgaacacaaaccctcgccgatgttgcgcatgcggcgtgctagtgctagatccagatagggtgagtttttaattggatccatgcgactgtaactttgcgaaatttaaaaaatacaactactatttgttatatcggctgcatgccactaaaaatttctaaaattggaaccataccattgccgtccctttttccatcccctctctcatgggaaactattctaatccctcaaggggatgttccctcgtttgcttaaaacctatctaaacggttatgaaaaaatctggaaaaaattgacaacattcatacaacacatatatacaactccacaaaatcttaagtccaaactcaactcacacgtcgagatataaaaaagataaattcagcgtataaatagtagcgtactgtttatatctaaatttgtcttttttttgtttctcgatgtgcagatcaaatttaaacttaaattttgatgaactagtaggtatcattatactctacattgtcaatttttttcagaattttttacaactatttacatcgaatttaaaagaaaaaaagatatacgagggatatccctcgagggattagattccactccccactctcacgccgtctccttcccacgtttaatcgtttcaatctccctttctctctccctccaactgcaaaaggacagcggcggcgacgccagcggcagctcccgagcactcccgccgcggacggcgtggaggacgacggcggcggcggcagctcccgagactgagctcgcccggcgcatcgtcgagcacggcggcgtcgccatgtgtgacggcggcggcgccacgctgcgccggccgggcatgtagcagctgtggcgcgacgggggcggggagatgtcggcaaccatgaagtcgtcgtcttcgtcatcgtcgcggatctccagggggaggaactcctcctcgtcgccgtcctcgtcgtcatcgtcatctccggcgagctcgaacgtggcttacggccagcgttggccgtcggcccgcgacttccactccccgacgctctcctgccgcggtggagcacgaggagcgagcccgggggaaggtggcggccgctggcgtcgacctcctcgccgaagaagaggaacaaatggttggcccggcggatgcggaggccgtcgaagccggcgagcgtggtgtccacgcgcagcgcccgcatcctcatcgtcgtccgccgcacgctcccgcacctccgcgacctcctccgctccctcctctactcccccgcgggcgtcgct

SEQ ID NO: 18003 - DNA, 1501 bp, Oryza sativa
gccgccggcggcatcgctggccgtgacgtcgacgtacgtgcggccgacggcgagggcgacgctgtccgtgctccacgacggcgatggccgaacgccgcagcaggtaagctctcgttcgatcggtcgatgtccatgtcagatgtgttctcctcctctttctttctttcgctcgttggttcgatcgatttcagaggaatctgaaaatgtttacgtacacgaatgaatgcttcgaccatacagaaagttgagtacttatgagttctttctttgtgctcaatcatgagtaatacgaaaagttactttctgtaaattttgctgatagtgcaagtaatcagcatgcatagtttcagtacagtaatcttcctgactcctgagccatccttcatccttttctttttctgttggaggttctgaaaagaaatatctcaattatctgcatacattaagtttcaacataatctgtgttgaaaagattatatgttattcatgttgtcagaattgtcaatgatcataaccggaaaatgatttatattttgtactgcatgatgcttaatctctctttctgaagaatgaagtttatatttcaagtaatttcagaagaagtggtgaggggtctagagtctagacggttctattagacagtttgcatgaatcaggaagcaagtactcggttttatacatattaattttgtcattttcatgcatggtagccctggtactacttgaaaaatatgagaaacaaagttggaccaaaatttcctaccacatgttgagttggaacaaaagtcaattgcaaatatgtgcttcaatctattcaggtcaattttaacatgagtggattagcaactgaaacttgtgggcactgcacccatgcccaaatttttttaataagcacaatcatttattaccattgttgtccctgctagctagtatacatgtatggctcggtatatatgtaatagagttaaaaaaacataaactacaattatgttgctgtctttcttctgaatcatcaagttagctaacaaaataagcaatagcattggcgtattatttgccagtagaaagatagcccatgaaatttctgagaaagaaagtgaaataattaaagaaatatgttaatgaattgtggattgctatatatttagcctgaaattgatgttcatgtacagcttagaagattgcaaagtcatgccagtgaaggtgatcaatatcatagaatctgagaggaaattaaactgatttccaaagaaaaacctcagagaaaatcaagaacccagtttcttcctgaatctgtgttcagagaactcaatcgctgctctgaataagattacagtttgtctatcagattactacagtttttgcaacaatgaagtgtatcttctcaagaatgataaaaattaaaattacccttttgcaatagttgacaaatgacttggcaattaactgtagctaaacttcatttgctagtgagcttgacacattttgctgaaacttcagg

SEQ ID NO: 18004 - DNA, 1501 bp, Oryza sativa
agttgagggactcaaagtatactttctccaatgctaaatgatggaggaaatgggccaagttctgtgaggcccatgcttgtagtcttgtttagccagaggataagggcttgaaaggccaaaaactaagaagggcctttttgtatgtatctgctgtgaaattggacctgaatccacgtctaatttcgacctatacactcttgcgtggaccagtgtttttagtttaattttccaacatggcacccataatttaataaaccaaattgactacgaataatctgcccgtttaaatgtttccttaattccctcaaaaacaaataaagaaaattcaaaggaatattacactactactccagttgaaaatttctttttagagtgggagcaagagtccttcgaacgtttgattgaaaaataggaggaggccaatgtaaaagtttcatttatagcaggggccattatactatttgagtaatactctactatagtgacttatgtactttaatgcaatcctctcacttgctataaaattatatatcgcactaatttctaaagcttaacatacagagatgtcatatcattacttactaacaattattacatttaaacatcatgttatattatctataatttaataatttattaaattttagagatttaaaatataagcatgttaaatcatcccacataattcacataatatttcaatatatctctccatcatttttttaatatcctataaatctatatagttcatcctcactttattccatgttaattttcttttctctcattaagtcatatcatataaattggttttagtcctcaaatgatgaacctatggttcaaattatctctcttctttttttctctctcactaagccatatcatcttagttctttgtagttcttagatgtatggtctaaattatcttccttcttgtgttttcttcataaagccacatcatcttaattttatatttgatccaacgtaggtgctgagtgactgagtccttctaataagagatggaagggagaagaagagggatatgaggaatagtgtgggttgggtgcagtgcgagtgcgggggctgaaggaggaagaaggagatgagtctccctataatctagttcgagatccctatttggagatagggtgtacgtgcgtatgcgtttgaacaacgtttctaaaaattttgaaaaattttggaaaatgaaaagggccagaaaatggtataggaccaatttgccaaaaacgctaatacacgactagtcgcgcgcgtcccttcccgcgtgacgagccacgtggcgcgcgcggaggagttaggttgcgttggttttttttctggttttcttttttttcgttcgtttcgttggttttttttccggttttctttattcgttagtttcttccgttcttctgtttttttgtccggttttctcgtttttctacgttggtttcttccgtctttgttcggttttttctctcccttttcggtttttcagtag

SEQ ID NO: 18005 - DNA, 1501 bp, Oryza sativa
gcaccgtgttttggcttgattagcagcagtacaccttttgtttttagtacaacttggtacggactgatcactgatcagacgctcatgaccagtgtggagtgcggacagctggcggcattttgggtcagacttaattagcagtgtgatgtaggagtagtaacactcaatcaaagcttaatttgtgctcctagctactaacagcatatattaattcgtaccagtaccgttttccataagttgtcctggataatactcccaccgtctatttttagtgtagctgtgggtttcattttccttatcaatttgatcgttcgtctaatttaaagatttatgaatttctttttttaaaaaaagtcatgcataaaatgctattcatattttatcatcttataataaaaaaatattaattataaaaaaaaatcaaataagacgttggatataaaaatccataagtcaaaatgggatgaagtatgtgtgataaaagtttgttcataccaatgatgtttccaaatcagagtaaacgactataccgatttcccgtgattgaggatggacttatgagctctcggacggctggtccatccccgtcccgtcgaccagatcacataatcgattacgaatgtgccgtggacaaaatttaaaattaaaaagtgttttggagtcaattttatgctttttttttcagcgcgtatttttcagtcttaaatttttaacgttgaaaccataagtaaataggtaaataacacatctaatataaaaagctttattcgcaaataatttttctttttttctacggctgataattcttgctcaaatcgattagagcctttataacctagagccaaccatgcattctactcctataaaaaaaaatatgccgcagcttacgagaaaataatcggaatgattttaagtcaacggcgtcgaaacatttcgaaacggagggagtacaatctagctagctctatataaagggcctgttcactttgacctgatttcttatatagttaccaaaatttggtagcaaactaaatatagccactttttttttggcaactttaccaaaatttggtaaggttgaaaatggcagcacagtgaacaggccctacatatctcacaaaagtttttaaataagaagaacggtcaaatatgtgctaaaaagtcaacggtgtcaaacatttcgaaacggagggagtatatatatatatatatatatatatatatatatatatatatatatatatatatatatatatatatatatatatatatatacatacatacatacacacacacagaatcctgttcaatatacaaataatttctatttcttgagcgaacccaccatttctatattggtcaatgatgtttctacaaaacattttattgtataatctgtaaaattaaaggtgtttttgattattattctgtgataaacaattgggcattggagattattggttttgttatttggaatttatttatgaagtggttttggaga

SEQ ID NO: 18006 - DNA, 1501 bp, Oryza sativa
aaaagtaagagtacaactagaattttgaacacgatacgagtacataattgcatgcttgcatgcgtgcggcttcttgatgccgcggggtcgtgaactgtgttgtcacgagcgatcgagcatctttaattcgcgcgcgtttcatgaaccatgcgaaggctgcaatgcgtcgcttccatttttcttctctgttttcacgaataataatactggtactactcaggttcaacagtctttaacaaagccctttcctaaggcagacagacaagtccttgcatgcatcacggccatggaggctttcaggtagatgtgacaacgcctcgttgcatttgtctcccattagtttatgggactagtgttatttgtctctgtccatattcaagcgatcctaatgcatggcttcgtctgcataatccggatatatgcgctagctttgcttttgaaaaacaaataattcaagtacagtagtaagattaattagtgtatcatgtgagagccatcagatcatacgggcctacgtgtttcacaataatgccaatccgaccttgtcattgtacggcagccttaaaatacacgaaatgacaaatggcaagcttaatggattgcatatgacattgcatccacttgaccttagtttagttccgtttgggtatgtgtttctgtggccctttagcaaggtccaaggctccttttatgagatgccactgcaagtggatatgcagctgtgcacaaacagggaaaggtagcatatcttttaaatataaagtggaataattaggagcttacccattgaatcacctgcgtgagaggctaattccttgagatttgactatctgagaaaaattaatactccatctatttcatctatttcaggttataagaccgtttcaagtttaactaagttatatacaaatatagtaatatttataatactaaattagtttcatcaaattaataattgaatatattttcatgataaatttatcttgattgaaaatgttaccactttttctacaaacttggttaaatttaaagaagtttgacttgatcaaagtcaaaacgtcttacaacctgaaacagagggagtaattaagaattataaatatatgttaaatattataaagataataaacatatactgtatatgttaaaatattatgaaaatgacaatggcacgatgatttcatatgtttttatattgagcttaaaatataataaatcatacataacggagcatgcttatgtcaaatttaagatctaattaataattgctcacggataatattaatgtactgccttcgttatctaatatatgacgttagttggtttaaaattggactaatattgtcatgcgtagaaaaagaagtgagtgccatttttacatgttaaacttaaatatgtagtatagtagtagctaggttaaaattatatggaatatcttatcctatcttatccagtgaaagcataaaacatttttactacgaggatacgccacatctcatca

SEQ ID NO: 18007 - DNA, 1501 bp, Oryza sativa
gcgagagctaggctgaaattaaacaagtggagatgtgcatgcgctaggccggcagccattgactagaatttataattaggactaatccgttcaattctgaatcaaatcaaatcgtgagcacgcaacaagtcagtgtcaacacgtcaaactaggcaacgaccgtatacggccagaattgtcagatactacaaatcatgtccggctagtaactcgatttcagcctctctcacagtaactcgatttcgatggatatatataggttagcagattgctgtgagctaaaacaacctaacagcttaattagttaattagcagctgccactagtttatttttatttatttttaatggttcatcaaagtatatataaacattggttgatcgaatgtgatcgaatcaagcgtggacgcaagcctacctaacatttcacaaggtagccaacaaaaatattcctattccaattcttaattcatttcgaatggcaattgccaaccactaaagctgcatgcaggtccggtgcaaatgcactgcacttgtttgttctctccctctctctgtctcaatataatagatagagatcccagaccttctaccataaatagatatactatacatagacaaaacttacaaaaatcgttagtttccaaaaatcttaactgagaaacaacaaaacaaaagaaaggttttattttcaaaaaaaatgtagaaaagtaagctttttgaatcttcttttaccatgcttcaccaatccataaaaccgcaccgtggtgatcttaaggagcagcctgaactcgaacaacccttaattagcagagttccatccctattccctaataacattttcttttatttatgataaactaattaaatttgtcattacatatatattgtatttcagtgttcaaggactaggacctgctagcttcctctacaaaagtattgggaaaaatgtgagcctattcatattttccattcaaatagtgtaaatgattttttatttaatttatgcccaaatttagtaggcatctaaatttttctctctgttttatttatagctaggtttgtttccatatgtccgccttcttgttcatagccacagtagatagctagcattggaagaagatcatccattgctcattgcttcatctctctccttgcggctgatgatggatggcatactactagaaaaacgaatttctacaatgaaacacatagattttcacaggcagatcttattttcgactacgattgcccacctgtgtagttgtacgttgtgtggagaggagtccaatggccgaccgcctgggaatatcctattcccatttttgcaggcagatggcttaaaagggctgcctgcaataatacccttatttttgcaggtgggcctcttaagccatccggtgaaatttggttgtggcatttaaatagacgcaaaagaaaactgaaacaccagttttttctaagtccccaactccctcccttttcctctcttgagctcctctt

SEQ ID NO: 18008 - DNA, 1501 bp, Oryza sativa
tcttaaaagtttgaccaagtttataaaaaaagtatagcaacacttataacaccaagttagtttcattacgtctaacattaaatatattttgataatttttttgttttgtattaaaaatattgctatatttttttttataaatttagtcaaacctaataaagtttggctcaaaaaattaaaacgatttataatatgaaacatagtagtaacatggaacgaacagagtacgtataatatatagttgaatgtgaaaatgagttcaagataaatgcatcagcactattaatttcatgagttatatgtgtaggagtaattccgagaggccaagcatcacaactaatctggcctatgctgtcgtttatgtaaagactagctagttactacctccgtcctaaaatatagtacaataacttttagttatgaatctagatacatagttgtccagatccatagttaaaaatgtttatattttgggatagagagagtactcaaaacttagcacagccaattaattcattcatcgagctagtatctgtttcttttctctgcattcttgtccatgtactagcatacgaatttacaaaaattcagtgcatgcagacacacatgttagccagctaggagagtgtatatagcggagagaggttgaggcctgtacgctgtaacatgaaccgaccatgcagatgcagtgtccctgcaggtggcgccaagctaaggccattcctaactcaatggttaagatgatgtccatagtattaaataggctgccatctaagataaaaaatgatgtcacaagtaaataaataaagaaatagaaggaaaccatgtcttgcatgagacatagtttctacacaacatctaagacatcatgtgagataagtagcattaaatttaagtatagatagtggtgtttgcattgaaagagtagtgtctagtactagtttcttgatgatgtggagtttatggaaactatgtacagtgctttgggttaggaatagcctaatactacagtatatgactgtcagatgactgtgtcctgcaggaaagcaaacaagctagggtacgtgctgcatactagcttcacagttcacactacatgcatgcagcatggacctcctccctcccttggataccgccacgccccacaccttcatgcatttgggattcccttacaaacccttcgtcccaaaataatattatacttatcttaatttattgctagaagttgatcttttttgagatggaggttgtattatatatcagctgcatgtatgttttcagtttccatctatcggctacccatgtactattatcgaatattttttaccaaaaatatcataaaatttcagttgtttttcagtgactcatattgtactaagattcgtgcacctacaatgctccaatcctctaatcttatcttctcttcttcttgatcgcccatcaatgctctacctcatcatcaagccccgtcctctcctcttcctcactcatcctcctaaga

SEQ ID NO: 18009 - DNA, 1501 bp, Oryza sativa
gataaacacatgtttgcgtcttggggtgttagtgctatagcattgctgcaattcctcatgatcttttctctaatcctaggctgctgatcacgattggaattgttcagttagcttctcttctctttctgggaagcagcagtgctattcgattcagattattttgtgatccaaatttggtccttcaagatggaacggtgtactgtgatgcaaatgctcgttgctcgaacttcactgctatctaggtgtcctatataaaatctggatgctcctaaaccatttgcatttgaaagaatgaacgtaaaacactgtatcatatcatcactcgtactgttagctcctttctcacttcaaaacaaccaaatcctcgaacttcaaaccaatcggagaattgaaacttccaagcgtctagactatgtcaaaaacaatcggagaacacacggaatgcttactcttttgaggttttaataacaccagatgaggaacgcggcagagttccacattcctggtaacttaggcttagaaacaaagaaataaaccatgcgaggtgcatttggggttgctatttggcgcgcgcgcgcacgcgttttcgttttcttttgccatctttttcgcgttttcttttttttttctgccatcttttttgttttttcctttttttttcacgtcccctcccctagcatgttttacctttttttcgcttttttttttctgatttctttaatagttaacacacatgttttcaaaatatattgagttaaaagttttcaaattttaacttaaaagttttccaatctgaagaaagtttcaaatctagagttgtaaattttcaaattttgagttgaaagttttaaaatctgaattgaaatttttcaaatctgagttgaaaatttcaaatctcgagttgaaagttttcaaattttaaattgaaagttttaaaatttgagttgagagatttcaaagattgagttcaaagttttaaattttgactgttcaaatttcaaattttaaagtttaaatcttgagtcgaaagttttcaaatttaatatgaaagttcaaatttcaagttgagtttagagtttcaaattttgagttgaaagttataaattttatgtattgcttttaatttttcaatagaaagttttaaattttaaactttcacgtatagatttcttttcaatctgttagttaaaaaaacaaccgggaaaaaggaaaatcttatctaattactatcattatctaaaactaatacggttagttatactaacttctcccgaaaaaatgtgcgccgccaatccacgctcgccaactagcttttccataaattcttacatgtatgaaaaaaaccaccacaacattgatgggttcacatcgtctgccgttcaggctgacggcaaacattgccgttgccttcatccctgccacacatccttctatcaacagttgcatgcagtggtcccaccattgtgattaattagggactactaattagcagaatcactta

SEQ ID NO: 18010 - DNA, 1501 bp, Oryza sativa
atatattataactaagcttttttttggatatatattataactaagctttttttttctttctctaaattagttccgaaagattgacctggcgatagtagacctttttgtgcgttgtagcacgtagcatttccacttattgagaagatatcattttgtacataaattattcaagtcatatgaacacgagcgagtgcatataatacaaaaagaaatgttttgagtacggatcgttatccttttagggtttcacattcatatatacttcttgtaagttgtcgttcggcgttgtaacctcaccccgatacagtgaagatattaatttgctggctggcacctatggttttttctctcctgctttgggaaggtttttcacgttaaatctcgtgtcttctgtgattgatctattgttctttatcttttatttgcctattgtttcctaacgcaacacacatatattttgctagtttaattaaaataataaacgttttaacacaattacatatgcattgtggttaaaagtagaaattatgtagtcctcgtacagcataaagaatagaactaactaacgaggactagttaaagagaaaatgtaacaataactattaagttagtgctgaaaaaactactccctccgttgcagattacaagactttctagcatttctcatatttatatagaagttaatgaatctagacacacatatatctagatttattaacatctatatgtatgtgagcaattttagaaagtattacattgtgaaatggaggaagtattaagttaagtataatcagtggcatataagaaatttgtctatttttttactagaaaatggctagccctattctattgaaccagatacgtgtggaaagcataaatttgattagtacgacgtccaccggcccatctatgctgcagtcctttacataatgggcttctataatagcccatgtcccactataaaccaaccaatggcccaactacttaattgggccttccacaatcaacaggagcagcccgctgtagagagggcagagctaaactgtacaaaattgcgtgcatgttttttaagataagaaaaactttattgaactcaatcaattaatatcagtgataaaaccatattgaaaacattctcggcatttgcataacttgaatacacaaccaaaattttcacgcacatagtatcacatagcaatacactcttgtgtgtgactatatgtgtgcagtgtgcgtgtgtgttcacgtgccacattatatttctatcatttgagccattaattgttgtaagattttcacaaatgttatgttcagacccagccaaaattgcagtatatatctggcaccaatttgatatgcgttatcaagatcactaattcagtgtgacaattgtcaccacttaccaaaatacggagtagtaaatgtacaaattaaatcccagccagattcaattaaattttgtagccacatcacatacaaattgaacatcaaattggatttg

SEQ ID NO: 18011 - DNA, 1501 bp, Oryza sativa
acattatcaattcatcattgaattaattgatcatctgcgaaattcattcagaggaattatattaaatgagatacttgcttggattcccgggctgattcctcttcttcttgggcggcggcgtggccgcgaccggagcagccgcgttgttctgcaggggaggctgctgctgctgctgctgcatctgcggctcgccgagaccgaagtagtgtgcagacgaggcggctgccatctctatctctgatgatagttaatcagctcaaaccactgatagactaattgtcttgttctgttaaattgtggctgaagaagaagataggcatggaattaatccaatccaattaagtcacactcttcgatagtagtatgtgtatcttggacgctagctagtctaccagctgacttccaatcctcttcgatttgcacgacctgaaaattaatcaagacaaaattaagcagagatccaagaggtaattacatgcgtggatgaagctagctagcatggaagatggtggatggatctgtactgtgtgcagccataggacagacaaactgactgacctgcagctgatcgatcagatcctctctaataacaaagcaacaaattaaatcaaaaagggggaaggaaacgaaaacgagaggggaatttaatcaaggaattaataagagaggaattaattcacaagctaattaatccaaagttccaaaaaaaaaaacatgcaatcgtacgttgcacatactcacaagcaaggcagctagaaactagctagcttgaaaaaaggagactggtcaataacatgagataaggcatggagaccgaggtagaagaagaacagcaacacatgcaggagaaaaaaccaaaaaaaataaatcacatgtcatcgatctgagatggagatcgagaaccgaacaaacaagttaaagaaaacaagctaggctccttgttgaaaaaaggaagaggagaaaactctaattaaggcgatggagatagaaatatatagagagctagcaaacacgaaccggggttataataaattcgaaaagccaaaaacgagactgcagctatctcctcgtcttcttgctgctgggctagctagctgctgcaatctatactagctagtacacgtacgctccaaattctccaagttttgtttggagctagctatagcacatgatgacgacgacgacgacgtaactggtataacaagctagcttaggagcatatgctactatatggcgcctgtggctggagaagaagagaggaagaagacgagagagcgagcgagcgagaggagaggagggagatcgatatggtgtggatcgagtaatcgatcgactcgagttgggtggttggttatgagcgagcgagctagctagctctcctccggcgccggcacaagggtggggcccacgtggcgccctctatgggcccaccatgacatagacagatgctctcgtcccttccactccaccccgacctctccatcctatactagctcatgtt

SEQ ID NO: 18012 - DNA, 1501 bp, Oryza sativa
ctaatatagggctattttggtttgatcctaccaaattgttgccgttttaatagtattttggctagttttttatttgtaccaaaacatgctagtaacacatataacactactatagaaatgatcttcacatgtgaccaaaacttgttttcgcagaccaaaacttgttttcgcaggtgaccacccacctggagccaagtgtttgcgaaaattgacatttttctatgcggacgcaacaaccgcatacgaaaatgcatattcacatatggcgtcctaagaaggccgcatgcatgtaaagatccgatttttacatgcgaataagtaaggacgcctcactacaacgattttctaaaaatttaaaaaaaataaatccaaaacccttgatcgggcaccgccttggcagcctgtgagtccatcgccgtcgggtgccgccactaccaaggcccctccgctagctccgtgaaggacagagccatcgtcgtcattgtcgatgcagtccgccgcccaccgtcgtcgagaccctaccgcaaacaaggccgacagcgacagatccatgagggagagggccgccgctgtagaaaccgcatgggggggtaggaagtgagtagtggagagagaaatttgatattttaaggcgtggtgaactggttgcaggtccacttgcgaaaataggtttatttttgcatgtggttatttaagagcccccaacaaaaattgatttttacacatgggcttcttaagtggccttatgcgataatacgcctattattatagatgtgtttcttaaggagccgtatgcgataatgcgttttcacatgcgaccctgaactaccccccccgagcaatttttgcataagcgaccaattacggcctgcaatgcacaagggccctcatctagaaaaatcgttactactaaaattttggtattgcctatatgttagcatggtagcataccaaagtccataactctctagctaattaatctacttcactaactttgactatcaataactttaaaaatatttagtttaaaggaactataacaagatatatatatttgtctttcaaagcactataataaaagtaaacattcatttatttattatatatattataatagaaaaataaggtcaaagatatatttggtaggccatgttattgtctaaaatgtcaattaaaatgaaactggagggagtactagtactgtaaccaccctccctctccctctgtgcgcaagtccacacgtcaaccatggccgtacgtattgtccatgcatatgtaaacttctccgaaaccaattcattcatttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcggcggcgcgaggattgtcagtg

SEQ ID NO: 18013 - DNA, 1501 bp, Oryza sativa
tataacaagggaaggacgagacaatgaactctaaaatagtacgatttcccaagacaacgagatattttttaatacattttaaaattatgtgtaattcttttataattttatgcgggtgctaggactgctagcctcataattgtacggggcgcggactactccaattactggcttaaaaaaacgattgatcaatcaaatttgaagcgctagctgttgtgagtggggagcctttttggctggatgttttgcttgcctgattaattatacttgcagtggctgctgtcaggggcatgtgtgacgtgataacaaacactgaatccgctgtagagcggctcatcaatcatcaggccctgaatgttgcggcacagagcatgcatctacagctagctaggtacatatatccacgaccaagttccatgtgatcattgctcatcacatatgtaaacgggataaagatatatatatccatttatctaaacataatatatactatatgtaattggcttagttaaataaaaaaaatgttatctaaaatttaaagtccaaaaacaattatatcaggcggcggttgtgcatagaggtacatacatgaacatatggcacgcgtgtagattttttttcttcggcgcatgcatatagcgaaactaagtgaaaaattaaatacgaaaagcatatattaatattatatgctcctcatgcaaattgagaaaaaatatctttgtgctaaaagattagttttggcatgcatatatatctccaagagtttcatgacattctttgtcacatgtactttgcttgtcaagtgcttggcagcaggctatggctgtgttcgctgctggcggttcccatgcggaaaacggaacagtctattagcgcgtgattaattaagtattagctatttttataaaaaaaatagattaatatgattttttaaacaactttcgtatagaaactttttgaaaaaaacgcactgtttatggcaatttgaaaagcatgcacgtggaatacgatggagaggggttaggaaccctaggttctgaacagaccctatataacacaataaaatactacgctgttgaatagtaattcctctacgaggcatgcataattgcatgtgatgtgtattcgagatcaaaagtacaggacaaaaacaaacatatagaaaaatcaggaacagatacatacttgtgtgtatatgcagatgtgctcacatgtgatatataattagctgatcatttcatctccccagaaattccaaagtagcaaagtttaatttagtggattacgatgtataggaaacagcaactatccacagagaggaattacacaatggcgactaaaggacaaagccgtgtattgtcaacagcacgaagaaaaacaaaattcttgtcacgaggctgactgtaaagtacagcatatatactacctgtaaataatccctctcaattaaattcaaaaataacacatgtgcatgagcaagatattaggtcgacgattcagc

SEQ ID NO: 18014 - DNA, 1501 bp, Oryza sativa
acgcgcccccggtgatcagccaccatcaacctcagctccagcaacaacaacgtcagctgccatcgtcggcagcggcggcggcgacgaacggcaacctcatcgccctcgccggcgggtacgagtgctcacacgacagctccggtggctcgtcggaagatgccgccatcgactggagctcgctgattaccgccgccaccgattccgctaccgccgccgttgatttcagcttcaacgacgacatcgatttcagccctgccgctgttggcccatgggcgccacagctttgattgattgattatttgtgcacactgcataataactgaattactagtaattagtagtagtaagtttgatcagtgcttgctaattgccatagtgttctatgttcaggtcaactcgattgatttattacctcccaaactctcaattctgcttgtctttaatttttcttgaataaattctgaactatggcctgttcttttcttacgaagatttcttacgaagatgaagattctacctcgctttccgttagcacgtttttcaaactgttaaacaatgtatttttgtgtaaaaactttttatatgaaagttatttcaaaatatcaaatatatccattttttaagttcgtaataattaaaactcaattaattatacgctaatagttttcttattttgtgtgcccgtatttaaaccgaatatttatgtgtgttagcaatagcatgatgaatggcaaacagaaggctttattaaaaagtcataaggaaaaaccaggaaagaaaagaaaaatagagtgcaaatataaataataaaagttccaacagaaaaaacacaagcatacaaaaatttaagaaaggttagaaaaaaaatgaaattctaaagtggagaaatataatgcatcggatgagaaaaactcgaaaaggaaaaatcagaaaaactataagagaaggaatctaggatattggtgacaatcgtacgttacaaaagacaggtaataaacaaaaaaaatatggggtaaacatttttatctatattcctagaggtttaattaaaaaaacaaagttatgcaatgagtaaaaggcccagcattaactatgaaattatgcttcaaaatccaaattatttttggttgtaactgatgagctaataagcagtcaacagacgatgaaagacttatggtgaaccacttatttcgtgctgaagtacagtgatagccaccttaaatgtaaactccaaaatagatatcatcacataccacatcataaagaaaggtcatgataactgcttgggatggtagctttgaagttgagccaatttatatgagcatacgtaagtcgccttctattttaatggttacaatctactcaacacttgtattgcgtaactaaaaacatatgtactgcataactaagatgatgcctcttttttctctttatcctcaatttttctctttaggtaaactaggaagaaagcccgcgcagatgcgatgcgtatcttgttaat

SEQ ID NO: 18015 - DNA, 1501 bp, Oryza sativa
gattagatagtcccatgtggtggcttaagagcgtatataggagtgccacatgacgtctttagaatatttgtagaaaggttaatttgtagaaaggttaatggacttttattatataataggtagactgtgccctcgctcggaacgatgccaccaatttccttagcaccgtgagacgttcctaccaaagtccaaaacaacaagctaggtacatcaagcgtgcaagtggcaccatcccctcctatcttctttcatccaatagctactaacatcttaggcaatgtttggctaatgggaaatggaaatgatttcccacccaccaaaaaaaacatctttaaatcctaaccattcattctccctctttcatttaatcctaacccttcattcatttcccaatcccaattccactctctatttcccattatccaaatacactcttagttgaagaccgacaatagcatagttggctcactcctagtaatgagaacaaccaactgcgacagtggcggagtcagggatgtcacgaagcccaaacgagtagtggcgttttctggtaatcgactaatattttcgaatatcataagatatctacagtggagacgtcagcgatggagcccgtgcagccacccgacctgcccggaatctagctcggtctttaatcgcaagtactattgtgtaaagatcagagttgcgaggcaccatcatgtttctacttagtattggatagtaagtagaagctattttcacctttgttgtaggcacggttttcataattaactgtgcgtatcaaatccatatttaacagtttctttggaaaggtactttaaaaggggtacgtgtgccgttaagccttcaaccattagatcaaacatgttttggcgtgagttagggtctgggcggcacccaggcgactgggttgcggcagccttctcctcccatgaaaggaggatctggatggaggttctctccgatctgctcagaaagtctgcggaggtcacgtctgcgatctgtaattgggttggtgatcaggttaatcgtgctggttctggttggatctggccgaatgcttttcgacatcgggcaggatggaggcctatcatgggacaatggaatcctaatccgaggaggagggcggatatgaagtttggtagaattacgcctgttgtcaaattctggtacggcaagttctacaggggtcacaccaaagatatcattgatgtggatctgttttggcgatcaaccgtgaaagaaaaggactcggagctgctggggtataaattcaggtacaaggaagggataaaatcaaaaatatctctcgggtcacagatatctagtgcaggtttcaatctagggttcggtcatctagcccttgtgcttaaggtcatggcggctgccgagggtgggggtgatcaagggactatcaatgcgatagttgcccacccgaagccttccggtgcgtcgtcgttgcccccagggagcaggttggaatctgaactccaagctg

SEQ ID NO: 18016 - DNA, 1501 bp, Oryza sativa
aaatattgcaataaagtgagcataaaattttaagggccattgaagcttgatacaataattagagaattcaactaaaattcccctactcaaacaaatagcttctaacagaaaatcctctgcccttgttaagagacttcctaaaggaaggtatgctttatcaacatactacaataaattaacacttttgagtacttgttgaggaccttgaggcatacatggttactttagattgcaaatgtaccgacaacaaattaacagaatcttatagaaggatggattattctcagatttttttgctgacaactattgctgttaactacaagcaaaataatcattgataatctcaactagagaacaattaatctactctaagggtcagcaaaagataatctcaactaggaatactaccattgctagtaaaagtctgaacgatcaagccaaactggtactaaaatggtaaatgcaatctagcatagattgtagtatgttgagtctaggtgcacatgtgcatttaaaggttgtaaggacattcaagtaagacagagcagagcaatggatgaccaaatatttctttcaatgtaccggataaagcaccacccataggatttcgttgttcctacaaaagataaatgctcattataatggcatctacgttgaaatgttcaggtcgtcgtgactaaaaactatgggtattttacgggaagagttgtgataccttagaatagagagattgatgaaactttctagtttcctccagttgtgagatttcatgtaaaattccatttgcagattttgaggcatctggtgaatttatggtattcaggaacctgtaagggggatccaattatgtcatggtctctgcaaggagaaacataaaaactagaaaaatgttgattgcagataccgtgctatggtggattttgtgaaccaggaagatccttttgcattcccagacaacgacagcttaaaagtgccagctgttgaacacgattggaacttcctagcatcttccaagtgcaggactaattgatcaaaaggaccagatgcaatcaattctgtattccctttactgcaagcaattgcctcgtatctgtagaaaaaaatatttgagagagctgcagggtgaggttcatattttcattaaaggaaattgtgaatcacaaaagacttgagcaatcatcagcacatcatgtacaaaattcccatttcaaacctaacgcagaaaggaaaacggaaagtccattatagaggagaggaataaaatgcatcgtatgtaaatttgttgagcccaattcttggagaaacagataggaacattaaacagctatagccaaaaaatatcttagcaagaatcacctgttctgggctgaggatacttggaagactgcagaatcaagctccacattgctagcaaccgccccctccatgttgcttacaagttacaaccctgacaacggactaattgctcaaatatcaatcacttcctagactacaacttccc

SEQ ID NO: 18017 - DNA, 1501 bp, Oryza sativa
gtcgatcggccgatcctgtctcctcttcaaccctcaaccatattgacgcttctccctctgtctcccttcggtgaacaggtttaaaccttagaacacgcacgaagcaaaagggaaagaagaaagaagacgcgagtgttacgttctaatcagtcactaaatcaacgaagtaatctaatttacttttttttcctacaatgataccgagatctacgatgatataccgatcaatggtttcgaagtaatctaatttactttttttttctacaatgataccgagatctacgatgatatactgatcaatggttggaggtattcaattcactaaaaaatactcatgttttactagttaattactcaattgtcattagttaattactcaattgtcatcatgttacaataattttattttctaccttatccttctcttgatcaacaatacatattattccacctccaagtacctctaaatacctcacaaacaccgtgaaagatctcaataagaatatatatctttatcgatcgttgctggttgtaaaatttagttttttttctaatttctatcagcgtttttataaaattagtaaaaaggaatttattaaaatttaatttttttaaatttctatgagcgtttttatataaaattaataaaaattgatactgttttcaacttccgaccgtcttcgtctccgtggccagtgagcacggccatggccgccgcggcattggcattagtacgttgctagcacatgaggcaaccgcaagccatcagtattaagttgcatatatcgaccagtttaacttaaaagcaaagcttaaactgatgagaaaaggtggataatccactttatattccaataggtatacactgtccagcgataacgtcgccgtcaattaaattgtgccaccggttacaaacatgaaaagcttctcgtagaccttgttaaatcccaagagaaatattaaaactgtgccaccggttacaaacatgacaaacttctcgtagaccttgttccgtaaatcccaagagagagattaaagggcattgaggaaaataattctacattaccataaaaataaaattaattttctctgtttcattcaatctaagggggagagattaacggactgtcctcagcaagaagttaccgacaacagtaaaggccaagccagagcaggaggaaggagacgatgagaaagctgggccgtgtacttaattgggcctcaaccaggccaggcccattttaaccgcgtctctcgtgggcccacattaactgccctgacaacacagcccacacgtggccgtgggccccgacagcccagtccgacgtgtcaccggatagtttccagaaacgtcttcctcctcctcctctctctctcctccccactccgcgcaggcagctgctttgctctgtgctcccttctcgggcctcggtttgctcagatccaccgcgtcgcgccgtcgatccgacgccgatgcggccgccggcgccggcgacgacgg

SEQ ID NO: 18018 - DNA, 1501 bp, Oryza sativa
ctgtttgaaaatactcatggtggaccggaattctcttattcagattgttctcgatgcgatagaacaagtaggtggcattttcgtggtcaccgcagaccatggcaatgcggaggacatggtgaaaagagataaatctggcaaaccgcttcgcgacaaggatggaaatgtccagcccctcacctcacacactttgaatccagtaggctcacttccagatctgctttgctttgcaatacaccgtgttaacaatattaggatgcagttgctgtttaggacctcactttctgaaaccatctgcaggttcccatcgccattggaggccctgggcttcaaccaggggtaagatttcggtcagatctccccagtgccggccttgccaacgttgcggcaacagtcatgaatcttcatggcttcgaggccccagatcactatgagcctacgctgatcgaagttgtcgacaaatgatgactaatttgactacggagtactagtgaatagtagtgactggtgatatactgatatctgctcctcttcgccacgacgagattgtttctctctgtagttcccacgtgttttgagacttggagaaagatgcacagcttctccgtttctggaagggctgcagacaaaccaatgaattcgctttccagttttgctggtggttgcgttgcgtagcaggatgattcctggcagcaaataaatgctatgcgtgtggtaaataaacgctgctactatgctgtattttttgacaatctgttcctctcaggacttgcactttagtactgggcaaagtctttgatgatggtctatgggccccggtaaaatttttcaacttgtcacattgaatgttggatacatgcatagagtattaaatataggaaaaaaaaactaattacacaggttacgtgtaaattacgagacgatttttttaagcctaattgctctatgatctaacaatgtagtgctacaataaaacatttactaatgatgaattaattaagcttaataaattcatctcacagttgaaatctgtaatttgtttagttattagtttatgtttaatactttaaatgtgttttattattagtctatgtttaatattttaaatgcgttttgttattagtttatgtttaatactttaaatatacatacatccgatatgacaagccacaactttttatcctggatctaaacacaccctatgtttatgtttaacagctggtgaggcgatgatgtcctacaaatagctagtaaacgactattctatccatgtgatcttatgcaaagaacaaatcttatacgtctagtttttgttatcccaaagtggttttcagatttccacgctatattttccccctaaaagctggtgtcgttgcaacattgcatttgcacacaggctcattgaacagttacacgacgtcagatcaagttcgggcatcgcaatcggctgtgagcacctcaggctcacgctatgcactttacattagcaccagtttcccta

SEQ ID NO: 18019 - DNA, 1501 bp, Oryza sativa
ttattagtttacgtttaatattttaaatgtgtgttcatatacttttaaaaaaatagctgtggaactaaacacggcctttgtcagttctacggtagttcagcccgtcatgtagtttaaagaccaccggtatgatcgtaactttgtcagaggaggaagagttggtttttatatcacgttcagtttgagcgttgcttttggaagcccagcacgcaaagcggctcgtccaacttttgatgttagcgagggaagggtaaagaacgtgcaaagagcagaaaacgaaatgccgatgatattctatagtggcgagtgcgcctgcagactacactcgatataccgtgggaactacggaaagcggcacacaccgggactacactcgatatgcacacaagtcgcagaccacccccccccccccccccccaatacacagtttgcatgtggagttctgcagtgtggcgtcagggtggcatggcagaaaacgcagatggctggcacggaacttggcaaacaggatggagagacggcaccgtcgtgattccacctgtttttggaacgccaccctcggtttcatgagagatccgcgagccacagattgattgatcagatcagccgtgtcggtgtcggctgggaatccggcaacccgagcggtcggtggcggcgctccccgcgcggctcgccgagagctccgtgtgcgcccgcagccccgcactaccaaaatttgcctcatcatgccacaactcaaattagccaaagtttaacttagttagacattcgtttgtttggtgccacacttttgataagattccttcaccgtgatgtgggtcccacatatcattggcacataaaagtgtggcaagtttactctactatggctaaagtgtggctttaattttgttggccacatgttagacatgttagctaaataaagtatagcaagttttgataatgtgagtatgccaactaaacaacctatacgactacgaccggcgcggtgtgtcggcccggctctcttgatggaaacgggtgggccatctcggcgaacgactcactttgtgtcggcagatcagcgggttcgtcggcccgggttctttatgccctttgggcctctctcgcacatgacgcggcctcgtgttgtgaaaactcagcccgataggacggattataggcctccaatcggcgggattctttctttcttaagatgaaaatttatagaggcaggttcacgaacgtatacatggatgattatcggggtcacacgacatgtgtccgcgtcacactgtcacgtaagctcacaagaaagaactaaacaacgagaagtgcctcttaacacttggacatctctccagctgcctcgtcgcgcccggacacttccagttgcagcataaaaagaagccagacatcctcctcttcctaacttcagcttggctcgcggcgggacgccaccagagaagaggaacaacgtcgaggcagacgaacaacgttttttttttcttctcgatggcgg

SEQ ID NO: 18020 - DNA, 1501 bp, Oryza sativa
attaattttaatttctcatgaagaaagcttgttggtatgtacttgacagggaggttgtggatgtgtgtgttttaaaagaaaaaaacgatctaaccttcgaaaatgaaataatagattcaccaatttaattgaaaatcgatgtgcgaattagagtatcacttgacaatttaggagcgtttgtaaggtgtaacttgccggcttagaaatatttataggctgtttcatggacttttagtatataatagtattttttctaaaatttctaagattttctttaatttaagaatgtcatatagtagcttagaggtgtttataaaatgttgaatggattttaccaccgcacggattttttattaaaaaatatataacaacctaaatgcatcaatttaagtagaaactggtggtcgatgctttgtatttttttctagtactttctccaatttaatagcaccacgtagtgatttagaagtgttcatatgatttttaaagtgacgaagggagagatgctagacctagtagttggtctatttgtgattttctttttgaattgtaaaagtaatttttattttagtcttcttaaaatagaaaataaggaaggaaaagatggatttacatatagtaagtacgttcgtcagtataatctaaaactattacgtacttttgtacgttggtttggatgttggctccggatgtttttttttataaaatagatctaaccatctaaaacaatgggtccactaatttaagtaaaaatagatggttgggtttctcttatttattaggtgtcatttggcgacttttgagtgtttatagggtgccacttgatggtttggaatcgtttataggaagtttgatggacttttagtttaatactccctccgtattgtgggacggaggagtatatataatatataatagatagataatagataatagaaatagatagacagatagataatacagtagatagttttttttcttgctatgaatagtactaccgaagctttatttccttttcaatctcaagtacgtacttatgtttgtatatgtacttatgtttgtatatgtacttatgtttttttaacagttagtatatatacatctaatttaatggtctataatgacgatccaccaatttaaatgaaaatcaatgctgagattatacagtaccacgtagcggcctaacaacatttgttggagcgccacatggtgatttatgagtgtttgtaagatcacaaattaaatatatcatttattttttttaaaagatgaacaattaaagatgattgatttgatatttgatatttatattgtagatctagttttaacaccgcatgtgtatatttatgaagtaatatatttcatctttatactgtagaccgtcgatttttcaatggccctaagtatttatgtttatgttttattttggctttatctttatagtaagtacgtgcatatttttttttcttccggcaaacattatgtacatgagaaagatatt

SEQ ID NO: 18021 - DNA, 1501 bp, Oryza sativa
agctggtcagcaagctcctcaatatccaaagcctcactcttcacatccctcttaggattcggatcactttccccataccctgctctgtcgaaaccaacaatgtagattcccagttcatgcaccagttcctgaatttcgacagacaaactaagcaatcaattcagaaaagcatgaaaaatctaaaagaaaacatggacaaaaaaagatgacttttttttctcaaatctaactgttcgtgatgtttgcatttaccttagaaacctgcaaggggaagtccttggtggaatcaaacgcatggacactgatgatcttgaacttggccttgtctttctgaactccatcttctctgtaagcaagatatcttccatctctgagcttgattcttggagatgtcacaggaggtccaccgggtgagccacacaatttttgaggtggtggccggagaattgcctggaatgccaatccaagcagcacaaccaggagaacgatgagtatccttggaaccatgaccttctcctagatccagttcttgatttcagctcaggtgaggtgatagatggcaatggaggagaagaagcagcagcagcagctatcttccagagttccaggtccctgtggctgtgcaaagcagatgcaatattggctgttgtttactccattggtagtctgtacccatcattgcatggacccattttggtcactttatttgcttctttatttaattgagattctttgcttgagcctgtgatctgtggctgtaagcaacataaactgttgcctctacatggttgtatctagattgagatatttgcttatatcctgtaaatgtttttttttagtgaatcggcaagttgctaatttcaattgaatagaattgaagtaaatttctgtacaggtgttgacatgaaaaagttgtaaaagggttatccttaaacagcaaaacaaatagacactggctcttactagcgcctatgttttgacttctctttaatttttgccaataaaactatagatgagagctcattgtattgaaagattttctcgtttctttccttccaaatctcctaggagcacatgcgttttggcacattctccatgtttgttgtcgcttcccaccattcgtgcactgtcgtggtgtaccgacactccgtttggtctagcttttcgcacgacaatccatgtagcgagcgatctctctgcagatgtaatttgatgttgtgaatgttctgtttttaggctatgtttagatcccaccccgaaattttgcaccctgtcacatcgaacgtttgaacacctgcataaagtattaaatatagactaaaaaaaataactaattgcacagattatgactaatttgcaagacaaatcttttaaacctaattactacatgatttgacagtgtagtactacagtaaatatttgctaatgacggattaattaggcttaataaattcgtctcgctgtttacctacggattctgtaattagttttttttattagt

SEQ ID NO: 18022 - DNA, 1501 bp, Oryza sativa
cagcatcatcgaacatgtattgcctgcaacaatcggttcttcacttctccctgaaactaaggatgcgttcgttgtgatgagttctggaggattgggtgagaaaaggacatcgtattaaacgcgcacgcttcccaaactactaaacgatgtattttttacaaaaattttctatagaaaagttgctttaaaaaatcatattaatcaatttttaaaatttaaaatagttaatactcaattaatcatgtactaatggctcacctcgttttgcgtatcttcccaatccccctcccaaactcaccctaagcctacaaaacatcctaacaacattccttctgtcaatctgtccacacttttttctcccagtgcatgccaaagtcccagcacttgatcatggacataattttgtttaatccccaccaaattgtccacccgtcgacgtaccttagatcacacccctcatcatcactaagctccccatcatcacctttaagaaccctctatggaacaaaccatttcttcctctcttttttttctttagacaccgggaaccaccagtccaccaccaaaattagcatggaagcagcttctccgacgtgaatttctccgtgacatgatcactaatatatggatccgataggatcatgtatcagtaaccacgtcctctaactttacgtcagatgatctcaatctggctagcactagcaccacgtctacgtacgtcgctgccacggtacagggaatctgagtgaggacttgccgtggaacgagggatatgttgatgagacgagggcgcccgcgcgagcgtcttcttcctcctttttttgacccctcgcgcggtggcttccgcggacaccgcgcgcgcgagctcaccacgacaccacccaggcggccgggccaggagcttgcattgctttcaagccaagtcgtcgtcgtcgtctttctctctcacacacacaccacactctgttccactgtgtgtatctctaacctccaagcttatcatgtcatgttggcttcttgaatgcacatcccatcatgaggcgcatcatgctgatgcggttgtggtgctggtagttgccttgcgcgttctttgtctctgtctctctctcccgagctatagctacagctatagccttttcctgagtggccggggcgacctaaaaccgcacctctggtagcagcagcagctcgcacgcagctcatcgtgtcgtctgcatgcatggcggcaccggtgcccggaggctgtgcgaggatgagacgggtggttctcggcgtcgtgctgctgctctcggtgtgcgtccgagcaagccatgccgtgacggatagccaggacagtgagtaccatatgacccaaccatttaatcagctagtgttaagatcgttttgttttctcagtcttgaacgattggatttattgattttgaggagggaaagaacaaatgttctgtatattcttcgatgattggaagggaacaccagaggcgtgtctccatgattgtcc

SEQ ID NO: 18023 - DNA, 1501 bp, Oryza sativa
ggaatttctcatttgtacttttgtatccgatcagatccatccaaaacacatgtatacaacatgatcaatccatgcatctctgaattctattctctattgcattttaatcagttcttgtggatcaggtactcaggtgtttgattctccaatgccaaaagtttatctggttgagttacagtacttttaaggatttgtgattgtgtaactgttgtctacttgacattttaaccgtatattgtaaacagatacattatcttggtttcatttcttaattttgaaggttgtaagttgtatcattttgacaaaatggaccataacttgttgcagaatgttggtattaccatatgcaacattcaaatttcaaagtagtgacttcattctgacattcattcttgatcttttgcaaatttatgtactttgtgggtagtggtatacctaatagcagtgaaaaagatgtaacattgtatgcgagtgagttgatgacattcatgatgccagaacctagatcaagtaatgcttagtattatgtttactaatgtgattactttagtattgcctagtacattctactctgttgattaatgcaatatggtcaggttgtagacacctgcctttcttcgatttggttttcgctctttccagaagtgcactctgaagtagttaaaccgtcattccgtttccgaatatgcttttagctgtgttatataaagaaagcaactaagtgttacatttgtggattctattgtctatgaggtcttcattatttcattgatttgttagaatctagactgatctttttgtgatgattgcatttttgttgtcttataaatgtattcactctcatcatgaactattttcttggactgatttaagtcatatggctcatgctgtctggtagtctggtcactggtattgaaaacattttattactacacttgaaaatactatggactaattctgttaggtgtatcaggaatgacaggaatgcccagtctgtcacaaatttggaatatatgaaacttgattttaccagacagaggaaaaaaaatcttaacaggtactatatttctgcagtcgcccaaactcttactcatttcaagaaacaagtggtttccatgagttttattactatgttagtaccattcaggtactgttttataggattgtattgcatttgattattcttttttaaaatacccattgacctacttaaatttatcttagcattatttctttacctgccttctgtacttgaaagctgaagcaggcattgtgacagctcataaacaaccaaagtgaagctagagacgcaccaaggcttcgtgttttcaattgtcattacccaattcactgttaacaaatagcttaatgtgacagtatggtctgtcatctattgaatggggccaaatttgatattatcggaaataaacttggaaaaaaggactacatagcaatatagcatcttcagtgagagccacaggctcacagctccgagagttat

SEQ ID NO: 18024 - DNA, 1501 bp, Oryza sativa
caatcttactgtatttgttgtttgcctttaccttagaaacaggcaagggtaagtccttggtttcatcaaatgcatgcactgcgattatctacttggccttgtctttttgaactccaccctctttgtaggcgtgccttctatcactgagcttgatcctgggagatgtcacaggaggtccacctggtgagccacacaatttttgaggtggtggatggagaattgcctggaaggccaatccaaccagcacaaccagcaggccaatccttggaaccatttctccctgatcctggcttgctttcaggcaaggggtgccaattgtgaagaagctgtcttacaggtcctgtggaggggaaatcctgcaatgttggatgttctttattctgttggcagtctgttcccatcattatatggaccccttcatgccactttctttccttctttatttattcgagatcttttcttgagcccgtgatctccggctgtaagctacataaactgttacctcgacatggtttatgttgagtcaaatccctgtttctactcggcagatgtaagttgttgcttcgaacgtccttgttgttgatggaaattcagaatcacccactttggatatggagatgaagctgtgatgaaattctggtcggtgaggagacggactgttgccattgccacgcaacacctctgcttccaggttctctacctgacttaattccttgccataatgttccatgcacataaaattttagacctggcgttctttcccctcttttttccatgtaaaatccttatcattttgcatgagcactaattcttctcaactgtacactttgatgcaaggggattggtgccaaacaaatacactcacactttgctgatagatgagaactgtaaagaaggtaactgggcagggtgccagggtctataaggctgtattctgaaatgcatcagaatgatattcatccagattattgattgcacataatgccttgtttaaggatttgatgaagaccagtcaaaaaatgcaattcaatacttggagaatgttgttttgtgccatgtgtacttttttagtggaaatccctgtaagaacatctcatatatgcatatttctgtacaattgttcattatttagctgtgctcaggcagcatatttttgttttcgtcttcaatcagcaaggaagatggagcttggggaacattctcttgagtaaagaagttgggttctttccagacagatagtacattccttctatgttgccttctattttttgtaaatttttttccttggtctcatgttcatgaagaaacagttctccattgatcttctcttttgatgaggtgtaataggaatcccttgatcatgttgagaacatctgggactgagatttggacaacagtatatagggtttctattggtaaaagtcaacaatgattcgttgaaatgattaatgcttgtataagtgacaattttgcatatgcacctggcacatgcattggcttg

SEQ ID NO: 18025 - DNA, 1501 bp, Oryza sativa
tctgaataaactagatagagttacagtcccccctcccatctacatatggtaaaaaaaatttagtggggtcttcgtggcgtctctcatagtcttcaccccagtagtgggggctcgagaccccgccgcccctatactggatccgccactggataagagtaatgtgttttgatggctcatatggttttggtttatggattatagagagaagctaaacaaaaatatattaagggtgtgttcggtagtacgattttcaacttctagttctttatttttcgctcatgttttcctaaaaattaaatggtacataaaaaaatcatacgtagagccatacctatcggaccgggtatccacggataaccaaacccaagggcaaaattgcaaaccctccatgagagactacgaactactaagtactcctaccgctgtgtgaggctttcttctttgtctcctcaatggcgacgagcggtggcagtgaacctcattggccttacagcctctgacaacccccaccacgatcacgatggattataagtgttggaagattagaggtcggcgtaggggtgtcactcacgcgacgaatgcttgggcaatggtcatcgccgccgccgtgatcgtcttggccgcgcttgctcatcaccggtctcgttgtcgtctgggtatggtggcgcgtggtgaaggccaatgccacgacgcctcccgctccccctgtccttgcccctcgggtgacgggggcggtagaggcaaccaaggtctgagctccggcggcgacgagtgctatctaggagtagaaccattgcggtctctgcatttctacttgtgcttgaattcgtattgtggaattagtagtaaaattggctctgcatttctgcaataatgatggcgggagggcgggcgctgcctcgagacggagcgcctatgtgacgacgtcgtcgtcgctgctgccgctccagcacccactccctgcacacagtgcacacagccgaacaagggagagagggaagaggaagaagggaaggagagaggatgacatgtgggcccacatgtcagtggcccataatttttttgaatgataaatgggtccatgtattataatagcataccatatcaatgccacgttggacgaagaccaggtcaataccgccacgtatgcgccacgccagcgaaacaaccctctaaaaacgtaagggagtcaaattacaccggttttaatagttggggctttggggggtcgatatatctggtattgcgattcaaggatacgaatcaaatttggtcattagtttagggagtgaaggtggactttttcctaatgaaaatgggttgcaagaatcatcattattcatgacctttggcccaagtgtggtactcagtttcatctcagtagagtacaaatcgaatgggttaggacgtgaatgttaatatgagcgttgccgtttcatagactgattcaagaaagcagagtcttaaaaatctaactcccacaaatccacgaggaaagata

SEQ ID NO: 18026 - DNA, 1501 bp, Oryza sativa
taagttagccgatcttcgtattgtgaaatggatatgattggtcaggtatgggtttagctaggtgatattttgacaaggcacggatgttgacgcattaacagaggagaatattgccaagcaaattaaatgcaggatatatattaataatggagaatatagagagttctatacttattttttttagaacctaaagatttctttaaaggtttggttttctattcctcttttcagttttatcttgtacggtactattgatgttaatgattcgatagttcaattattttatcttcgatttgaaatgagaaatagattattcaaagttgcaatcaagttgctagagagctataactagataagatcgtacatacaaatcatgagactggtgagagaagcgtttatcaacgtaggattattgtgtggtcagaatggttaacatttctaaatgctatccgaaagctatggttttgcatataataaactatatgtcggtgtaaattagtcaatcttgaatcgaagagagtatggaataatcagatgaaatgcatgcaccgttgaagtctgaataacatacatagcttgtaatattgaacaatccagtagcaacatggttaatctcaatcattttttctttgcaaacaggatcatgtacttcctacaccagtgcatagtaacttgcaagttttgtcaacagccattaacaattgaaaaaaaatagtggtactgatcaatacaacttgaacccaaattcaacatcccattcattatctggggcaaaataaggtttacacatgcatgaaccagaagaaattagacttgcatctgcagtgcatctgggaccagtcacacagagagaaagagaagtcagttccaagatgataagagtgtagagccagggattcctgtggcagactccatgacaaaacaccttcaagtagagacaagacctatacctctctctcctttcctctcttcaaagaagaaaaaaaccagcataggagaaaggaaggacaagatctttccatcaactgtgtgattagcatgccccagaccggaaggtgaagctgctacactttcagatactccatatcaagattcaagagagagctaaagctataggagtgagcagcaatagcaagagccaagaacagctagctactccagctgagagccaagaaccggtcaagctttgcttcttgcacttcttgctagctaaagctactccggtcacttttctgctatagtagctcttggctcttgcttatcacaagagaccacaatcttggtatgtttctttctttgactctctcatcttgaattcttcacatcatctggcgtgtagcatactagcatgtacagtagcagcgatcatgatgttcttttttgttgttctttgtggaggtagatcgaagaaatttgagctagcgcttcgttctgattcttggagatactgggagatcgagctgtggttttgtggctcgtaggatgggagaggctaggagag

SEQ ID NO: 18027 - DNA, 1501 bp, Oryza sativa
tcatgtactaaccgaaaatttcctctgagtttcatcgctcttaaatttctgtgtttttactgcgatataatcaaatgggcatttctattcctttattttctcaatctcaagtttttaaggagcatgtgacatgattggtgagatcctataaaatggtagtattatttatgcacctggattctaaaaggaaaataattaaaacataggagtttcccctttgagaagtctaatccactctttcatcccctctctacttcctttgttttcctcgagtaacttccagtcatgtgctttgatttgcttggaatcgtccaaagacattacctcaatttttcttatgttttaaaatcctgtgtattctaaagagaatgatgttcgtttagggctattgaaaaaaagaggaaaaatataggattttaaccgctactacaagagcaaaacaatgagtttcaaaacctgacaaatcacatagaaatgatagtttgattagactgtagaaaaaaaaacatagaaataaaatgagatagacttgaagaaattttctaagagaatggttaggctcacttttcaataaattctttaaaaatgcgcattccaaagggaacaacatgtttcagtcatttattttgaagaccttaataggaatttttctaataaaattaaaatcctccgatttttctataaatcgaagaagaccttcctttaaaaaaaccttaatatatgctttttagtacgagtactccctccatactcgtattagaagtcgtttagaacaatgtttaagtcaaaccttagaaatatatatcatgaataactctcgagttcttgaatttgaaaatgtaaaaattatattaatatacatatatcatttttcaataaatatttttatagaaaccaaaagtcaaaattatgttttggagaccacgtcgctgtgcaaaacgattttatgagtacagagggaatattcctgtatttccttttacaattatggagtacgtttcgaaacaagtgggccatctcaaacgaaactggtcgtatgtgcacatcaccccaaaaccctcagaaaatttgcgcaccgcccactccaccagtccactcccggcccaagaaagccatgctcaggccagtgtgctcaagaaaggggcgcgcagcgagctcgcgactactcactctcaatcctttgggaaatggagctgctcagtggctcagtggccgcagctccgggaagcggaggctaccgagagcaaccggaccacgccaagaagcactagctagtgtactgcctcctcgatcttgctctatctaccactagcatcgagcttgcttcgctagctcctgtatatttaaggccgtaataagtgtaaacacagcaccaatagtccaacacagatactagtagtagtgtggtaaaagggtgaactgaagaccaagaggcaaaggcgcctgtgaggctgtgactgagaaggtaggagtaggagaagagaagctttgggcgccgcca

SEQ ID NO: 18028 - DNA, 1501 bp, Oryza sativa
taacatcaagaactggatctggagtgaaattatggagcaaccaaacccagctccacctctctagttaatcattttgtgagagcactccagccagcttcactcccattggatggagttgaaactgtttgactggactccagctctcctgggagttggagctctaccaaacatgccctaattatacataacattagtacggacgtctgacagagattaacagttcgagaagttggccaaacaatacctactactcgcgttgccgacccaccttagaagcatccttccacctacttgtactactcgctttgccgacccaccttagaagcatccttccacctacttgtgtccagagtgcagatatatgaggagaatatggacatgatttccacctggacatcccaggagcaactcagcccataaatatggagcacaacctcgatagtatatgaatggtgggtggcactgctcacaggtcgaagcctatcagaaaaaggggggtgtgcactctcatcctacttacgacatggaaaatataggagagaaatcaatgaatgttccaacataagaaactctcgataatcaagctaatagcaaagatcaaggaagaggccaaaaccttagactttggcggaggaaaacatctcttcttgagcttatagcttagctatttcaccatataaagtttccctcttatatatgttctgatcgattttctcctgcgcatacaacaatccaagattttttggcagccaaaacaaagccgccaatattattcgttatcttgatgatcataactagttgataaggatacaactattttattgagggttacgtagaaccgccaagttatatccttggcggctgtagcggtcatgaataaggtatttccttgatacttcctttggtggttgtagcggccatgaataaggtattttcttgataatttccttggcggttcgataacatctaaagtaaagtatattattgtcaatccgaactgacaagtttttatttcttggcgctttcgaaagttggaaatgatcgtaattttcttgttggggagacaaaaaaaaaactctttccataacagttagccgccaataaaatggaattttccttggtctataaacttggcggttggccggcaaaacatgttaccttaacggttttgatgctatccttagtggtttgtgtctgtcaaaagaaaaatcctggattcttgtagtcatgctataatatttaaagaattggcacactcagtgttgcttcgttttctgtacgtgtgtcccgttgtcaattctgttcgttgcaactctgacgacaaaacaagatgtttacagagatagatttgttttttactgcaggaatgtatatatgggctgcaaaggcctataggctttctcgtccatccgcttcaggccttaactcgtactcggcgccggcgtcctcgtatctgcacggcggaaatcgacgccacgcggaggaagaaagcaggaaggta

SEQ ID NO: 18029 - DNA, 1501 bp, Oryza sativa
aacatttaacaacatagattaatatgaaaatatatcactccacaaatatgtaaggtcaaatttagttacaagttgcaataagagaacaataaactattaactaaaatagttaatgtacattcgcagttatatttattataacttataaaagttaaatttaaacttgcatgtttgtggaatgatatatttcatattaatctattttatcaattttttaaaaaatatttaggtgaaatgtaaaaaagagggaatatctactcagagaataaaaacactttcaaaaaaagagtatgaaattatgcgcgtggacaacattatgaaaggaataaagttaagtaggaaacctgaatgcaaacgtggttgcgtggcattggcagcagctcctctcagtccttaccaaccagagcatcatcacctctacatctccattttcacagtactggagatatgttctcaacaacctaaaagtaactttcgctctattgatggaacttaagggggtatttagatctagcggcgtaaagtttggcgtaaagttttgacgtgtcacatcgggtattatatagggtgttgcatagggtattcggacactaataaaaaaaactaattacagaatccgtaggtaaacagcgagacgaatttattaagcctaattaatccgtcattagcaaatatttactgtagtactacactgtcaaatcatgtagtaattaggtttaaaagatttgtcttgcaaattagtcataatctgtgcaattagttattttttttagtctatatttaatactttatgcaggtgttcaaacgttcgatgtgacagggtgcaaaatttcggggtgggatctaaacatagcctaaaaacagaacattcacaacatcaaattacatctgcagagagatcgctcgctacatggattgtcgtgcgaaaagctagaccaaacggagtgtcggtacaccacgacagtgcacgaatggtgggaagcgacaacaaacatggagaatgtgccaaaacgcatgtgctcctaggagatttggaaggaaagaaacgagaaaatctttcaatacaatgagctctcatctatagttttattggcaaaaattaaagagaagtcaaaacataggcgctagtaagagccagtgtctatttgttttgctgtttaaggataacccttttacaactttttcatgtcaacacctgtacagaaatttacttcaattctattcaattgaaattagcaacttgccgattcactaaaaaaaaacatttacaggatataagcaaatatctcaatctagatacaaccatgtagaggcaacagtttatgttgcttacagccacagatcacaggctcaagcaaagaatctcaattaaataaagaagcaaataaagtgaccaaaatgggtccatgcaatgatgggtacagactaccaatggagtaaacaacagccaatattgcatctgctttgcacagccacagggacctggaactctggaagatag

SEQ ID NO: 18030 - DNA, 1501 bp, Oryza sativa
tcaaatataacggactatcaagattggacacgaaaactcataactgcgcttataattggacagagatagtagtacatattaacatgattttcaagctactaaatggtactttttatgtgaaaactttctacatttgatctaaaatataaaataaatctattttttaattttttataatgatctattttattattaaaacagctttgaaaagagtcatcacgttcgctgtgggggctagaaatttccatattaatcggataaaaaggaaaaaaagaaaagaagagtccaagtagaaatacaatttaaaaatagctgaaattcgaaattaaaaataagcaatattgaaagaagtttccatataaaaacccaatatgagattaatcaaaattcaaaataaaaataaaataaaatccaaaattagaaaagagaaggataatccaagtaggaatacaatttaaaaatagctgaaattagaaattaaaaataaagaatattaaaagaagagtccatataagaatccaatacgagattaattaaaattcggaataaaaataaaataaaatccaaaattagaaaaataaaataaaataaaagaagagagctcaagtaggaatacaatttaaaattagctaaaattcggaattaaaaataagcaatattgaaagaagagtccatataagaacccaatacgagattaattagaattcagaataaaaaataaaataatatctaaaattagaaaaattaaaagagagttcaaataggaatacaattttgaaacaattgtaattgaaaatgaaaaattgaagtattaacagaacacaatacgataataattgaaattcgaaaaaaataaaatttgaaattagaaaaagaaaaataatatttcaattagaaatgcaatttataaatgactaaaatttgtgataaaaataatgactattgaaagaaaagacgatctaaaacacatgacgagataaattaagtaacatgcctcggttgatatgataaataaaaactgttagtaaaacaccaaatagaatcctaatgacgattaaaaggagggacgacagtcatgccgtgaaggaaacaagcaaggcggttgccgggacttctagaaagtaaaaaaaataaaccccattgataatcatattcaatttttaaaatctcaatgacaataaaaaatagaagcagcgggtgggggtgtataggagtatagttgcggagccaccgaaggttgacggaacttctagaaaataaaaaatgaatcccaaaaacagttatgtttgatttttagaatcacaatgataataaagagtaggtggcggacgggccgtagaatagcatagtagcatcgtttgaaggtacttctaaaaattataaaaaataaaacccaacaagacaataaactctaaaaactacaaggtccaatttttaaaggttcggaactttaaaaaataaaaaaaaacaatgataatcatgttcgattttaaaatctcaa

SEQ ID NO: 18031 - DNA, 1501 bp, Oryza sativa
gaggaatcgatcgaaacggggagaaaacggcaagggaggagatgatgcgggagaaatggttagaaaattgggggagaaaggcggagatcagaatgagttaataccttcccttcgtgtgctcggtgcggtggacggcgcggaggaggtggcgtggggcacggtgcggtcccggagctcgcagccggaggggtcgacgacggcgacggcggcggcttcaaccctcggaaactgcagcgtgagaaattacggcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctcttccgtagcccaagcagtggacagttactgagtgagtttagcatttgcttgtcagcaaatggaattactggtacacaatgcccataacaaaagctacacaattactggtacaacaacaattactggcacacaacagctaccaattactggtagtccgtaaactactacagtataccagcatctcaaccagataaacatcgcacagcgacgacgtagtacatatcagatgatgaattatccaaacaatatgagcattgttacatatctgacaagccaatgcatgtgccaggtgcatatgcaaaattgtcacttatacaagcattaatcatttcaacgaatcattgttgacttttaccaatagaaaccctatatactgttgtccaaatctcagtcccagatgttctcaacatgatcaagggattcctattacacctcatcaaaagagaagatcaatggagaactgtttcttcatgaacatgagaccaaggaaaaaaatttacaaaaaatagaaggcaacatagaaggaatgtactatctgtctggaaagaacccaacttctttactcaagagaatgttccccaagctccatcttccttgctgattgaagacgaaaacaaaaatatgctgcctgagcacagctaaataatgaacaattgtacagaaatatgcatatatgagatgttcttacagggatttccactaaaaaagtac

SEQ ID NO: 18032 - DNA, 1501 bp, Oryza sativa
ggagcagatccggaggccctcaaggttgggcccgttggatctgtcatcggtgccaccaccctcgccgtcgctgatgaatccactggctggggagaggccggccgttacctgctagggaaaggtgccagcgaagagggagagctggaatgagaggaaacggtgctcgcaagagaaaagaaagagggaggcgtgggcgagagagagaacaggctaagggataaggacgggagagagagggtggctaaaaaaatttctcgtcctgatggtggctcggctcagtttttctaatagatgttggttgttttagaaccgactcctatactacatgtgttggtttttatctagaaccgacacctataatataagtatatatgctattttttttaaaaaaaccaacacctatactatgtgtgtcggtttttatctagatttttgcctgatagaagtgataaatggaaaataggtgttagttttaataaaccgtcacttagagccgtaacctataaggtattttgtagtagtgagggaaacatagggcatttaacatcgactataagctcatgtttttttttctagctcacgtaagatcgaggcaaatctagggcctgtttgggatagttttacattctgagaaacagccaggggcggatccaacgtgggtgcaggggggactcaaaacccatggatacctcaggagcacccccttcgattttttcaccataaatgataaactaaaggtctttaaatagctagaggttgaagaaactgtgtaattgagcctccccaattttttgttcctggatccgcccctggaaacagcgagaggggatttagcttgtgagagtatgaagaatttgggaaaattagcttttgggtgtgtttagttccacggccaaaattagaagtttgactaaaattgaaagtttgaagaaaaaagttggaagtttgtgtgtaggaaagttttgatgtgatggaaaagttggaagtttgaagaaaaagttgggaactaaacaaagactttgtcttctagtttatttgctgaattcaacaactacttgttctcaaaacctaaggccttgttcggttactagggatttaatccccaaggggaatcaatccagggagggattgagtgaatccctctcatgtcactcaatccctgttggggatgaatccctccctacccactaatccccctctcaaatccatgtgttcggtttggtcaagatcaacaatagcaggattggtgctttcctgcttcaacgctgctattgagttgatgttcagcttggcagtttatatgcatcaacttcagagcatcaaatggaggaagcatcaaacatagcaacggaatttgataatatcttatcgtacaaacaaaatatactcagtggagtaattactgtaatctccaatgaacatcaaatgtcacttttgcttttcgtcgaaacatagcattatctaatataagttagaatatcgatcagtcctagcttctaca

SEQ ID NO: 18033 - DNA, 1501 bp, Oryza sativa
atatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgctaccaacttctgtaaaggtgtggtcttagacaactgctattagaaatttagaattttagcatgcttttaaaggttgctacttcatccccctctcctactagttcaactgttgcaacatactgattgcagcagaataaccaaaagtacttcagacccaacaacaatgtgtgcaatgtcagactttagatgagttgctagatctggaaaagacttcatttctaggtagtttggacctctctttttctgggcgtcagattcacttctattctattagatagcttttaaattcaatccaagatgttctggcactggaagtgtagattctgttccaacttttagctactcattaactttagaactgtaaaatcaacccttttatcaatcgaaggcactcttttcgaaatgaagggcttc

SEQ ID NO: 18034 - DNA, 1501 bp, Oryza sativa
taattccattgtctagattaacaatgttcagttctaacacctacaattccttgtcgcaggcaactcttatcttgtggattctggactatcttctgacctgacctgcctgtgttaatttgaatgtgtatcctgtagtgtgatcctccctgtcaatgtccccaatgaatcctacgttcattttaatttggaatgcaagggggcttgacaagattgctaaacgcaactatgtgctgaattgctgatattgtttgttatcaagagaagagaccaaaaatttgtatagctatttttttatcattaatttcatgcctcctcccggtgcttggaaaataaaggctcgagttgtcaggcgaacaatcagcatgttgatacgacataccagcattcgttgaatgaatttatcagcaaaacatgttgcgaataagaaagacagaaacttgttagttatatttgtttagtgaaagggatatacataacttgaattgaaatacagatacacgcagagcaaactcctgcaaaatttgtgtttgagcctttcaccgtcctggactcaaaccatgaaagcccaaacaagacgttgtattggcctccgactcgctgctccctcggcctcgactcctcggcccgccgcctgcgccgacctccaatctcgcgaccagcggcgccggcgtcctcgccgccggccggtgagcgcctcatttttctctctttcccataacattacattctctacttgttgatctgggagcttttctctctgccttaaccttgagtattatttatgctgatagcatatgcaatttgtttgcagaaaaaaataacttggggctataggttcgcccctctggtgcctatcgtttttaaccatgggttagttgatctgttctcaaaaaaaaaaaaagtatctttgcccctcggtgggttccctctgattgatactttcgttttgctcaatcggttgctgtttccttgagttccttcttaatttttccccttgttccaatccatatcaatatctgggatatatatttttagataatggtctgggatatatatggactattattgtaactattatcaatatatatatattgagtaagtctctgtgcttggttgcgttgcagttggatccattgcttcaatgaatactagaaaagggctcgggcttgccctctagtcaacaagatggtgatgattctcaagctgtcaaagcaacaattccagaccttcctgaggtacgtagggcggcatgaaattctgacctttctgatacattccactgcactatcaattaattatcaactcttgtaaatctgcatatcacttgcaattaatcatgccaaaaggtatacctgggtagaatataaccctcctactccatgtggtacttctgtttttctttctactgtccaagtaaccatttggctctttcggcattgaactctactcgcatatgctcgtatgcaggacatctggtgccatgtacattccctaatgccac

SEQ ID NO: 18035 - DNA, 1501 bp, Oryza sativa
tgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaagtttttgctgttctttttttttttccaaatggatttgcatggttgcttttgactacactgccctaacctcttgggaaagttggctcactaggttgtgtgcttttgttcttggtcagagaaagagagagagagatgatgttgtgagtacgtacgagtggtgtgtccatggtgagaggtggtggtggttgcagtttgttgagccctcctcctgagtgtggcaacctgatgaacaagagcttcttctagctctccaaaataggcagcgccacctcctcctcctcctccttgctcgctgtcagtgtcaggccaatgcaaattaagaagggaaattaaaacatgtaacatgagatcaacaacttgttgggaataaatttgttgaccagaatgatctgaagaaatattcatgaagaacagtaatgagaaa

SEQ ID NO: 18036 - DNA, 1501 bp, Oryza sativa
ggaccatctttaccccttcttacatgcatatgtttaatcaagaagaaaagacaaagagaatccttgcctcaaaattccttatcaatctagctattatatacccctctatctctctctaatatacatatataagctaggactgctcttgttgtccatgaatacatacataaacttattcaagagatccaaaatggtaaattcatgcatgcatcattctttgttctgcatgcagctagaaaacgctgccttcaggtatgctctgcagggtaggctgccacactgatccgcagctctcctgctggtgcagcagctcatctgcttcagcttgtttttgcatgagagacaccatgtcgttcagggagatggcggcggcgtcgttgtgcagcagcatcttcttcagctcctgctttctgaccaccagcttcaccctcacgacggcgccgccgggtgggtcgtcagccatgtcggccgtcgccggccggagtgcctcgtcgtcgtcgtcggaggagacgccgttgaggggtggcggcggcggcggcagcttcaggatctcgccgtcgacgtccatgctcatgatcttgatctccctgttcctatcttgaatcaccatgcaattccccatgatgatacgacgacgaagacgagttttgcaaggagatttgggatgatgaaattacgaggtagctagcacgaccgaatgatcgatcgatcacaattcacaagttagaaatgtgtgtgtggtgtagtatttcttggcgaaagagtagggggttggaggggaggagttatgtgtggtatttaaaggaattgtattaggaggatagccacaaactttggagcatacttcatctctgtgccattggactagccaagtgagctttgcttacttcatgtcatgcctcaccaaaagcaagatatagccactgagaaagtgagaattagtgaaatcgaccagccatttcttttttttttgtctctatcttgttgtcgtccttgactgttgcatgctgatttgcatcagggcggttccgtgaaattcgaggccggttgcgcacgtcaaacatctcggaataaacttgatgtgcattttcagctagattttactattattgtcttttcagtcttattctagtctactataaccttaattttaagtactatgatgttgttgaattttctatatatgtttaacaatttgtcttactaaaaaatattaaaaaaatataaaagtcatgcttgaagtgtctataataataaaactagccacagtaaaacaaataatatttacatatttgtttgataagagaatgatcaaatatatgtccaaaagacaacgacgttatatgttaaaaatagagggagtatatatttttttataataaacaagataaaaaaggtatagaagttattaaataaccgttgaattaatggagcaaatcgactgtaaactacaccgacacttatatttatgacaacaaatgcttcttcctagtgccaggca

SEQ ID NO: 18037 - DNA, 1501 bp, Oryza sativa
tcatacacatactttcaattgtattacacctagggttaaaatcttaacgttaaattcattatattttagccgtaacaaaaaaacaaaaaatctgattgttttaaggttgcaattttgtcagaattttatcttttttgttattctctatgtagaatgaatttgaagatgtgactttgcacgtagatgtaatactattgaaagtacatgtattaattttttgtgataatttttagttgctgtacacggtgtgtacatgcgagggtctgtgtgcataggatacgctcccatctatctgtccgttggaagcagatatcgcagtgtatttggttggcttacgctttctgtattactacacgatgattccatccataattgccttcgtgcgcatggctggtttgtttcacctcaatctcgagatgatccgtgtgttgaacaataactaagcttatcgggctgtcatgtttgctaactttttttttattaatcgtccgcaaataatccacaagggcgtctaatatgcgataatgcgaagttgcaaaccaactcgcttgtcctcgcgttcgttcaggaacattagtacgctattttgatctactccctccttttccctaaatgttttttcccctaaatgtttgataccgttgacttttttaaacatgtttgaccgttcgtcttatttaaaaacttttgtgaaatgtgtaaaactatatgtatacataaaagtatatttaataataaatcaaatgataggaacaaaattattaattgtttcctgcatttgcttttaagacttgattaatgatgtacttaagtaaacccttaattctgaacatgaaaaaaagaagcgctttacaatgcaaaaagaaagaaaaatctatatttatagccgcgccgacttcaaatgtcttacttcctccgtttcacaatgtaagtcattctagcatttcctacattcatattgatactaatgaatctagacatatatctatctagattcattaacatcaatatgaatgtgagaaatgctagaataacttacattgtgaaacggagggagtattgtttgacttatgattataaaatttgaattttagaactaaattttgaatttgatttgtttgtttttttcatcgtagtttatttcacaacatttgtttttaaatcgctaaggacacgtatataacaattttccttaaaaataagcgattcggataagcatatgaataagagaaacaatggggctgcaaatgactccaccccttcaaccatatctatgggcatgttcagattgatgacatttccaaccatagcattatttggtaaaattgacaattatgtagctacgtttagtttgttaccaaatattgacaatgtgtatataattttggcaacattaataagccaattctaccaaaactttggcaatgttgacaatttgctaaaattttggtaaagtttatttcgacaccaatctaaacagaccctatataagagtatacta

SEQ ID NO: 18038 - DNA, 1501 bp, Oryza sativa
aagagatccatgtcagcatatttttctacttggaagatattaaatgaagagagagagagcgaagctatctactaacatagagatagtctatagagaaaaacgaggcaatgcatgagagagctatagatacccatgtagacatactattgaggtggtttactattaatctagtatattgctgagatgtacatgttttatagagaacactttactttaccatcgcgggtgctctaatgactccgtctaactgtaaactgtttgtccacgtattccgtataaaaacggttaaaaaaaaggaagcagagggttggtttggtttgtggtctaaataggccttaccaaattttattagtaccaaaatttggcaagttttggcatgactaattttggtaaggcaaagttgtgtttggattgaagccaaaatagcctaagttcactattgaaatggcctattttcttaggcatgccaaaatttggcttcaaaccaaatagacactaaacactattgaaattgccaaaaattggtaagcctaatttaggccacaaaccaaaccagcccagagtcgggggttgctagttggcgcgcgcaccagctgctcccggcctaaggcccatcagcccttttttttcgcgatttgttttttctttttcttttgcgattgttttcggtttttttcgttttctttcttattactttttttaatctttagcacacttatttttttataaaatgttttgagttgaaagtttttaaatcttaacttgaaaatttttaaatttgatttgaaagtattcaaatctcgagttgaaagtttttgaatctgagttgtaagttttcaaatttgagttgaaagttttcgaatcggagtcaaaagttttcgaattttgagttgaaagtttttaaatctgagtcgaaagttttcatattttttcaaatcttaacttaaaaattttcaaatctgtaattgaaagtttttaaatctcgagttgaaagttttcgaatctgagttaaaagtttttgaatctcaagttaaaattttttaaatctgagttgaaagttttcaaatatgagttgaaagttttcaagtcgaagttgaaagatttcaagttgaagttgaaagttttcaagttagagttaaaagtattcaaatctgggttgaaagtttacacatatatggaaaaattcggaaaaaaaaaataaccgtgtcttgccgtctattgggccgtgtgggccggcgcgtgcgcgccaattagcattcctgcacagagtccacgtctgcggtgaagaaaaaaaaaagagagacagaggaaacaggagggtgacgtggacagaacggatgacgggatggcggtagacgtggcgcgacggccatcggctactccgcatcccctctccgccactcctcgcccgcctctccccccaaccaaaaacccaaccccgacgacccacgccgccacttctccacgctctctctctcgcgcgcgcaaatggcgtcgtcga

SEQ ID NO: 18039 - DNA, 1501 bp, Oryza sativa
agtgcactgtatctactaatttctgaacagcacaaccacgcaacctctgacaattaatcgaggaattagttcgcttaatctaaccaaagaagcttacgcttatcggaacgcgcgaaatctcgctgtgctcggacaccaccgtgcttccgccgccggagctgttcagctgcactcggaatgcacagagcaagacaaattagatcgggataagcgtggggagcaggtaggaaggggtactagtgcaacaccaccaggggggcatgaggggagcggcggcgagaggaagcgagggccgggtgatcgatgagcggcggcggggagacgtagagcagcgcgacggcggcgaggaggaagagcaggagcgccgccgccggcagcagggccgggcgcgggcacttgttgtggcctccgccgccgcgccgtcgaggctgggccatcctccggagcccggagatctcaggctaggctagggaggtagtgccgcgacggcagcggcggcggtggtggtggggtggtcgccgagacggcggcgacatgggagacttgtggaatttcgatgagtgggtttgaactttcgagaaggtgatactgttccagtgtacggcagtgcagtattaaattaaactggatttccgtattgcaaattttgtactaattttcaaattcttttccttttttcatagcacatataactgtaacgattaaacgatgcaatttgaatacaagatatttcatctaaaaaaggatacaggtatttattgtcgatttctgtaggaattgagacttttgtgtacatttgtaaaggagatgtattcacattagctagtacaaattggtcgaaatttttctgtaatcctccggttaaaacttgccctttaatggagtaattgaagcacgaatttctctaccatcattgatgacacatggaggaaacgtgaatgtctgcgtgtgttcgggttggattgggatttggtgacattctcccgtgacaccgagggattcggtgacattctcccgtgacattctcatttgatgtcaccgaatcccaatccgttcaggattttggcgacagatgggaccagactaaaaaaaacaagcaaaatgttgatttgttttttttcattaaaaaaggttgatcattttctaaaacaaatttatcccttcgtttcaaaatgattttttagtacgtgtttgaccattcgtcttattaaaaaaattaagtaattatttattattttcatatcatttgatttattgttaaatatactttcatatatacatatagttttacatatttcacaaatttttttaataagacgaacggtcaaacatgtgctaaaaaaatcaacggagtcaaatattttgaaacggagggggtatcagcgaacacatatgatttaaaaagaaactgtcgacaaaatcttcgcgaaaaagaaatgctgaaagcatgtgagcctgccgtcctgaacgcatgacaagttcgtaggtggctcatgcccaa

SEQ ID NO: 18040 - DNA, 1262 bp, Oryza sativa
aagcattccaagaagactttgaagaaggttgtgtcagacaaggaggagtgcaggatagtcaagctcttgagcgaggctagagagaacactacatctctattcgagtcaacaatgcacctcttgtcgaagcaaatcgagatgccaaaattgtccctcatctccagggcattccagaagaaaaacacaatgatttgcaatgatgagcagttgcaggtgttagagtgctgcatcggggaccttgaggctggagcaggacttctgttcaggagattggtccagagcagggttactctcctgaacattcttagcttatagatattcctcaagatctgaaactcttaagaccttgtgattggcatccgtcttttaaaggatttgctgatccttaccatttgtatatgttataggcttactgtacagaaaagaaaacatacatgaaagagagttttgatctaattctttccatcccctgagtcctcacgtatctctgaggtacatcatgtgattatgcaagcgatattattaatgtctttgtgatgaatataaatcgcacaacatggcaaatgaattataaaatatatgtgccacataaacgaaaatcttttcattttttttgctggcaaattgatctgtgatgtgccatagggctatcaaatggccatgtgggtcatgccactctgataccatttgttgcctcattagcaagcaaaggatctttatgcagtagatcttgctgccacagctacaacaggccagctcccatacacgaggatgagcgtgcaaactgcattaattgcacataatataacagtagttggaattaacaaaagcataaaaagatagatagtgcacgtatcagcaataccacggtggtagcaataaattaaaataatcctggagagcatgcaattatgtcaagatccacaagtagagtgaactaacctgctggttcttgctgccgatagttgagacatgacaatgtgatatctcccttggaagaaagatggcagtgcattaaaaattagaacaacacacaagagattccatatgctgtttaatgttgctgccagatctcaaacaatgatagacagcgtcagggagctgaactggaaggattctttttgtctaccatccaaatgatgctgtgtatagcacatccactgaataaataggtctcagcacaaagctagacacatcaaaccataagtttcctttccttctcatctattggattcaacacaaagaggcaacatttttagcaa

SEQ ID NO: 18041 - DNA, 1501 bp, Oryza sativa
agcctcgcatgccaactctcaactagagatcgatgaacacactacacaagcgtgcaggatttatacatctgctcgctggagaggagacagggcagtcatccagtcgtacgccgagcggccaagaaggcacagagacacatcaggaggatcaccggcggtggcagcagcaagcctgcagcttctgaagccagagagatcgccgtcgcagcgctcgaaacagcagcagcaaagctcttgccgaagcagatcgccaccatgtcgagttcaagcaggtggtcccagctcgtctccaagaagaagagagatgcctcctgcgaggagagcagttgcaggtgttggagttggacattgctggtcttaacaacggtgttgaggttctcttcaggagactcatccagagcagggtctcccttctcaacacactgacactggtagatgatgagatagatcatagatcatgcaaacactagctcctttgtgatctgcgtccgccttttagaggatctgctgatcatgaaacaattttgccatgagtacaatgagacaaaatgatgaattgtacagtcattttgagaaaagaattcttgttggtccatgttctcttgtcgattcactgtatgtactttgatgagaactttattccatgcctatgacatcaggcctagtacaagattatgttcacttggcaaagtattttcttttccaagaagtgccactatgaaaacaggatagacgaagatccctttttttagataataatgggataaacgtagattcatgctgacatacacaaacttgatttaccaatagcgtgctgtagaccagcttgtaattagcataaccagtgcccaataaaacaatacttaacaaccattaacacgaatggaaccactaactagtcagcctgcttactccattaaacaagtgttagagcatgcgtgcacacctgtgattgtgaggacccagcaatgaactgccaagctgattctttgtcccaacaactggaacatcacaatgtgataagcctagttaggagcacctaatgcatcggaagaaaattgcacagcatgtggatcatcttgaggttgcaacaaccagatgctaaatgccctggtagagacatgccagcaatgatgcacgggtggtcagaacaagataagcatggcgtgttgcattggaacctggatgggaagtcaaccatagttttttcttccagaaagaatcatcaggcagcagccagcttcatttctctcatcatttaactgcgtgctcacctcgcatcttgatctgaatctgacattaaactaaccactcgtgcagatgagtttgccgctgataattcagacatgacaggcttgttatgctcaaatgtgagagttagaaatgcctcttatattgaggagacataaaaaagcatcagtttgtcttggagatgggtggctttgttgcagcagcacaaccatcaatattgatgagattctttctgttgcttctgtttctt

SEQ ID NO: 18042 - DNA, 1501 bp, Oryza sativa
atccaggacatgcagttggctatcaagagagccgatgatgccgctgttcaagccaaggtccagtccttcatccgtctgaccaagaaggcacaaaagcagtcgaagaagattagcaagaagtctgcttcagatgatcaggagggatgcagggtgctcaagctgtcagctgaagctagagaggttgcaatttcaatggttgagtcctcgttgcatctcttgttgaagcagattgtgatgccgaattctagcaggtggtctcttgtatccaaggctttccagaaggcaaggattgcatgccaggaggagcaattgcaggcgctggagttggacatcagtgatctcgagagcggagttgagactttattcaggagattgatccagagcagagtttctcttctgaatgctctgagcttgtagatgatacaccaactcttgttctttgtgatccgcgtccatcttttagaggatttgctgatcatcaaaacaattttgagaagtgtatatacacaataggtactgacaaaatgtacaagaatactgaaaagaaaaaaaattatctatgttcagttgtcaactttactgtcttagctttctgcatgaccataaatcccttccagaaaatcttatttatcctcacttagaatggccaaactatcacttgtattttggagttcttatgttaaagttcacttagaggtaaaaacataacttataaacaagatgctcaccattactggttgttgtagaaataatagtacagaaagtttgaaatttccttctgaagctgcaccctttcctataaaataatgagatggttgtgcttttctcatccacaggaagtttatagtacagtccatcttgctgtcatgactaatagcacactagcagataattagcataattgtccaataaaccaactatctaacagttaatataacacatcgaacccataccactttcccagcattctccattaaacaaatggtagctcatgcatttatgtgaatgcgcagcactagagtaagctgacatgctgattcttgatcccatgaactgaaacatcacaatgtgatcggcctagttaggagcacctaatgcataacagaaaattgcacagcatgtggatcatcttgagattgcaacagccagatgttaaatgcactagaagaaacatgccagcgatgatacacgggtgatcagcacaaggtgaagtcaactagttcttccttacaccaagaatcatcaatcagctccttatctcatcatttcactgcatactcacagatctcaatacatcaatctggatttgacattaaactactcactcgtgcagaagagcttgtcattgacaatgcagacatgacaggctgatcatgaactcaaatattaagagtgcaccgaagggacataaaaaaacatctctttgtcatggagatgggtagctttgtaccagctgcatagctttcattatggatgagattcttgctgttgcttctatttc

SEQ ID NO: 18043 - DNA, 1501 bp, Oryza sativa
caatgcttatttcgttatagataagagataaaccgtaggcaggtctacaccattgcaaaacagtttctctactctttctctcccattatcagcaaaaggagagcattgtggcttcagctaaaaccatggcattccacctcagatctgcaagcatgtcttcaagtcctcgctccggagaaaccaacattgaaaaatagatgcagagctcgatggtgatcatctcttcaccctctgcaactgtcgaaacaatcttcagtgacctcaagatgattgaatgagtgtacaaaaaatattgaggtaatcgtgcataccaagcaaccaattcatctttcatcagaatcagaaaaggaaagccatggagcaagagctcgaggattcccttgtgctcctcgatcttttgcaaagccatccaagagatttttttctgagctcaagacaagcattaagaagatgcaaaaaaatccaatcgttcatccatttgaccaagaaggcgcgaaagaaatacaagaagttcaggaagaagtatgcttcagctggctaggggagctgcagggtgaagctagagaggtttatatctcaatgattgagtccttattgcatctcccatcaaagcaaattgagataccaacttctagcaagtagtttttgtctccaagacattgcaaaagaaaagagttttatgcaacgaggaaccactatagacataggagttgaacattattgatcaggaggttgttccagagcaaagtttcacttttcaatgctctaagcttgtagatagattataccaattcttatcccagatgattagttcccagcttttataggatttgctgataatcatgtgtaaatgaaaaggaattgtacagaaatttactcaatgagaaacaaaaaaaaaaatcatttaatttcctgctatttatttaactgtttaagcatgctttgatgcatagcaacgtatgggaccagatcattcagataaaattcaaaagtaatataataatttactcagatggtgatattattattgactgttatagaagtaattagcagtttagcacacgtgtgcagtggatctagttatccatagctaacaagtcagctccaagcctccaatgcacgaggttgagggcgcaagcagcatgtaatttgcagtataaagtacctctgataatatcagttatacaacaactaaatagcaagcatgatgccaataatacgctgtttaaactccattaaaaaaaacgttttgtgcatgcaatcatgtcaagatccactaacagagtgagctaacctgccgattcttgctgctaatagtagggacatcacaatgtgatagctcatttggaagataaatggcagtgtattaaacaattgaacagcacaccaaagattccatatgttgttgccagatctcaaacaatgatagacagcatctgggagctcaactggcaggattctgtttgtctaccatacaaaggatgctgtgtcttgcacacca

SEQ ID NO: 18044 - DNA, 1501 bp, Oryza sativa
ctccattgaggagaccatgtgcctgcctagcaaccaagtttgctcatcacagcaaaggaagttgtttgacagagagatggaatactcccttgagctactggatctctgcaacactatgaacgaggtcttcaccgagttgaagtccatcatccaagatctgcaagtgtctctcagaaaaggagatgatgcagttgttcaagccaagatccagtcatacatccggctggtgaagaaggcaaagaagcattccaagaagactgtgaagaaggttgcctcagacaaggaggactccaagatggtcaagctgttgagcaatgctagagagatcactacctctctattcgagtcaacattggacctcttgtctaagcaaattgcgatgccaaaattctctctcatctccaaggcattccagaagaaaaatgcggtgatctgcaatgaggagcagttgcaggtgttagagtgctgcatcgcagatcttgaggcaggagcaggactgctgttcaggagattggtccagaccagggttactctcctcaacattcttggctcatagatactcctcaatatgtgacactcttaagaccctgcgattggcatccgtattttaaaggatttgctgatccttcccatttgtatttattataggcttactgtacagaaaagaaaacatacatgaaagagacaaagttttgatctaactcttgttgtgcactcggttcagacatatctctgagatacatgatgtgattatgcaagcgatattagtattattgccttgttatcgaatacacatagcaacggctcatgaattatgaaacatatgttccacacaagcaaaattattttcttttcttttttgcagtcaaattgatctgtgatgtgccatagggccatgaaatggccatatgggctgtgtcactctgataccatttgtagcctcactagcaagcaaaggatccatgtatagtggatcttgctgctgcagttagaataggccagctccaatacacgaggttaagcatgtgagcagcaggtattgtacataatagagcacttgtagcaagcaaaggatccgtgtgcagtggatcttgctgccacagctaaaacagtccagctaccatacatgaggttgagcgtgcaagtaccactgattgcacaaaatagaacacatgttgaaattaacaagagcataaaaaaagataaaacacatataaaaaataccactctggaagcaatcaattaaaataatgccttgagtgcatgcaattatgtagagtgaactaacctgctgtttcttcctgccaacagttgagacatgacaatgtgataagtccttggaaggtagatggcagtatattaaagtattgaacatacgagagatcccatatgctgtttattgctgctgccagacctccacccattgtggacagcatcaggaagctgaactggcaggattctgtttgtctaccaaccagatgatgctttttcttgcacatca

SEQ ID NO: 18045 - DNA, 1501 bp, Oryza sativa
ggtttgaggaggcttggtgatatatatagctccattgaggagatcatgtgcctacctagcaaccaagtttgctcatcacagcaaaggaagttgtttgacagagagatggaatgctcccttgagctactagatctctgcaacgctatgaacgaggtcttcaccgagttgaagtccatcatccaagatctgcaagtgtctctcagaaaaggagatgatgcagttgttcaagccaagatcctgtcatacatccggctggtgaagaaggcaaagaagcattccaagaagactgtgaagaaggttgcctcagacatggaggactccaagaaggtcaagctgttgagcaacgctagacagatcactacctctctatttgaatcaacactggacctcttgtcaaagcaaattgtgttgccaaaattgtctctcatctccaaggcgttccagaagaagaactcggtgatctgcaatgaggagcagttgcaggcattagagtgctgcatcggagatcttgaggctggagcagtacttctgttcaggagattggtccagagcagggttactctcctcaacattcttagctcatagatgagtcaagatctgacactcttaagaccctgcgatcggcatctgtcttttaaaggatttgctgatccttcccatttgtatatgttataggctcactgtacagaaaagaaaacacacatgaaagagacaaaattttgatctaattcttgccctgcactcagtcctgacatatctctgagatacatgatgtgattatgcaagcgatatcaatattattgcctttgtgattaatatactttgcatgacaagggcatggcacatgaattatgaaatatatgtaacgatattactttgatttcttttctttttacagtcaaattgatctatggtataccatggggcaatgaaatggccaagtgggtcatgtcactacgatgacatttgttgcctcactagcaagcaaaggatccatgtaaagtggatcttgctgctgcagctaaaacaagccaactacaatacatgagattaagcgtgcaggcagcatggatctagctgcagcagctaaaacacgccagctaccaaacacgggactaagcgtgcaagagcctctgattgcacataatagaacaatcagttgttaacaagagcataaaaaatagataacacatgtaataacaataacactgttgtagcaatcaattaaaataatcccttgagagcatgcaattatgccaaaaaccacaggtagagctaactaacctgttggttcttgctgctgatagttgagacatgacaatgtgataactctcttggaagatagatgccagtacattaaaaatgagaacagaacacgagagattccatatgctgtttattgctgctgccagatctcataccatgatagacagcatcagggagctgaactggaatgattctgtttgtctaccaaccaaatggtgctgtgtctagcacatcc

SEQ ID NO: 18046 - DNA, 1501 bp, Oryza sativa
atcaattagcttgccttctaggcctctctccaaagttgaagatgagttgcacagcatagaggcatgcatctcatcaccctccacgaccatcgaggtggtctctgatggtttgaggcggcttggggacatctacagctccattgtggagatcatgtgcctgcctagcaaccaaatttgctcatcccaacagaggaggttgttggatggagaaatggaatgctcccttcagctactggatctctgcaactctatgagtgaggtcttcaccgagttgaaggtcatcatccaagatctgcaagtacatctcagaaaaggagatggtgcagttgttcaagccaagatccagtcattcatccgcttgatgaagaacgcgaagaagcattccaagaagactgtgaagaaggttgtctcagacaacgactgcaggatagtgaagctgatgagcgaggctagagagatcactacctcactattcgagtcaatattgtacctcttgtcaaagcaaattacaatgccaaaatcatctctcatccccaaggcattccagaagaaaaacctggtgatttgcaatgaggagcagttgcaggcattagagtgctgcatcggagatcttgaggctggagcaggacttctgttcaggagattgatccagaccagggttactctcctcaacattcttagctcatagatactcctcaagatctgacactcttaagaccctgcgattggcatccgtcttttaaaggatttgctgatccttcccatttgtatatgttataggcttactgtacagcaaagaaaatacatgaaaagagacaaagttttgatccaattcttgtcgtgcacttgatcctcgcgtgttgcagagttacatgatgggttatgcaattcaatgtcaatataattgccatggcatatgacttatgaaatatatgggcaagttagcgatattactttcatttcttttatttcttacaggcaaattgatatatgatgcgccatagggctatgaaaaatggccatgtgggtcatgccagtctgatgccgtttgttgcctcactagcaagcaactgatccatgtaaagtggatcttgctgctgcaggtaaaacaggccagctccaatacacaaggttaagcgtgtaagcggcatggattgtacacaatagaacacttgttgaaattaacaaaagcattaaaaaatagataacacacttggcaataataatactctggtaacactttattaaaataatcccttgataacatgcaataatgccaaaatccaccggtagactgaacaaacctgctggcttttgctgccaatagttgggacatgacaatgtgatagctgacttggaagatagacgcagtgcattaaaatattgagcatacaagactatatgctgcagccagatctcaaaccatgatagatagcatcgggaggtgaactggcaggattctgtttgtctaccatccaattgatgctgtgtgttgcacatc

SEQ ID NO: 18047 - DNA, 1501 bp, Oryza sativa
ttcatattgatgttaatgaatctagatagatatatgtctagattcattagtatcaatatgaatgtaggaaatgctagaatgacttacattgtgaaacggaggaagtaagacatttgaagtcggcgcggctataaatatagatttttctttctttttgcattgtaaagcgcttctttttttcatgttcagaattaagggtttacttaagtacatcattaatcaagtcttaaaagcaaatgcaggaaacaattaataattttgttcctatcatttgatttattattaaatatacttttatgtatacatatagttttacacatttcacaaaagtttttaaataagacgaacggtcaaacatgtttaaaaaagtcaacggtatcaaacatttaggggaaaaaacatttagggaaaaggagggagtagatcaaaatagcgtactaatgttcctgaacgaacgcgaggacaagcgagttggtttgcaacttcgcattatcgcatattagacgcccttgtggattatttgcggacgattaataaaaaaaaagttagcaaacatgacagcccgataagcttagttattgttcaacacacggatcatctcgagattgaggtgaaacaaaccagccatgcgcacgaaggcaattatggatggaatcatcgtgtagtaatacagaaagcgtaagccaaccaaatacactgcgatatctgcttccaacggacagatagatgggagcgtatcctatgcacacagaccctcgcatgtacacaccgtgtacagcaactaaaaattatcacaaaaaattaatacatgtactttcaatagtattacatctacgtgcaaagtcacatcttcaaattcattctacatagagaataacaaaaaagataaaattctgacaaaattgcaaccttaaaacaatcagattttttgtttttttgttacggctaaaatataatgaatttaacgttaagattttaaccctaggtgtaatacaattgaaagtatgtgtatgattttttctaaattttttattgacattttttagttggtgtgcacgtgtgtacacgtgagggcctgtgtgtataggatatgtttccaagatagatatgcacacgaggcaaagtcaaactctttgcacggttgcaacagcaaccacagctcatctcttctcactgcattgcattggcattgcttgctcatcacagatctcacacgatctggacctggcattaaactgaagtttcacgcgctcgtgcagatgagtgtttgtctccagtttcaggtgagacatgacagctagtcatctactagtattatctcacaagttcattcaatcagtagagatgctgcctcttgcatcgagcaaagcatataatgatagagattaaagaaacagaaacctgttgcttctgtagttctgttgcagcacaagtgatcgtcaattatcaatgagattctttctgtctgctggtccagcaatgagacctgcttctccttcct

SEQ ID NO: 18048 - DNA, 1501 bp, Oryza sativa
gcctgaccaagaaggcgcagaaacagttcaagaagatcaacaagaagtctgcttcagaagaccaggagggttgcagggtggtcaagctgctggctgatgccagagagatcgctctctcggtgcttgaatcaactttgcacctcctgtcaaagcagattgcgatgccaagtcaaagcaagtggtctcttgtctccaaggcattccagaagacaagggttacatgccaggaggagcaattacaggcgttggagttggacatcgttgatcttgagagcggagttgagactttgttcaggagattgatccagagcagagtttctcttttgaatgctcttagcttgtagatagatcatacaccaactctgatcccctgtgattggcgtccgccttttagaggatttgctgatcattgaaacaatttttggatgtatagtagtgtacataaatgagaggaaatgtacagaattcactcgaatgaaaaacaaaggatttttccttctgtcttatttcactgtcttacttcccttttcccctcaatcgacatggatggcaggtgaacaatcatctatcattttgaatacttcagctgaagcttgttcaagagggcacatagcaatttaatcagaattttcttcatctatcttggttgttataataaagaaattagtataattgcactgttcaaatattttattcgcaaagcttttaccgtgagatggacacgtcattgctattcacatgagatgtgcctcaagaacaggcgcaagacccttcttcaatggatattgccatgcatataattgatagcagcatgacagattgccagttagccggctgatatagttcttgataaattgttccgcaagaagatggtggatattgccatgcatataattgatagcagcatgacagattgccagttagccggctgatatagttcttgataaattgttccgcaagaagatggagtagcacagatggcaagttggaaacaacacaactcgattagcattctccattaaagaagtgctgcagcatgcatgtatgacaaggctctgcactatgactacgagttagctgccatgctgattcctgctggcaataacacactatgatatctgcgaccagcaacagatgacacatgatgtcaagtcaactcctcctttgcacggttgcaacagcaaaaacagctcatctcctctcactgcactgcattgctttactcaccaatctcacgatatggatctgatattaaactaaactgacacgctcgtgcagatgagtttgtctccagtttctggccagcgaggcatgatagccacctcaatgcaagctcaattagagaagagatgctttgtgcattgagcaaagcatacaaatattaaagaaacagaaacctgtcgtgcagatggtggcttctgttgcagcacaaggcttcgccaattattagagagattctttctgtctgctggtccagtaatgagactgcttctccctcctt

SEQ ID NO: 18049 - DNA, 1501 bp, Oryza sativa
aacaaacatgagagtgtatgcatcacgccaagagttacccaatgttgtacattgtttgttctgtttttcatggttgtcatcaacaatgttctcatttgtagcgggtccatgtcagtaaccgtgcataggcgcgcgcgcttgaattggcaatagaatagtcgctcgcttctctctctctagtccttctcttcttacataagcaggctattatcttgcttactctaaagtgacggtgcttgatatagagtagtggtggtactctgtttttagactttgcaataatactctctgtcaataatgatcagcggcggagctagggcccggcgaccctgggcacttgcccgggcttcggcgccgcaagcatcatttgattagtgctaatttatggtgcttagccacggcatgaagcagtataagcacactatttggttgggacacttaataacgtgtataagtattagagaacatacttagccacagcatacaataactagcatgctgcatgcagtagtataagtacgttttaataatctgttagacataatcatctagggtataacctgaagcaccagaattatttactagctagattgttgtacccattacttgagtgtaagctattagacatctgcaacctgaaagcaaagtaaattttctagcaccattataatttttctcttttcgggataataaattactaagtcccatagcctgcaaaaacacaaccatgttttcctctaaattagaatagataaaaaagttgttgtatggtacacaatctatgaagttatgtgtgatttgttatatatccgttggcgtaacaggctcacacaaatttctagatccgcattggcactgataatgattctggacgtcgtccactcgttctaaccttgagaaagcccggactcctctcacctgctgctttcttctcataaagaacaagtgctgaaattttgagaaggaaatgtgtgacacctcgaaaatcgaaataattgatggaaaaaagttttgaaaagctagagctagcaagctgttggccgatatatctttgatggtcgatggctgttgggtttgtgggcttgtgctaggcgtcccagctactcaggctgtaaggggtttccggcctatgtgcggcccatattgcatgggccgcaagtccggaacggactgtaacttccttgcgggcccacactaggcgatcgtagatgggccgggccgtattggggagccgaatcctatttgaacggcctacctacctttcccaacgctcacgtctaaccaaatcttttccgcttcgcatacgtagaaaacgtaaaccattgaccatatcggacacggtctcaagaagttcgtttccatgtgtacgaaacgtattctttttctcgataagaagtgtagaaggcgccaggtcgccgtagtctcgctcgtctccgtgcattccgcgatctccgtgcccgtcgaccaccgtggtgctcgccggcgacggacggagcgagaa

SEQ ID NO: 18050 - DNA, 1501 bp, Oryza sativa
cctgaaaggtttctattccttgtgtattttcttgtttggttactttgtttgttataatcttgatgcccacattcttgcttatcagtcctcctggttcacccacaagagaagaagaaccattactaaattcatacactgattatgaagatagcatatacggtaccctcaggaattcctacctgtgtttataattctacgttataattttgacaaggaatcacacagcgtattaaaaaattgtaggtattgcatggagctcccatgatccgtcattatttgcttctttatcttatgacggaagggtaagtacctgcagcatttgtatgcttatttgaaatatttgtcttgtgattttttaaagccagtttatctgatatctgaatcttgactctaatgatctgtgataatttcctctaatggtcaggttgttttagaatcagtcaagccctacttgcagagaaaatgaagctgcatgttctctccgttgtaagggcacataactccacttctttgctcggtatgttgttgatgcgattaccaatagtaccttctcttgttctaacagaccttcccttttctgctcaagcagacttgtttgttgtgcatattattggtgttgtagattttctccttgccatcctatatactgtactctggtacatggagttgatgcgatggcctgattcgacagcttgtgaccccagaacaatagcaagccaataatgtttcagtaaccatcttggcagaaatccagtgtctcatatgatctgccactcttgtgattcaggccagctgtaattgcaaaattcagcctggtacaattgccaaatactgctcctcgagtgattcttgaatgtcatatatctgagaaaggttggtgtcaattgttgcgttatgtggtgaagtacaaccgatctgaattttgtagaactgttgagattgacaagatctgagcttctgtttttcattcgatttttcactgtatgagtggttcccttactttagcaaagattaatatttcgtctgtatgttacaaaatcattcagggaatgagcaaattaacttcaaattgttttgggcatgagccacctacgaacttgtcatgcgttcaggacggcaggctcacatgctttcagcatttctttttcgcgaagattttgtcgacagtttctttttaaatcatatgtgttcgctgataccccctccgtttcaaaatatttgactccgttgatttttttagcacatgtttgaccgttcgtcttattaaaaaaatttgtgaaatatgtaaaactatatgtatatatgaaagtatatttaacaataaatcaaatgatatgaaaataataaataattacttaatttttttaataagacgaatggtcaaacacgtactaaaaaatcattttgaaacgaagggataaatttgttttagaaaatgatcaaccttttttaatgaaaaaaaacaaatcaacattttgcttgttttttttagtctggtccc

SEQ ID NO: 18051 - DNA, 1501 bp, Oryza sativa
cttcgcggcatgtaattcctaacaagagaagggcaggaggatagattagcggtgaaaaccttgcccatatgatgatgccatgcagcatgggaaggtgtagcgcttgactgccccgtgcttctcctggacgtccagtgatagtggtgttcatggagagaccgacaaaggagttcatggagagccctagctctagccatgcaccacaaaacactctcctccgccaatggtttcaaaacaacattgacattatgcatggcattgttggtaatacaatcgttctgacgcttccaaataaatatgaaaaaagaagattaataacacatgcaaatgcgaaaagcaagagtgaaaagctttctccttcgcaccaggatggtgcggtctctttggttccttcatatcacatggacccactattcgaaccccaagatctttcttcatttagcaccgtgtttactcaagagaaaagctctgtccctacatggtcgggtcctttggctgatctctctagagttgggaaacaaaagtagaagcacaaatttggccgctcatcaaaacaaccagccactgcccgtgctcgataaggaacaaaagagtgatgtttacaaacaatgatttttggcctttatgtttatcgattttgctcactgtacagtaaattctataattgtgtgtgtgtgtgtgtgtgtgtgtgtgtggtcacacgaacaggagcacgctgatataaaatgagaatgtcaggcttcgcagcatggaattcctaacaagagaagggcaggaggatatattagcggtgaacgacgtcgcccatatgaagatgccatgcatcgtgggaaaggtgcagtgcttgacgtgtgtgactcttggacgtccatattgatagcggtgtacatggcctccaccatggcctccacgatccaaggattgatgtctatcgtgatgcttggcgatgataaccacccgacaaactcggatgacggatggagctgtgccgcactacgtagaaggggattggtttttgtgagagcttctagctagaagatttttctgtggctaactacctacaagtgcttggcttgtattgtgagaagatttagacattctgctggtactaaacaattggaggggtgagtcatatgccatacaaggaatattagaagttgttttggatttcagaattcgctaaaagttaattgatttttggaccttttttcatgaaacacaagagccttgtgtttcatttcattaagaagagggaaaataagctcaaaagagaagttcacagaggaaccatcttgaaaaaaaaacatcacaacaagcgatgtgtcaccaaaacacaaaacacactctcagacaacaaccgtccaacaggagagaccgacaaaggagttcatggatagccctagctctagacatggactacaaaacactcccctgccactgtttcaaaataacattgacactaggaatggcattgttgaaatgcaattgttctgatgctttc

SEQ ID NO: 18052 - DNA, 1150 bp, Oryza sativa
ttagagtgtcataaagatggaacctctaatcccgagagcgcaaattgtcataacaagttttacctcttgttgaagatcgaaaccgatgcagctcaacccgaaagcaataactcgtcgaaataaaacaaaagcaaaaaggtggcgatgcgccgaaattgtattgaacgtgtgtgttagaaattacatagggctcggggtcttatttatacccgagaattacaagatatgtccataccggacacgactattatctctaacaaactctaaaataccataagtctttgcggcagacttttgcccaagcatatctctaaggaaattacataaaatatcctaattaatagatacaattgccttctcaggactctatccatgtgcggtaatcatctcgaagcacctcaattcaacccgatgtcatacaccaagttgtattgtcggaatcggctgcatcagcccacctagtccgactcagactcagccgatcctaatcgtagtcgatctggactctagccgattcctgctttgttcctgaatcgatctccgccttcaactccacttcgatctaatcttcttttccgatgccaatgttaccaaatttggttgttagtaaagtggaagcacaaatttggccgctcatcaaaacaaccaaccactgcccatgcttgataaggaacagaagagtgatgtttacgaacaatgattttttgccttggtttttatcgattttgctcactgcacagtaaattctatgattttgtgtgtgtgtgtgtgtgtgtgtgtgtggagtgtttgtggtcacatgcccgtgtgtctattgataatcggaacagaagcacgctgacatccagtgagaatgtctggcttcgcgggatggaattcctaacaagagaagggtgggagggtagattagtggtgaacaacctcgcccatatgatgatgccatgcggcgtgggaaaggtgtagcgcttgactgtcccgtgcttctcctagacgtccagtgatagcgatgttcatcgagagaccgacaaaggagttcatggagagccctagctctagccaagcaccacaaaacactctccctcgccaatgctttcaaaacaaaattgacattatgcatggcgttgttgaaaatgcgaccgttccgatgctt

SEQ ID NO: 18053 - DNA, 807 bp, Oryza sativa
tcctaatatatagagatcagccaaagtacctgaccaagtaggatcaacgcttttctcttgagtaaacacagtgctaaatgaagtcggatcttggggtttgtatagcggatccatgtgatttgaaggaatcaaagagactgcaccatcctaacgcggaggaggaaacttttcactcttgctttcgcagttgcatgtgttattaatcttcttttaacgatatttacttggaagcattggaacggctgtattttaaacaatgtcatgcctagtgtcaatgttgttttggaagcagtggtaggggagagtgttttgtggtccgtggctagagctagggctctccatgaactcctgtgtctgtctatcctgttgactggttatttgttgcctgaaagtgtgttttgtgttttggtgacgcatcgcctgttgtgatgttttctttctcaagagggttccttcgtgaaattctcttttcaacatattttgagtattcttaatgaaatgaagcacatggcttttgcgttttcatgaaaaaagaagtccaaaaatcaatttgactttttagtgaatcctgtaatccaaaaccacttctaattttccttgtatggcatataacttacccctcccattgtttagtaccatcagaacgtctacatcttctcacaatacaagccaagccctagtaggcagtcaaccaccgaaaaatcttctagctagaagctctcacaaaaaccaatccccttttatgtagtgcggcacagctccatccgtcgtccaagtttgttgggtgcttgtcatagccaagcgcca

SEQ ID NO: 18054 - DNA, 1501 bp, Oryza sativa; identical to SEQ ID NO: 18051

SEQ ID NO: 18055 - DNA, 1501 bp, Oryza sativa
cactacacaacaagcaaagaaacaaatttcgcaattagggtttttaagagataattttcccgctaggcgccacgacggaacgggcgctacagattgatattctaagcacgacttaatagatcaaactcaactgatgcagcattaagtatgaaaagaagaacaatatctagacaatcaagccgctggacatttcatagagtggtatatatcttatataatctaaaccaatatcgatatttaacctaaccggctgccctcttttaacagatgttagccgattgtgggttagatggcaatattgctagagattatgtaagatatatgataactcgacgaattacgtaaacaagattagagtgtcataaagatggaagcactaatcccgagaatgcaaaccgtcataacaagttttacctcttgttgaagatcgaaaccgatgcagctcaacccgaaagcaataactcgtcgaaataaaacaaaagcaaaaaggtggcgatgcgccgaaattgtattgaacgtgtgtgttagaaattacatagggctcggggtcttatttatacccgagaattacaagatatgtccaaaccggacacgactattatctctaacaaactctaaaataccataagtctttgcggcagacttttgcccaagcatatctttaaggaaattacataaaatatcctaattaatagatacaattgccttctcaggactctatccatgtgcggtgatcatctcgaagcacctcaattcaacccgatgtcatacaccaagttgtattgtcggaatcggctgcatcagcccacctagtccgactcagactcagccgatcctaatcgtagtcgatctggactctagccgattcttgctttgttcctgaatcgatctccgccttcaactccacttcgatctaatcttcttttccgatgccaatgttaccaaatttggttgttagtaaagtggaagcacaaatttggccgctcatcaaaacaaccaaccactgcccatgcttgataaggaacagaagagtgatgtttacgaacaatgattttttgccttggtttttatcgattttgctcactgcacagtaaattctatgattttgtgtgtgtgtgtgtgtgtgtgtgtgtggagtgtttgtggtcacatgcccgtgtgtctattgataatcggaacagaagcacgctgacatccagtgagaatgtctggcttcgcgggatggaattcctaacaagagaagggtgggagggtagattagtggtgaacaacctcgcccatatgatgatgccatgcggcgtgggaaaggtgtagcgcttgactgtcccgtgcttctcctagacgtccagtgatagcgatgttcatcgagagaccgacaaaggagttcatggagagccctagctctagccaagcaccacaaaacactctccctcgccaatgctttcaaaacaaaattgacattatgcatggcgttgttgaaaatgcgaccgttccgatgctt

SEQ ID NO: 18056 - DNA, 1501 bp, Oryza sativa
ataatagggttccatttgcataaacagcatttagcaaacatttgagaatttaataaaacagttaagtaatatttaaacaatattaatccaacgctatacaacataccctgttgtataggcctaaccattctgaacaaccatacccggctgtacagatctatctccaaaccaggaatataccattccaaaccaggagctaaacaaattattaccagttattgcatcttttattatgatgagagatgtgagactcatcacgaaagacattgttagacccgcccataaccgcgggtacggctattcgaatagttttactctgatcagaggtgtaccactgtacccacaagacatagccccacatcatgtcaccatgtgccttaataccaccacggtacctcggaaaggagctgtgacaataccccttgcataacacaatccaccgcagcgcaccattcctggatcataatcaccccctataaacaaggcatggactccccagtgacccctgtgggcttatctccgccacttctcagtctggtgccccgcaataaaccatgctacacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttaattggcaagtaattaattaaccaatcacgattgaccatcgtgaactatcattaagtcctcattaaataattaatagtgaatcataagttatcccaatagtgtgctaatgtttctaagcatggctaagcattcatatctaatatctagctgaaccaatatataaagcccaactagtcaagttataataacccaaggtatcaaggaataaagtaatcaagaacaaaagggctataacaaacaataggttaattccaccaaatgacattcgaaaataaatgcaatagttgaatagaaacaatagctttaatcgggatcaacatgctcaaagggttgtttgggatctgtgtgacttgccttgctggccttggaactcttcaaattcttctcctgcgaaaacagactctccggaaacatcggaatctaagcagaaaagagcaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggtttgcggtggaccgggtgcacggcagcggttcacgggaacgaacggccgagatcgatccatccaaaacggacggccgagatcgatcgggtctacggcggctcacggccaacggccccga

SEQ ID NO: 18057 - DNA, 1501 bp, Oryza sativa
gctccctgttcctcaatctttgaacccttctcttttgattcttcgtaaagataccagaaggacaccattgacttttcctattttcattgtcctcttggccatgatcttgattcactggacccaatctttgttgaacaggaactcttgtctgccttaaccgattgcccctactatatgatcggcttgagctctcggcaataccactgcacccaggacagtcttcaatagatggtagcctcatacctttattccaacagaatctaaagaactcacaaccccaatgaggatcaaagccaccgtcatcttcttcataatgcttctcctgctgcttgtcgtacttcttctgatatttgttgataatcttagccgaatttacctgaaaaccccttgcacggcccctatcggctgttcggccagctgtatgtaccatattaataggaaaaggattgccatcaattttcatcggcctcttgtagtcatcaaacttgattttgcctccctcaatagcagcttggatctgctgcctgaacaccttgcaatcattagtagtatgagacccagaattgtgccacttgaaataccttttcttgcctaattcctcagtcgatggaattgtgtgaccagcaggaagttgaatttgcttctctcggagcaacaagtcaaaaatcttgtcatctttagtgatattaaagtcatacctctcctcttttcctgagctctttacccattagcatggtataacctttttacttctcacccattcagctgtagctacttcagaatcatcatcttcattgtctgacccatacatataagggcagacgtggttaattttcttggaattcctcctcgcctctgcaaacctttgctcatgcaatatcaccttctgtgtgagatgagacaagctttcaaaatcttccgacgagaatttctccctgattggagcaatcataccctgaaaagccaaatcggctaattgggcatcagtcagacttaagctgtaacacttattcctcatctctctgaatctctgaatgtactcatgtaccggctcatcatgtttttgcttgatcgatgtcagatcggacagtttcatctcgtgaaccccactataaaagtagctgtgaaactgtttttctaaatcagtccaactgttgattgttccatatggtagagaagaaaaccaagtaaaggccaatcaagacaaagacaaccggaataatctaaccctcaaagcattcacggccgatgcttcaccgcattgagctaaaaatcggctaatgtgctcataagttgatgtactatcttgccctgaaaactttgaaaaatccggaactttgaaccgattaggtagaggaactctctcgaaccactcaggatatggctgtcgatatagatttccagcatctttcggcctaagcccaaactgttccttcatgacatctgcaatcaaatcggcccatggtcgctgttgaggtgccccttgaggttgttgtggcat

SEQ ID NO: 18058 - DNA, 1501 bp, Oryza sativa
ggatattttatgtaatttccttagagatatgcttgagcaaaagtctgccgcaaagacttatggtatattagagtttgttagagataatagtcgtgtccggtttggacatatcttgtaattctcgggtataaataagaccccgagccctatgtaatttctaacacacacgttcaatacaatttcagcgcatcgccacctttttgcttttgttttatttcgacgagttattgctttcgggttgagctgcatcggtttcgatcttcaacaagaggtaaaacttgttatgacaatttgcgttctcgggattagaggttccatctttatgacactctaatcttgtttatgtaattcgtcgagttatcatatatcttacataatctctagcaatattgccatctaacccacaatcggctaacatctgttaaaagagggcaaccagttaggttaaatatcgacattggtttagattatataagatatctaccactctatgaaacttccagcggcttgattgtctagatattgttcttcttttcatacttaatgctgcatcagttgagtctgatctattaagtcgtgcttagaatatcaatctctagcctgccttctggttgccgattagggtagcatcggagtttcagccgatcttatctgatttaactatatttactctatatgcttcattgacatgttaaatctgccctttatatcaagatattgtcgcatctaagtatattaagcttttgtttgatatattatacctgttttaatatcctgatatagagtagtatcggagtattagccgatacatgctaaatccatctgatcggctatgctataaacatatatagtcctgttattaatatatattctgatctaagtgatttatactgtctcggcgtggcgaccgatctatctcaatcacttgatttaagtatatatcgatataagagttatatattggtaatatctacagcagatcgagtagatttagttctttattatctacttataatcgccaatcgattcacatatgacatcggctcaaagataaatgatatgccatcggcacatagccgatcggctatcgtttatagatttaaccgcggtgtctttgtctttatttcttgttgattgcaggatcaaatcaactggcacgctaacacacccgaaggcgagctttggacctgcactggagttaagcagatctcccaggcctcgtgtttttcatcaacacgcttttggcacgcccggtgggaccgataagaagtgaacaagccattctttctcatggccgagaaaccacctctatgaccatcctcggctagcccgggtactgtcacaccctaaaaatcctaaatatataaattgttgtttaattggaattattagaatttattttaaaagtctagaagagaagatctaattttaattaataaattccaatataaaatggggccagataaaatttcattaaatactttgcttaattctataattc

SEQ ID NO: 18059 - DNA, 1501 bp, Oryza sativa
taatagggttccatttgcataaacagcatttagcaaacatttgagaatttaataaaacagttaagtaatgtttaaacaatattaatccaacgctatacaacataccctgttgtataggcccaaccattctgaacaaccatacccggctgtacagatctatctccaaaccaggaatataccattccaaaccaggagctaaacaaattattaccagttattgcatcttttattatgatgagagatgtgagactcatcacgaaagacattgttagacccgcccataaccgcgggtacggctattcgaatagttttactctgatcagaggtgtaccactgtacccacaagacatagccccacatcatgtcaccatgtgccttaataccaccacggtacctcggaaaggagctgtgacaataccccttgcataacacaatccaccgcagcgcaccattcctggatcataatcacccccttataaacaaggcatggactccccagtgacccctgtgggcttatctccgccacttctcagtctggtgccccgccataaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttaattggcaagtaattaattaaccaatcacgattgaccatcgtgaactatcattaagtccttattaaataattaatagtgaatcataagttatcccaatagtgtgctaatgtttctaagcatggctaagcattcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaatcgggatcaacatgctcaaagggttgtttgggatctgtgtgacttgccttgctggccttggaactcttcaaattcttctcctgcgaaaacagactctccggaaacatcggaatctaagcagaaaagagcaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggtttgcggtggaccgggtgcacggcagcggttcacgggaacgaacggccgagatcgatccatccaaaacggacggccgagatcgatcgggtctacggcggctcacggcaaacggccccga

SEQ ID NO: 18060 - DNA, 1501 bp, Oryza sativa
ttaataaatggaattgcatttcaagaataatttaaattgaaaaaggtttttaaaagtctcttttggctttgggccgaaagtcggcccaaaaccttctctctctccctcggcccaagtcggcccagtccgccgctagcgcgtgccctcgctcgctgacaggtggggtccgcctgacagtcttcgtctacctccggccgccgccgcccgaaaccctagcgccgcgccgccgccgtctccttccaaattcggccgcccctttccttctccggtgaaatcaattgaggggaattgtttcccgagatctcctctaccttttctcttttggaatcatcgtctaaatcgctttggaaattcatggattcgagtttgattcggattcatttttcccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgtcgccgtcgtcgccgtcgctccagccgtgcttcgtcgtcgctccagccgtcgccgtcgctcggggaggtcgccatcgtggtcgccaagtcgtcgccgtccttgtccgccccttcgtcgtcgccgaagaccgccggagcaccgtcgccgccgtcgacccgatcttctccgccgcttcgacctcgtcgccgtcgccgtccgttgatcttccgccgccgttttggtcaccagtgagttcgtcgcgtcgcgctctacgtcctggtgcctttcgttcgtgccgaagcatcatcgttcgccagcgagcgtgcgccgtccgagccgccgagccgcctccggaggtgacgtcgccgctgacgtcatcggggccgtttgccgtgagccgccgtagacccgatcgatctcggccgtccgttttggatggatcgatctcggccgttcgttcccgtgaaccgctgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgctcttttctgcttagattccgatgtttccggagagtctgttttcgcaggagaagaatttgaagagttccaaggccagcaaggcaagtcacacagatcccaaacaaccctttgagcatgttgatcccgattaaagctattgtttctattcaactattgcatttattttcgaatgtcattgggtggaattaacctattgtttgttatagcccttttgttcttgattactttattccttgataccttg

SEQ ID NO: 18061 - DNA, 1501 bp, Oryza sativa
aaggaccggttcacgagtttcggttgtgaaacattaaccgtgccaaccacaagccagcgtgggcaacggctttaccttttgtatagcatggtttatggcggggcaccagactgagaagtggcggagataagcccacaggggtcactggggagtccatgccttgtttataagggggtgattatgatccaggaatggtgcgctgcggtggattgtgttatgcaaggggtattgtcacagctcctttccgaggtaccgtggtggtattaaggcacatggtgacatgatgtggggctatgtcttgtgggtacagtggtacacctctgatcagagtaaaactattcgaatagccgtacccgcggttatgggcgggtctaacaatgtctttcgtgatgagtctcacatctctcatcataataaaagatgcaataactggtaataatttgtttagctcctggtttggaatggtatattcctggtttggagatagatctgtacagccgggtatggttgttcagaatggttgggcctatacaacagggtatgttgtatagcgttggattaatattgtttaaacattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaaataatggcacatgcacttcataatctcttttagtggttctcattcaaaatttattccagtgttattagtactgtacatctattattgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttttttctaactttattcaaattaatccaaaaacttgtgctattgattggataaatgtcttaactccctcctttcacttgtctttaga

SEQ ID NO: 18062 - DNA, 1501 bp, Oryza sativa
gttggtatcagagcctccttgaccctaggttatgccaaatggttacccatagaagccctctaaaaatattggaaaagtagaactgttctcctccccttctcttttaattaaaccaaaataatggcacatgcacttcataatctcttttagtggttctcattcaaaatttattccagtgttattagtactgtacatctattattgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttttttctaactttattcaaattaatccaaaaacttgtgctattgattggataaatgtcttaactccctcctttcacttgtctttagatgccgcgctacaagcctgagtacttgtttggtgttgagggatttgtccaggagttgcgtacgatgtccattgccataggatttgggactgcccctttttatgcccagattcctcatgatcgtcatgaagagaagtgccgggtcaaagtcaccttaaacagtaatagcgaagatatcccctcagtgatgttcgaagctggaggaaaaaactacatccatgcatgtcagaaggtggcaaggatcgccataggagagctgcgcgatcgctacagtgatcagttggccgacaccgagtatcgctaccatcctcgccaaccacagggaagtgaccgtggcagctaccttgagactgaaggaattgagaatgatgctaccacatagcatttggttgagatgctgtgggctatggatgaaacccgtgcagagactgtgttagcagctcaagatcgtgaagatcggaatcgtggtaagatttgcaagctagaggacaaagtggatcatttggagaaggaactagccgccttgaagggagaagcaccaccgcagaaggccaggattcgtcttaccgcaaggaagagagctctatttgtccctcgctatcaattggcgccaaaggttcgtgtggtggaaaaagaagttaccccagccctagcagatcctccggtcgtcaacgtaagtgatgatgaagtagaagaatccaagcgcacccattccaaaatcgagtggggagccactcaagatgatgaagatgagccgaacgagccttcaatcaactccgatgcccggaagacctagagtgccttgtcaaaccgttgtcttagatcgttgtgttagtttgcttgttttaagtttggttgtgtgtgtctcgcatgtgattacatcagtggtgggatgtaagtgcatgcgttggtttgctttcgagtgttaggtagttggtgagtttagtggtgtgagagtcttcagtttgtaataatgaaactcacttaagatcaataaaagttaaattaattctctgtcctaa

SEQ ID NO: 18063 - DNA, 1501 bp, Oryza sativa
tgcaaaagataatacaaagttaacatcgggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttataatgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgatgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaatgtggttcgtcgcctgccgccactccaccccataaaccctaaccgatcgagggggcgcagccagtgacgggaagtccaccgccgcgccacgcctcgtcgtcgacaccgtcgctgctgcaaccacatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaactgacactaatatcaacaggtcaagatggttgtttgcaacattaccccacaaatatttctccctatctttgtaattttacttagttaacaaaaaaaaagtaggcttcaccattttcaacactcacaatgccctcattctccaaaaacccaaaacaaaatcttgcccacttaatttcatcagaattcctatcgataactggagattcaactgctacagccaatcggtttactcactaaaataaaatcgatctaattgcctaacaaatccacatctctcctctcttccactgtaaaccccaagattgatagaagctagaaccaagtttttgcctcctctcctagggctctaaccacagattcatctaccgcacaaattcaaaatg

SEQ ID NO: 18064 - DNA, 214 bp, Oryza sativa
taaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctact

SEQ ID NO: 18065 - DNA, 475 bp, Oryza sativa
ccagagccgataaggccttgtcagatccttcagagacgaaagaccatgtaagacctggtcgtgtaagagttctcgccgtgcgtattaaccaagccgtgtaatcggaaattgacttttccaacctcacggctgggggctaggatcagagctatttcaaccaagacaggccaggagtccaagagccttgtcacccgaggacatccctccgacgacaaggctgggggctaggaagagtgtacaactcaaacggctaactaaggtcgttaactgagaacacgctcttacaaacaacacccagagtaagaaacatttgttaaagatatatttctttattcacaaaatattccttacagttagcacataaatattatgtcaaattacgtcttttcccaagatatcttgttacagggtacaaattctaccaagaaggccaacgaaaatcttctcggccagcggcgacattgatctcgcgaga

SEQ ID NO: 18066 - DNA, 231 bp, Oryza sativa
ctaagcatggctaagcaattatatctaatatctagttgaaccaatatatataaagctcaactagtccaattataataacccaaggtatcaaggaataaagtaatcaagaacaaaagggccataacaaagaataggttaattccacccaatgacattcgaaaataaatgcacagttgaaataaatagagaatttaaatataggatcaacatgttcaaaggattgtgtttagg

SEQ ID NO: 18067 - DNA, 615 bp, Oryza sativa
ccggccagcccgcggtatgaccggccgacgctgtgtcggtgtcggtttcgggttgtttatttggatatccgtgattatttcatgattatggcttctagatggatactatacgtatgtaatactattgtttgctgataatgagtcaagttgtagatagcttggtctcggaatatggtttctttgtttgctccacgtgtaggtgacttgatgtctcgggagagtatttgcggtgatggaccgggagtcggcttggggataagacgacgtccgtggtggtcagagatcatgcgggatactaaggctagagttgatgcacatggttgatggagattccatatggcatacgatggagttattgtgtgcgtatgggatgtggagtcgaatttggaaggagtccaaatttggtacgattggttctgtaaagtttctttcttgtactagagggtttcctaaggtgtttaggactcctagtatgagtttggttcgtggctttgggctgcctacctcatgtataaatagagggggagcgtgaggcttcccggtatcgctttagagagcaattgagttgagttttgaattagggtttcgagtttagtcgaaatttttgtaaggagt

SEQ ID NO: 18068 - DNA, 262 bp, Oryza sativa
ggcccaagccaccccacccagccgccccagcctcccaagccgcccaccccccctcacgcgcgctgatcgcgcgaccgcgtgggtcccacgcgccgagtcgtcgtcctcctcccgcccggcctccttcctctctctctcctgtgcaaaccctagcgccaacctccccaaaatccacgcgattcaaaccagggtttccaaaattgattagggggttttaatccctattgattcctctgtctttcccccatatttcccccttgat

SEQ ID NO: 18069 - DNA, 315 bp, Oryza sativa
ccatcgcatttctcagcattttcgtgcatctttgtgaggcctacattggagtagagccttttctagatttgtttcgcttttattacgagttgcgtggatggaactcaacaaggtgtctggctgcgttgggttctgacttcgtgatgggatgaagtcgcaatacgtccccttccagtgcccctcttctcgcagcacgtccccttccagtgcccctcttctcgcagcaaatggcagaacaggtggttttatctcgagattaaggactcgaatcctgccctcattgttcctgacgagcagccaaacaagattccggtt

SEQ ID NO: 18070 - DNA, 487 bp, Oryza sativa
ttcggaggatccgctcttgccggaagttgaagcccacgttagcgaaagcgagctaggcaggtgacatcatctttgaccatattgaatcccagtttataaaattatgtggatttaaattatggcattatcgctttatttaaattcccgcgttatcactgttttatttagccatgcctatttacctttgttatgaccatattattattgttattgttattattattaccttgttcaccctaaaacaaacaaaacctaaactagcggtttaattttatgtatatgcttcgcaatttaattatgtaacattaagtggtttttcaactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggt

SEQ ID NO: 18071 - DNA, 989 bp, Oryza sativa
  unsure (1)..(989): unsure at all n locations
ccccatgagggcaggattcgagtccttaatctcgagataaaaccacctgttctgccatttgctgcgagaagaggggcactggaaggggacgtgctgcgagaagaggggcactggaaggggacgtattgcgacttcatcccatcacgaagtcagaacccaacgcagccagacaccttgttgagttccatccaacgcaactcgtaataaaagcgaaacaaatctagaaaaggctctactccaatgtaggcctcacaaagatgcacgaaaatgctgagaaatgcgatggagttgggattcaagtgcaaaagtgaaagcccatagaagtttaagaccagcaaaaggaattcagaggggggaggaagaaacccgcagacaatgtaatcctcaatcgcaaccatgcgacctaggacgggctggggagtagtaccccctgcttccctctctgccttgtcgtggccagggaggccaccctcctcctgaagtttcttcagggtcgcggcggtggaggtcgacttcccaagatccatggccgtcgggagatcgccggaagatcgccggaaacggacgatgaatcggtgaggctagggctttttgcggcggcgaggaaggcgaggaatgcaaaggagcagtgtatacttaatgaagtaggcggacctcaaagctcacgccctaaatacctttaaatagacgcactcccgacggtgcgaattccaaggaaataggagaaatccccgccggagatttctatgtccgttgtgcatggtggtttttggacttcagttcaaaattcattcgtgaccgttggacttcaaacggtgcgctcgattacacgtcatctccttggttctcgcacctggaatggcaacgttctcgacacctggagtcgcaaacggtctcacgagttcatttttgagcagaagtcggnggctactgtcagggttacgggttaggcatacccttcaccctacgatatacgtcacgtatcgaca

SEQ ID NO: 18072 - DNA, 671 bp, Oryza sativa
  unsure (1)..(671): unsure at all n locations
gctctgacttcgtaggctgtgttggtggtctaggctttgagattcgatgagctatggctccgcggggggtcccttatataccgtaggttgggcgatatctgagtaggactcgnatgtaccaaccctgatacgatacgtaggtacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagccnccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtt

SEQ ID NO: 18073 - DNA, 278 bp, Oryza sativa
gggtgtgtcttgttaagaacgggggttgtactcagtattgctcaatttttcccaaacccagaagagaagttcctgaagaatgaaggttttggtgtctagctcgtgcctgccgtcaagcgcctgtggtcgtcgccatagtcttccgctgtttctcgtttgtctctgtgtgtgctgggcattcgctgcccatgtaataaattaagtatgtacgcttccgcttgttaaactctgaaatgtatcaacttttggtgtaccttgcatcctgggacaaggattaa

SEQ ID NO: 18074 - DNA, 787 bp, Oryza sativa
attgctcaacccgcccataaccgcgggctctgctattcgaatagttttactctggccagacgtgtaccactgtacccacaagacacaaccccacatcatgtcaccatgtgcctcaataccaccacggtacctcggaaaggagttgtgacaataccccttgcacaacataagccattacagcgcacctttcctggatcataatcacccccttataaacaaggcatggactccccagcaacccccatggacttctcgccgcttcacagtctggcgcactataatgaatcatgctatacaaaagataaagccgttgcccacgctggcttgtggttggcacggtaaatgtttcacaacagtagctcgcgaaccggtccttaattgtcatgagcacaaccatcaaaaccatatgctcacaacccaccttatccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattataacccataggaaaataagatcatcttcggccattaattaatggggaaaggttcaccacccgatgacattaaaaaataatgcatagttgaaataaaataatagctttaaacgggtttaacatgctcaaagggttgtttgggatctgtgtgatttgcc

SEQ ID NO: 18075 - DNA, 658 bp, Oryza sativa
gggtaggtatgacacgtgggtcccaccattttttaaaaaagaaaatactgattggattgccacgcgtacgccacgtaggaaaaaaccagtctgaatagggtcgaggggttaattcgtcggtactgaaagttcagggtgagtaatgtctggttttgtggttaggggggtaatttggtcaaccgtgatagttcggggggaagggggggtaatgtgtactttttccgtaggataaacaccgaaagtggcactagagaaaataaggtgtcacacaaatgcaaaatgatcgtgctattagcaccggttcaaaaaccggctagaactacccaacaagtggcagtagttgttcagtttgtcacctaaacgaacctcttgctaaaattcgaaatcggcattgttggaataaaatcaactggatttactagctctcttactattaaggtgacagtatggcgcgccccggggttcctggctccggcatcccccggataatagcatgctcccgtcttcgccttgccggctgagccgtggcgtcaggggtggttggcggatgcttggtgcgctttaatgcgcgcggtagaggactgactatgtcgatgccccaacgcacgaaaggctatactggcggaattggcgtgagctatgtcggcagccttggcaa

SEQ ID NO: 18076 - DNA, 197 bp, Oryza sativa
acttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcaga

SEQ ID NO: 18077 - DNA, 204 bp, Oryza sativa
aagtgaaaggtgaggcaaacgcgcggttatataggcatcgatgaatacaaacacagcttgcttgcattattgatccatcaatcgatggatcgaccagctagctatgagcaaaaagggccaatttggcgccgaatttgcagatgggcgaattaaggccgtccaaactgaatgatttgatcacgtacgtccaatcctctctgcagc

SEQ ID NO: 18078 - DNA, 161 bp, Oryza sativa
ttgaataagacaaacggtcaaacatgtgctaaaaagtcaacggcgtcaaatatttcgaaacggatggagtatatatgtatacgattgagggctggctacaacctaacaattgcagctgacatttaatttgacatgtatccgtccgttcgtctgtatatagt

SEQ ID NO: 18079 - DNA, 686 bp, Oryza sativa
gtcactcacctcatccttccagttgtgttgcatcgcagcaccagcacacaggcagcagtagcacctcgatccatctaccattttatttgctgaaaagttgaattttttttttcttagatttgtacactactttatgtctcacactaggctctatctctctccctggcatgaatgccccaggttgcaggcctcttctttccccaggatttcgttagaaaagccccagtagcacacggattaacaatctccgatttaaagtcagaagagacttggtcactgatatgcgagcccactacttctagacccacatgtcaatgaccacgttagaggtacgtaaaatgacacatgtgcctcttcatacgctctcttctctcctctttctctcgcattgttttgttttgtttttaattttgaagcgaaaagagggagggaggtgcaaagaaaggttaggaaaagggacaggaaaagagggtcactgatttctttatgccccagctgctggagccctgccggcctctaccatctccatatataccacctcactcctccccttagcttaacacaccacacacacccacactggcagcagctcatacacatagctagctcagctgagacacacacacacacagtgagtagttcagctcaaagctagcatcagcagcagagctaattaacaaacatgg

SEQ ID NO: 18080 - DNA, 330 bp, Oryza sativa
tggaccaacggcccaacctgaacacctgggcttgatggagcacaagtttgagccgggcaattcttccttttgaactccaaataaaataaagcaaagaaaggaaaatttcagcatcctgaatgcgtcgacaccaagtagaataaggctgtgttcggtttcaggggttggaaactaatcctttcagcatgaaaaatggagcgatccattagcacgtgattaattaagtattagttttttttaaaaaaatagattaatttgattttttcaagtaacttttgtatagattttttttttaaaaaacgtaccgtttagcagtttgaaaagcgtgca

SEQ ID NO: 18081 - DNA, 964 bp, Oryza sativa
tagggagaactagagtagcacttccggtgcctactatatgagcattgcttccggcaatggtcataatatttccagttttcttagttaaggtgtggaaatatctagtttcccttaagattgtgttagtggtggcactgtctactagacatatatcctcttctgccatgggattcccacccaagtatgtttatggaacataaacagaaatgaaattaaacatgaagtaagttgattctattaagggaaacattacaaggacttcaggcccaataaaagactaagcgtgctcttcaggagcattattcatgaccaaagttctacatgtgctactcatgcggaacactgcatatgactgacatataggagattacttcagatctccaaatatgtcatcatctttttcaagaaggttgtcccaatcatcgtccatacggacgtccccaccatccttaacattgataagcatgtcatcatgcttttcaatctgagcttcaggctcaatggtgaagtgggactcatgttggctctttttctcattcatgctttgttggtagagctcaaccaggtgcttggggacatggcagttacaggaccaatgccctctgcctccacatctatagcagttatcctgctttaccccagatgattcacctgtaaccttcttgagtttgcctttacctctgggtttacccttgctcttgcccttgaatatgatacttcccttacctttccctttcttttcaccatggcctcttttacggccatgtgagtttccaacaacattggcgtgtgcttcaggcactgccatagatgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctca

SEQ ID NO: 18082 - DNA, 1501 bp, Oryza sativa
accgggactaaatctttagtcccggttggtaactccaaccgggactaaagatccttttttagtcccggttatttcaaccgggactaaaaataggtatttttagtcccggattcgtagtcccggttgcataaccgggactataggggggttgtgaaccgggattaaaaagggtttgtccaccagtgacatataatagatcttgggaattccaagggatttctttttatttttgctcctactaaatagatcttatgttttccctgtaatatatatagatgtcttaatttttcatacaggtatgtgaagaatttcgagaaatttcagtggaaaaaaaaggcaaaattcaatctccttcagttacagaataaaatgtatctggaaatgattttattatggaatgaagggagtagttggtgttattgagaatgcactctgtcagggtactgaaattctccaaatcttactgattttggagatttcagtccacacaaaaccctgttttcatatcactagattaagatatataagaaggaaattaaatatcacattccggtccaaattcaaattctatctgattccatgttttgcattggaagcggaggaacaacatttctagcagctgcctagctagagtgtacaacatttatgtatacgaatcagattacatgttgacggcatgatcacaccattatcaggagtagcaaaccataatttctgggataagttttcattgttcactgttggatgcataatttggagcctacagatatatgatcatgccagctagctactacaacaacaataccgatcctatgtgctacagagaattaaggatatagaaacatcaaaagcacagccaacaaggttagaaaacctgcatcttattgaagaggcacgcatggcctattaggtacccctaagtaaggacaaggcatttgttaaggttatgtagtgaccactgaccagtcaagatgtagtgagactacacatgacggggactcctcgctcatgactcatcagaatcaccaatcatggctacatgttcgtgccggccttctcctttgcaccgtgcgttacaacggaattttaaaaaggaaaaagtacggattacccccctccctcccccgtccgaactatcgcggtcgtccgaattacctcctgaaccataaaaccggatattcttcacccccaactatgcaaaccggacgaattacccccctcgacccaatctgcggtggttttggtctatgtggtagtccagtcagcaatactatttataaaatagttgtgggacccacctgtcatactcctctcactcttcctctctctcttctctcattcttcctctctctcttctctcactgtcaactatgcaagcggtggctgaggaggcgaggcggcggcggcggcgcggtggctgagggacggtggacgagtgtggcggcgagcgcagaggctaagggacggtggacgagtgcgtcgtgggggagacctgtgacca

SEQ ID NO: 18083 - DNA, 281 bp, Oryza sativa
aatgcctctctctctaacctaatgatgctctctttgctgcagctgctggcttgggcaaagcttgctcgctttgctacctgctgcatgccctgcctccttgctctccgatcacccaaccgctccatgcacaaacctgcaaaacacctctctctctagatgtgtccctgtgtactggaccagccatgttgcttgcaagcaatgctgctgctgacaaattgggatcacaaggaaaagaattagtatattctagctagctagctgctgcatcagatattcagaga

SEQ ID NO: 18084 - DNA, 1410 bp, Oryza sativa
actgttaccgtgataattcatactgcacgtatgacgtgtgtctcatgaaacatggagaggcccggtacgtgtcagtgaattgtttacgaccctatagcctcgttgcagttgcttatatatatatatatatatgaccgtgtttagttccaaaatattactactgctactactattgaagtagtatcaatagctaaagcagtagtgaactctgtagcgttctatatccatatagacgacgactactaccgctactactatcgaagtagtatcaatgtatcgcctccggaaaaaagagggttgctgccatttctttggtttcttctcccctgatcccctcctccggagaatcttctgatttagtataacaagttaattacaaggcaatgaaatagagttaattccctgttagcaatatcttacccgaggcgacaattcacctggtaggtaaaatagggactaaagatcaatcaaacagaagtcttgtttaagcttttaaacaacctttaataaggccagccccttaaaaacgaaaatgaaacagacatgtgaaacaatgaggattaaaaggagccatttcaacaaaggtacaccaatgagctccttccacttcaacaaagcaaaaaaaaaaaaaaggaatctttcagatagcaaagaaacaaaacaaactccttggaggaggatcacaacatgaactggatcagtagttcatccattttttttgtaggaagtaaacaaattcagctagagcatacaacatagttctgaattttcttacacgtcgcactatattatccccaaaattaagcatagtaagcacgtactaaacacatctatacagtaggtaggctcgggttaaagatgtaccagtggatagcaaacattctatatatgctacagagctcgcctatgtcactctttcatcctcttcttgtcaaacatttgtaggctaaaaaataaacaaaaaaaacactgcattattgttacgtctaatatagacgaatctttggatcacctctagatcgaacaattatttaggcacactatggataacaatcatttaggcagaactcatagaagttttttaaagaatgtaactcttcaaattttgtatatcatgttaagtgcctcttgagaaaaataaaagatgagcctaaatacctgcagtgaaagtaaataggactgcattgttttgcattactatcagatgcatgataatacgttatgtatatgtgtcttagtttggccatatcacctaaaggatcctcgtttagcctatcttctaaaaataagcaaatcttataccctacagttttgtaagtagtggaattagaatacatcgcaatatagtcatatagtttacttcagcatctaattaatggatggcttaatctggcacatactctgataagt

SEQ ID NO: 18085 - DNA, 1501 bp, Oryza sativa
ttggctttgctcaaaccactgatcttatgtttaacattgttgtatgagtgcctttggtactattcatatctgtgctcagtattgatgttctcctcgatgtcacttcttttgcatatgactttcacaaacagtggaaagcctaaggactatgatgtctgtgaaggaaccaacggatggccatgcggtagatccggaaaaatcctctgaatcaagtgtaggagtttgttcaaaggagctatctgacagttccagtatttcctgttgtagagagaaccaacgggacttaaactgcaaagaagtcctacacgaatcatcaatcaatagctcccctaaccccaccgtttctctcatttttttggattatttttgggctccttgtttaatttacacgttgtcttttactgttttgggctcctcatgcagattagcttgacgctttgccttgttgtgtccggtaccatcaaccgggtgttggatgtttatgccgagcatgtatgctctatgcgttttttcaaaaaaagaaaaactctcaggaaacaacgaagtagtcctccttattctaatttttacgaaaaaggacttacctttatatgaaatacaatgtaatcccaaaaagtacgagggcattctcaaaaaaacagatcctaatccaatccctcctcttactctgctgccaacccatccccaacacgcaacatctctctgcccaatccgccatccccatccatcaggctaatccatgcggcctcctcccggccgggggcaaggacggcgccggcgtttacaaagacgacggagcaaggggacgacatgcctcctgtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagagg

SEQ ID NO: 18086 - DNA, 161 bp, Oryza sativa
agttgcagttgtatgtataccacaagcttctggtatttttgacggtcaggtcgttgatgagcgagattttgtcgaggcttccttgactgcaacctagatattagtgctggtgatagagcatacaacttggcagcttgacccccgctggatcgtgccctcct

SEQ ID NO: 18087 - DNA, 247 bp, Oryza sativa
ttttagattagacaatttatcggagtgatattgtcatatagaacttgtttttaacagagaatagcatttgcagaattgaaaacacagttgctggagtagttgctacggtgctcacggattctttttccccatatatgtgcacgccgtttgtgattctcgttgcactgcgcatgtgtgggtgatataatttctgaaagaaatttaaaacaaaaggaaattaaacgccaccgctctgactattcttagg

SEQ ID NO: 18088 - DNA, 418 bp, Oryza sativa
ctgtccgtcttgatccagccacacacacgatatgacgtttctacccctcacaagtacaagtataatgcatgtcaatgaggggtagaaatgtcatatcatgtgtgtggctagatcaataacgatcaagacggacggaaaaattgacggaagtgctaaaaatgggaacagagtgaactttggatgctattaaagtgaaccggtaactttcggtgctacaaaaccaaaaatgtgaactttcgatgctatataaccaattttgcatgcctaattaagactcgtcacaatcggtcatagagcagtattgcatccgattttatccgatgtgacggctgagctagcgtgagacctacgtggagcccacatgtcagggtgatccacgtcatcaccctccctctttctcctcttctctctttctagg

SEQ ID NO: 18089 - DNA, 423 bp, Oryza sativa
agctgtcttttaacaaattcatgtgttaaaagaatggtttctgcgagtgacaactgctttcataagtattattttagagaagatatatattccctccgtcccattttaagtatagttatggtttttcgcgaccaactttgcccgtctgtcttatttgaaaattttttgaacttatatttgcacttaaaatgggacataatgagtagattggagtaggttgcttacaaacttgcaatgtttcttggacagtaagtgaactcaaatcataattctctaccatcaatcatcaactcatcacctaacttcaaacctttttcccctaaaatcgatgtgattccgtggcatgcaaagttgcgaacgcatcattgctttgtttacctgcagcagtagaacatagagtaggagactccgttgttgcttccc

SEQ ID NO: 18090 - DNA, 247 bp, Oryza sativa
ttcttaggataagttttttaaaaggtttatttataaaataggttttcaaaagggacctaaaagtaaaaaaaatccagacgccgcgatgggttgggttgggtacttgggttcgggtgactcaagtagaactggggtttaatccgcatcaccaaacacccctccacttcgtctctctctctcgcccaagtccacacttcgtctctctctcccaagtccaaggcctcgattccgtcgtgagagctcacca

SEQ ID NO: 18091 - DNA, 297 bp, Oryza sativa
  unsure (1)..(297): unsure at all n locations
cgcagtcggatctgatttttgaagactaatgaccgnctacaaaaatataaattggggtgatgttcgctgtccgcctacgaaaatctattttcgcacgcggaccacttaagcggcgcctacgaaaatgattttcgcaggcgcaccttatatggtccgcctgtgaaaatgaggagcaatattaatagactaggctggagtagtttttttctaagtctcattctctccctcacttatcctctccctcacctctttcccttagatccctctacctcactcttctctcctctcctctctagc

SEQ ID NO: 18092 - DNA, 368 bp, Oryza sativa
agattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatcctt

SEQ ID NO: 18093 - DNA, 430 bp, Oryza sativa
attcctgcagccctagttgtggacagaaaaaatatgcatgaatgcaaaataatattgtgtgagcaaataatatagaatgatgatgtgtgtgcaaatggatgcctagggtaagattgtcttttcatataacttaatggagatgagttaacaatacttatggtgtgatagtatttttgggagaaagaggttcgtgcaatggtatttttaggaagttgtctttgtcgatgatatttctggaattagaatgcttgtcaatagtattttatagattttctctataaaattagacggagtgagtaagacaagcagtactttagggagataagtgaaatttaaatggtggttggacaactaatttgggaacaggtagccaacaggcggcaaacgacaggggcagccatcaattcctctggccgctccctccaacagc

SEQ ID NO: 18094 - DNA, 155 bp, Oryza sativa
aacttatttattcatagcttcagaactatttgatgacgtgacagcaatacaactctacttctatttcaaagaaactaaaatttaatcccatgcaattgtgcaggatatttgggtagtttcataacaatctgaaaatgtaaccagataagataagt

SEQ ID NO: 18095 - DNA, 1501 bp, Oryza sativa
tatattggatactgaaagaatatttgattactataaataattaatttatacatatggataaattgtattatacattcatctaataagagactaataatgagtagcaaacttagatttttaataacagcttgataaaaatatttatttacaaaataatatatatatatatataatttattttaatatttttaattaatgaaattgcataaagacatgtcattgttgtactctacattattacttagaaatataaatactcatactcttatcatcagttataaactatttaacatataatatatgtgtttaaagatagtgttgtttttggtaatatttatagtgtataacaaccaccatattcatgacaaatgtcactctccctttttttataagagttataatttttttgttgaactatctgtagcaatcattttataacacacacattttaaaatgaagttagtaggacaaaagacttaattcgcgcacatcctctcatatctccacccacactttttctttaatttgtgtcagccctagcttctcttgtaagacctgtcagctgctctcctcttaatttgccttaatcccagtactaataacagtttagtttgtaaaaaaaaaacatatggtgcatgtctccattttaggcctaccctgccaatagttacagcgactcgatttctaatctgaacatgtttacgtccaccaacttccaatacaaacggaaggtaaaatagttggatttcggatttcatgtacaatgcggctagggttttttggacgtaccgcagctatgtgaatcgggggatcatgatggtttctatagacttttttttttttggaatatccttgtagagtcgtactggtcatcatcaataaataacaggtctagggatacggtttttctcatttttttaattgtttttctccacggtacttgtggcacatactccatatttattgtaaggaggtgacatcctcttctaagttggtttttttacagaggaagtagtttgcaggcgcaaaagcttctcgattaggctacgaactctggcagggagcaaatgctcagtcaaatccctgtgcagccatgcatgtggtgaccgtttcacccccccctcccgccctcctggttgtgactggcagcgtgcatgtctgccacgcaaattttgtgtggttgtattttatgtcctcgaatggactgatgctccgttgtgttttatctgaaaattccctcgtgtttcacagaaatacaacacgaaaaagagaaaattccgtttctagcggtagcggctcaagggatgtaagcgggtcgacccacgaacttacttatatgttaaataaagggtaatatgtgggttttcacgtattaacttggcttgccacattgtagagaaacaagtggatctacccataaactcatttatatatcaaattggtatataagcgggtttgcggattgatctgcttgcattcctaggtagcgctgtaaaataga

SEQ ID NO: 18096 - DNA, 236 bp, Oryza sativa
aagaagaaaacgtgaaaacggtgcggcaagatttaagcaccacaaaactttctgtgttcattgctctttagcttactattcatcttcaagtttttatcaagtgagagagatatatcgatcctgtgtgtttctaccaacaagtggtatcagagccatgtcggctccgacgccgcgcgtctcgcgttcgccagtgccgcgcatgcgtcgtcaatcccgctcaccgcctccgcgccgtg

SEQ ID NO: 18097 - DNA, 310 bp, Oryza sativa
caatacaggaaaacctctcaagttttctcatcaagaaaacagcactatggactgtaacacttgacaatttgagaaaacagcactatggtggagtgtaacacttgacaatttgacaatttgcctatggagaactatgtagtatatgaatgggtaagctgctgaagcaattttcactagagtgtaactaagatcaggatagtcagctgttcgatgttgctttgaacacgttagacagactgtgagtttacatacaggctccagtgctcaatgctatattgctattgctctgcgtgtgctatatgtgacagaa

SEQ ID NO: 18098 - DNA, 443 bp, Oryza sativa
cctaatacatgtcattttcataatcaaataagttgatgcattttcacccagaatcccatcacagttcatcatacaagcaagtgtagttattaatggtaaatttttcgtttagagaaaaaaaaaggaagccttatataagatccaccggtggggtgtgaacaataatcaatgaatgagatcgcatcccgtaagggcagcctagctacacaaaaatgcataaaactcggtataccaaccacaacaacgcttgcgcacgcgctcaaatggcagcgacttcatcgtcttccgcggccaagaaacgaatcagtgatacattggcagggaaccaccaaaagaaggcccatccaatccaatccactccaacgcggcatggaagacaagacagatgattcacagctatcttctgcttctacaagtttgatactttgtactgtcctttcagg

SEQ ID NO: 18099 - DNA, 230 bp, Oryza sativa
catgtaaaaatggttccaagatttgctattccatagtggggctggcggctgctgtatattgcattggacttttgttagaaaaaggcagagcctatacagatggtaacacaacattgtcattggatatagtttataagaacatttacaaaacaattgtgtatattgtaccctgacgatcgaatatatggaaatttagtgatagtagttcttttctgcctatcttatgtagg

SEQ ID NO: 18100 - DNA, 391 bp, Oryza sativa
ttaaaaaagaaggttagtataatataaaagattttaaagagatataatatcattatataatataaaagtttttaaaggtatatatggatgaagggagtagaacgggtctattcccagtctcgagagatattccaagaccaactatatgtcttttttcttttggcaacggtcaaggtaaattcctcattattctaggtacccaaagaaaaatatcccccttttaaaaaaaaaaaaaatcggtgcagctgcaaaggagagtggagttttcaatcgagtagtggttccacttatagaagttttttaatcatttgggaggaagaagagggaaagctgttgttgttggcggcggtggggttcgcttgcgcgcggtgatgttgtccgccaagttgaa

SEQ ID NO: 18101 - DNA, 193 bp, Oryza sativa
gttctccgccggtgatcggaatccttcccctgccgcggcggcggcgaagaatcataaactgccttagagtcgcaaacttgcacgcggaagagattcgaggaggcggcgaggaatcataaactgccttagagtcgcaaacttgcacggcggagagattcgaggaggaggaaacggaggcgtatcccggcgggga

SEQ ID NO: 18102 - DNA, 237 bp, Oryza sativa
tttagggaaactccagttcgctgtaccaaagacggaatgcgtgattaattaagtttattcttttttaaaaaatagatcaatataattttttaaagcaacttgtatataaaagttataaaaaatatactatttaatagcttgaaaagtgtgtacgtgatgagttggaagctctaacacacgaaaacaaccgaagttccctcaattcttttttcttgacttgatttttcttactccagt

SEQ ID NO: 18103 - DNA, 230 bp, Oryza sativa
gtcgggattgcctctccttggcgccattggcttagcccataatcccctccgttcaacaactgatgcggccacttctctcgcctgctaccgccgtcgcggcctccctcctgggccctggccacgagcgccgtcggtgacggcggcgacggctgggttggctaaggcgagcacgagccgtgttcccctcctcgttcctcctgaccacgggcatcgaacgcctttggtgtagg

SEQ ID NO: 18104 - DNA, 585 bp, Oryza sativa
tgaatattgcctgatgatcactgattaatattagaatctggccggttgtctgtgatgactgtaaagtcctgtctgatgttgctttctcttgtagtgaaactcttcaatcaatctatcagtggcgtagctaatattctgtctggttttgttaagttcctaggaatgcggtggtatcagatagttcctttgaacttcttctgatgtgaaattaaccagtaacagttagcccatgaaccatatgaactttggatagtattggagcaaactaatgcccatcgcatagaaacgactcctaaaatcagtgtccacaattcatgaatcacatcatagatcactgattggccacctgattgagcttcagatagagaattgggttggtagtaaaatgatttgtgaagcagggcgtttaatatctggttttcagcagtgaacattaatgaatacctatatgtgtacaactttttattagccagaccgttcaaagcaaatggttgctggatttcatttttgtcaagcatgatatagccactgcctacatatgtatgctcagtcgagttgctgaaatatttttcttcatttgattat

SEQ ID NO: 18105 - DNA, 529 bp, Oryza sativa
ttctgatatacttggtggaacatcgtgcaacatgtaaaaataattcaataataagctaagaaatttttgcgtcagaatatatccatgcgtggtcttgttttaacgatttaattgcaacgaatttaatggtgcactcggatcatgatttggataaataatttaagagaaaaaatagtttaaagtggttttgcacgcatgcgtggcattggtgtcatgctgtcagcgcccgatttcccccccacaccatagggcgctcgacgcgtagatggttccagatttttgaggtgtcctgggtcagtaaagtcaatattaatttgaaacattttactaataattaaactaaaaatatcagtctttagtgtcatgcacgtagttatcatcagatttgtatttgaaaatatatttatatgatattgattcgttagtagctaataatatgttgtaaagaaattcaatggctaaaatataaacttgccatttaaaaagccaatacatcgtaaattttagaattgaagtatttttttttaaa

SEQ ID NO: 18106 - DNA, 296 bp, Oryza sativa
cactaatgatagattaattaggcttaataaattcgtctcgcaattttctagcgatatctataattggtttgattattagactacgtttaatacttcaaatgtataaatgtatatccgtatatccgatgtgacaaccaaacctaaaacttttccctaactaaacgaagcctatatttcgaaaaaaaaaaaacttgcaaacacccatcgtaagtaggccctcccgaaatacttatttcatttctttcctcgataagttttttttttctcgctggcgccaagctcgtcaattcaaaaaa

SEQ ID NO: 18107 - DNA, 296 bp, Oryza sativa
tgcaagtagctcatcaaaaaaggaaacatgggacataacaggcaatcgaagatgcagacttcttcaattgagtagatttgtgttatctttttcatcagaaagtaactgcatttctatcttattatgctttgtgaaatatgtttaaatttgtcatacattcatgtgttattctcatactaaaccaattttgtcatgcatttattttttttaattctcttaacccaataatttcatagacctttgaattagctatcaactatggtatagtacgtggaccattgatggatattacattt

SEQ ID NO: 18108 - DNA, 276 bp, Oryza sativa
gactttactcaatacttaatgatgttaaaatgttttacttttatcgtttatgcagcacacagttcgtttcaatctttcttgctgaagcactgttatgtgcatgcaatgtttttccttgaaagatgaaatgaatgaataagtacctctgcatctatgtacacagtgttgggcaactaatagaaattgttggtagggagcaatgcattattttgggcatgtattttagttgaatctctttgtagctcagtaagattttgctttttgttgcaaagtagg

SEQ ID NO: 18109 - DNA, 653 bp, Oryza sativa
ctgtacaggtgaattgtttggataagctacgagaaatacatgagaattggatgagaggtcgattgaaataacattttccaagatattagaccccatgcatgctaactttttttgaaaaaaaacatgtattaatctaatccactccaaaagaatttcacaggattttgaagtcatcaatcatttgttgaaagggcaaaaaaatagaaaaaaaatcctatagaattgttccttataacaaatcctttgatgaaaagggagccaagcgtataaagaacgtagagagtgttcttccttcgatattaattacaaggaagagtatacatggcatccctccaatgttcttatgatattaattatttcataggagttttaaatgattttccttgtgtcattcctttatgaaagggccatgcagaaataattttctatagatttcgattcttcaaagtttctttcactttttctttggactggttccaaaggagtgcttactactataaaatacatgaaacacaaaatttccatccggttgaccgacgtaaacggaagttttgtgacgccagaaacaaatggcctctcactatcattgtttgattctgatgactcccttatcattgtctgactctcactgaaaagaacatgataagtgatga

SEQ ID NO: 18110 - DNA, 318 bp, Oryza sativa
agtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaaga

SEQ ID NO: 18111 - DNA, 1501 bp, Oryza sativa
ttttggaatggagggagtaattttctacataaacatccaataaaattctcttgtaaatccctctacgaagtacagggactttgctagtttcactctaaatgaaataaatctagagcatatgcaataaaatctgtagtgtccacaaatttaatactggccagctcaagccattaatgcaaaagattgaaatcttcaataaaatccatgtattaatctatgcaataaaatctatgaatacaaatgattgaaatcttcaattgccagctcacgccagataaacccatcaaatgcatgctgcttttgacctatatatatgcttctatccccaaatccaacctgcaacaagatcgagtgaacaagaacatgtatactgcatctacaatgccaaaacccccattatattcaaccctcctcctgctgcctattctactagttctaatttcaaccacatgtatactagctgcagatgagccatgtacggcaccgccttgtcaaggaagtgagtaacacacccatcatccctcttatcatcttcttccttctttcaacctgctccaatcaccagcattctacttgactttttgtttgagatgaaggagaacaacaatttataatacatggatttcttggtcatcatttgtggtcgatgtgcagagcagacatggccagagctcctcggaaaggaccaggacacggcctacgacaccataaagcgtgagaatccgcaggtgacaaatattgtgtacttgatttcgaatagtattgggcgagaggaaaatgatgaattctgttgtaatcgcgtcgtgctggtgattggagcccttccaaccggtggcgaagggatcagcaaggtgccgcaagttggctagaattgtatattggcaaaatgaataattgattatccaattccataatatgttggattttttatggtaatctaaagttattttgctctaatatgttggtttcgctcctttcggtctgtttgctttgttctgttgttctgtgcctggtggcaagttcaatttcgagatgtaatgatgtaaagagtaacagcaagtcagcaagagcaatgtgaaatgttaaaaattctgatctacccctttatttggtgaggttaactgcaatccttattccatcatatataaccttcttttctactccctccgttttttaatagatgacgactttttcttacatgtttgactattcgtcttattcaaaatttttatgcaaatgtataagatataaatcacacttaaagtactatgaatgataaaacaactcataataaaataaattataattacgtaaattttttgaataagacgaaaggtcaaacatatgagaaaaggtcaacggcgtcatctattaaaaaacggaggtagtatctaggttcatgatctacatatatatgcaatattctacaatgatagatccgtacctttagtttggaaggaatttagtattccacttaattacctcttctagtctgatttag

SEQ ID NO: 18112 - DNA, 1501 bp, Oryza sativa
tgaagttattgttttgattaaaataatgaattctgttgcttcttgtctattgaatgaactgttttatcaatgagtggtcaggtaattatagtccaatcaactgacaaaaacgcattttaaaactgagctatttaatctttatttacgaacagagaacatatattgatatatatcagtctgaatacaaagtagcagctcgaaatatcatgaactatcaaaacagtatttattaatttaattaaaaattttaaattaataattcttaaggtgtaattaatgtggactattcttttattaggctaagtagatataatttgaaaaataatcagcatgtttaccttattcctaaaatcataatatttataataaaacaataatagccattggcgactagtattttctaattttgatttttttttaaaaagaaaacgatagtctctcatagggtagattttcctttacaacgcaatgcgattctgtcgcttaaatccataagaatttgacattcacatggtaaatgaactagcaaaacaaaatattttttttctacagaaacatgcagtaaaattctcttgtaattcccgttacgaagtataggactttgctagtttcactataaatgaaataaatctagagcatatatgcaataaaatctgtagtatccacaaatgatttattttttaaaaagaaaacgacaatctcgatctcaaaggttaattttcctttacaatgccatgcgattctgtcgcttaattccgtaagatatgtacattcacacggtaaatgaactagcaaaacaacgcactccctccatttcgtaataaggcataactattttaaaagttgttttataatataaggtgtgcatgcatgcatgtcattaattagcatttcttttccactacaatattattatttaaatcttccaccatcaaaatctttaattttattgggtgcatgtattctatttattagggtaatccaaactatgagatgataataattatttcttggtctttgggttaatgatggttatgctttatattttggaatggagggagtaattttctacataaacatccaataaaattctcttgtaaatccctctacgaagtacagggactttgctagtttcactctaaatgaaataaatctagagcatatgcaataaaatctgtagtgtccacaaatttaatactggccagctcaagccattaatgcaaaagattgaaatcttcaataaaatccatgtattaatctatgcaataaaatctatgaatacaaatgattgaaatcttcaattgccagctcacgccagataaacccatcaaatgcatgctgcttttgacctatatatatgcttctatccccaaatccaacctgcaacaagatcgagtgaacaagaacatgtatactgcatctacaatgccaaaacccccattatattcaaccctcctcctgctgcctattctactagttctaatttcaaccacatgtatac

SEQ ID NO: 18113 - DNA, 1501 bp, Oryza sativa
ggactgagaattttcgttcagagaaattatattcagagctctgagtgtcatgttctctcggtttgcaagtgcagcccttttcataattttttagtttggtcggctggacaattagatactcacagttgggtcaaaagctctgaaatgttatgaaaattatggggctcatacacatatgatgctctaaatgtcaattagaaatatgtcatttgcaaatttgtgtgttgtattctcagaaatctgttcccatctgaatttccatttgttcactcatattggtgagcgttttgaccaaaagagttcctttatgtatttgttattggccttttcaattcactgaattgcgaaatgttcggttgcagggactaagtcaagccctggagagatgattcggctaaggtgggacaccaccgatagcgaggaggtcgttcgcacccgcatcccctcaagcacgccgggtcagcacaaggcgcgcgtgctcccggcggctggccgcggatggccagatacaagaggaccaccggccagccctccatggccgacccgttgccctctttcactccatacctatccaccacgccgccatcgcctccgacaaccatcggtgtaatactaacttggttactacgagaaactctgtgacaagaccaatatgttatgttgagaatcattggtgtaatttagttactaagagaaaatgttaagaaccattagtttaatagtaacttggttactacaaaaaattttgtggcaagatcaataagttatgttgagaatcatcggtaccatagtaatttatttactaagaaatcttgtggcaatagcaatgttaattctaagtaatttatttactaagagaaggtatactataatttatttactaagagaaggtataccaatcaattgggagtactatcctaagtaagggccgtttttttgacaaattgacccttttcaaaaacttatttcgaaactaacccctgccaaaaacttcaaccaaaactaggccgtcggctcagcgccaagcgcattggcgctgaggttggccgtgtcagcgccaatgggactggcgctgacattgtgccaccgtggcggccgggccgatcccctagctgatgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtgg

SEQ ID NO: 18114 - DNA, 1501 bp, Oryza sativa
gacaccaccgagaagcccggccagttcagcaaccagatcctcaagcacgccaccgtcgtctgcaagcccatcgacgcctaggtcgatcgatcgacctactcaaatcaatcatgtgctgcgttatcctattgcactaaaaaaaggttgtatttttgtttggggggggggggggggggtagttatgtgtgtgttctgtgaggcaggcacctgttgttgtaggtttacttaacttttttttttcttatacttgttggttcaaacttaattattggtaatctatactgcccaaacattgcaaatatatcatttctggctatttacacttcatcaagacaaattccaatagccctattacagctcgtaaaacacgtaaccttgagaacatacagcttttgcctccacattggtatataggtgtcggtgtcgccataatttataggtaagtttgttaagaagattcctcatagtgaaaaaaaactgaaaatgaaaaaaacgcagcctacatagtactataggtattgaaaatataagcacatataggtttaatttattttataaataaatcacgacattgaacatatatactagtataaacacatcatacaatttacacatgtaaactagatagtagagcgtgaacatatcgaatgtacgaaacattatgaatgcgtaccggcaattttggtcgtttggctgcacagtaggaacaactcgccataacgggctttgacgttgatgtgcagcacccgagcaaagaggaagacgatccaccataacgggctttgacaatgacgtgcaacactcgagtaaagaggaagatacgagctgtggtggacgaacaactagtagtcgcacgaaacgcttttcaaattcatatgtataatctcatcatactacttccaaaaagcaagccctagtggaagaagagaaagtagccgcgaagcatcgacttggcagtccaattagcaaagaaaattaaaaagaactctttagacccacctgccatccctttccctcaaccaataatgccaccatatatataatctcataattctgattcaattactgtcataatgtatcatcaccaaatgcattatcccacaacactactcaaatatctactcatctacacatcgatttcaatggattttctaagttaccgtccacggctatgctaaagactgcagcaatgtacagtattgtcttggttaagtatcaacaccaccaccatgagggagagggatcgcaggtgggtccagagagttttttttttcctgattcaactgtcacggtggcgtcactaatgcaagcacaagtcaaaacaacccagaacagtgctaagggatgtatttgtccaatataaatagttgagggtgtaaaatatcctgtatttaagtttagggagggggtaattcagtcgactgcgatagtttaggagggaattagtactttttactagtgaaaacgaaccgattgaggactcctggaaagaagaatcagg

SEQ ID NO: 18115 - DNA, 1501 bp, Oryza sativa
ttgatgtcgattctactccactttatggttattctctgcaaaaagttagtgaaccaaatactagtggaatattattattctaacatataaatgcattgcaagcataactagttcccttctattttggtagtactgatggtcgaaactgatcgctaacgatcgtcaacacctgcggtcagtccggagttcaggctgtggtcaaaccacccacatacctgcggtctgaccggtcctgtgaaggaaacccaacactttccaaactttggcaattttcacctatttcatccataggtgccaaatttgggtgtaaacaccgacatcttcgaccctcctctagatctcccttggaaagaatgttgacatctctagcactcctctaggactcctaggagaaaactccgaccattgggcaactccttcaagagcttcctctcactattttactatattataactctactatagagcagcctaaacatgaaagtgagttgtactccactttgctgtgtgttgagagtgaagcaagctcctccttttctatagtagttcggtaagcttgggtgcatgaaaaaagagggagtaggagatgagaaaccagacttccgaacacgatgggagagaaaaaattaggatggagatgaagatataggaaaaaatgagtaaattgcacacacggtgcattaacttggcagatgagtgcaatttagtgcaagaacttgagaaatgagtgttttagtgcaacaacttggtaggtaggtgcaatttagtagtataaaatttttataagtgatcatataaatgcaacaacttgcaagataggtatgattttgatacaataacctaagaagatatgcgacaatttaattatttggagcatttttttatatagattcaattttaagtacttattttgacaatatactagcgtgtatttgtataagaatatttatatttttatcctaataactgatagctgaaagtcaattaaactggatatagaaattattatatttcggttgatatttgagaaggtgaagaaaacaaaaaaattcttaaaaggtaattggatgtaaattgtatgtgcagtataattcttaaagattaaattcaatattataaggtaatgtccgtaggattactatgtaatggcatattgatatcgtgaaaaaaattcacttagcatatgcttagccaagttgatgtaccaaaatactaataaattattaagttcttataccagaacgctttcacttgttaagttgttgtacttggacatttaattctcaagttcttacactatatcgtatccacctgccaggttgttgtaccataggtgcaatttacttgaaaaaattgagctgggtgaaaaaaatacatgcgggtctcctaactctttttacatgtgagcatcttaaggatgtgggaactttcccaacttaattatctctggttcggtatgcgtgtttttccaaaccgttaaatgatatgtttttttacaaaa

SEQ ID NO: 18116 - DNA, 1501 bp, Oryza sativa
tcgaaagaagatggattccacgcgtgtgtacagaaataattagcggcagcgcggatcttaatttggaacttgcaaagatactcctaattagcctggctagattagtttgtaaattccttgttgatgtgtcgtctcagctttaagctgcagacatgctagcaagtaacaacacgattagtacgtagtaatgtggttcttgattatgagctgggggtcttaaccttttttgtgtgacaagcaagagaagaggatttgggtacaatgtaatcctgttcttccgctttcgaaaaaaaaaaacatatagcttcacgtgcctaatcctctgctaaatgttgtgccataactgtagaaagattcgccatttggctacgactttactgtacatgccgttctttccgtcaggccaatcatacaacgctgtggctcgcacgtgtccgcagtcatatgggcccagataacatcggcctccacaatggatcgatttctggatgaagtaggccaagctactccccagagagctcaagtacctgcaagctctaatcattgtatcccaaagggaccacttatacatttggcgacaaattttgttctaaaaatttgacagatataattataatacaattatagtgtaattacactgtaacttgcatgtaactacagtgtaacttgtataaaagtttcacgtaattttgaatcgttaaatctattacaagatttgttttggtgagggagaaaaaaaatcacagcacacacatgtgtaagaatttgttcccacaacctctattttaccgaaataacatattacagagagatttttgaaagttatatacaagttacactatagttacagtgtaattacatgcaagttacagtgtaattacactacgattatactataattacatctgttaaatttttgggagaaaatttgtcgacgaatatatagcaaaatcgtatctgaaacttttgtcctttcttaattaacacaacgatgccgaagtttgattttaccaatctcgacatggtaggccctgtttagttcccgaaacataacttttcaagttgccatattgaatatttggatatatgtatagagtattaaatatagaaaaaaaatcaattagacagattgcgtataaattgcgagacaaatcttttaaatctaattgtgccatgatttgacaatgtggtgatatagtaaacatttgctaatgacggattaattaggcttaataaatgtgtctcgcagtttcattgcggaatctataatttgttattagactacgtttaatacttaaaatatgtgtccgtatatccgatgtgacaaccaaacccaaaaattttccccaactaaacaaggcctaaatctgattttgctatcagactgccactatataggtgggtcataactactccgcctgtaaaattatttttatagcagttcaagagccacatgaaaaaatatgttttcttatgcggttgcataagagacctgtgaaaa

SEQ ID NO: 18117 - DNA, 1501 bp, Oryza sativa
gctgcgcgcaaggggagctggatccaccgccgccgcgctccccaccgctggatccgccgccgtcgctttccccgtcgttggatccgccgccgccgtgcctccccatcaccgaatctgttgctgctgcacctcccccaccgccgcacctctcgactgccactcttgctcccgtatcaccgtcgttccccatcatgagaatgagatataaaaattttgaagatgctaagaaagacaaacaaaaggaagatcagacttgtaggcgagtctttaatagccgcattttcacaggtctcttatgcaaccgcataagaaaacatattttttcatgtggctcttgaactgctataaaaataattttacaggcggagtagttatgacccacctatatagtggcagtctgatagcaaaatcagatttaggccttgtttagttggggaaaatttttgggtttggttgtcacatcggatatacggacacatattttaagtattaaacgtagtctaataacaaattatagattccgcaatgaaactgcgagacacatttattaagcctaattaatccgtcattagcaaatgtttactatatcaccacattgtcaaatcatggcacaattagatttaaaagatttgtctcgcaatttatacgcaatctgtctaattgattttttttctatatttaatactctatacatatatccaaatattcaatatggcaacttgaaaagttatgtttcgggaactaaacagggcctaccatgtcgagattggtaaaatcaaacttcggcatcgttgtgttaattaagaaaggacaaaagtttcagatacgattttgctatatattcgtcgacaaattttctcccaaaaatttaacagatgtaattatagtataatcgtagtgtaattacactgtaacttgcatgtaattacactgtaactatagtgtaacttgtatataactttcaaaaatctctctgtaatatgttatttcggtaaaatagaggttgtgggaacaaattcttacacatgtgtgtgctgtgattttttttctccctcaccaaaacaaatcttgtaatagatttaacgattcaaaattacgtgaaacttttatacaagttacactgtagttacatgcaagttacagtgtaattacactataattgtattataattatatctgtcaaatttttagaacaaaatttgtcgccaaatgtataagtggtccctttgggatacaatgattagagcttgcaggtacttgagctctctggggagtagcttggcctacttcatccagaaatcgatccattgtggaggccgatgttatctgggcccatatgactgcggacacgtgcgagccacagcgttgtatgattggcctgacggaaagaacggcatgtacagtaaagtcgtagccaaatggcgaatctttctacagttatggcacaacatttagcagaggattaggcacgtgaagctatatgtttttttttttcgaaagc

SEQ ID NO: 18118 - DNA, 1501 bp, Oryza sativa
tatacacgtcattttccgccgtaatgtatagtaagcacagtttccatgccagtacactgcaattttcacgtaaccggtaacttttttcaccgcccatttcctgttttacccccacgaccagggacgggcctcggattttaagattgggtattcgatatggaaagagggtaaatttttttttttacaacacgagcacaatatttggtacgtatgatcaatgatatggtattttagtactgcttattgaattagaacttgcgacaaggtttttagcaatttccttgatttactgtgatatactttgtaaaaaaacatatgcagtacaaacttgtcagggttatggataaggcatacctcatatcctacgacttatggaatatactgataaagtataccttcatgtatacggattgttcttgtaaatatcgcgtggagtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaatttgagggagccagcctgctaggcttttttgttgggcttcttttgatcaaaaacgttgttttctttatttctctgcgtacatacgaagtatataccttatatatgtattcttttttaaaaatcttaggtattttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttgtctatatttaatactccatgcatgtgtccaaatattcaatgtgat

SEQ ID NO: 18119 - DNA, 1501 bp, Oryza sativa
gtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaatttgagggagccagcctgctaggcttttttgttgggcttcttttgatcaaaaacgttgttttctttatttctctgcgtacatacgaagtatataccttatatatgtattcttttttaaaaatcttaggtattttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctactcgtgtgggggcatgcccgggagcgaggcggcggcggcgcaggaggcggaga

SEQ ID NO: 18120 - DNA, 267 bp, Oryza sativa
acactctcactttatcgtatcttaatataattattgtctactttatctacttctgacgtatattttttatctacttccacaagctcttctaatgtaatgattatagacaaaataaacttatttgggacaaacgggtgaagagaaaaaaaatgaaattattctggaatagaaggagtataagagaattttggataatcataaaatgatgacacggtggggtcccacatccacgtcgggtggctgctaccgaccttgacctgccccagc

SEQ ID NO: 18121 - DNA, 1501 bp, Oryza sativa
actgtgtttcttgggaaaaaaaaatctgtggagctagtctaacactcaaactttggtactaccagtgtaccatctctactataagcaccagtatcccttgatcacatcgacaaatgacaactgactactccagtatactccgtacggaagcatgtacatgaagattccctcaagcattgaaagattccgatgcaattagctgtcatataatttcgagtactattaaatttctacgctactttgaaccctaggcactgtacatgggaggaagaaaaattggatacaaggacaccctcctgtttgctccataaaatcattgcaccgacaaaaaacgcaaggtttcacaaggcgacagattgtgttgactagatgcagtaaaaagtaatttttttcgtaggcattagctatagtttaacctagagatttgggtcagtaattttatttcaccattagtcaaactgataagggatttgtcctataagatggcagtatagaactgtgcagttatggcatatggtcaattgctttccattggttatgacttactgactcacactgccaaacccttaattgtggggctgactgctattttctatatcatgtgggggccttattaaaaaatatacaagctgtcaaccaacaactaaagcaaaaccacaaaaaaaataattctgaacaattgaatcgttaaatgagcaaattttcagaggttctcaaaaaaaaaaactcagatgtagacacttgggttacccaaaaccataaaatatatggactaagttacaaagatcttaagaagagtaatcaattgagtccaacaaacagcaatgatcaagcatctctcatctcaccaaacgaatcaacaaatgcagaggataccatcacaaatctcattaaacacgtggtcacaattagcatagatgaacttgcaataatcaaatcaattaaatgcatcccccaaattatcactaatcacccccttcaaaagtcactaatttacaaatttacaaatcagtccattctcacatcaccactcaccaacccgaagcgaccaaccaagaaaaggaggaaaaaaaaagatcccatttttatataaaagcccctgtctccgtctccgatcagctgcaggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggtgaggtttggtggtggctttgacccgggagagacccgtttcttggcgtcttctttggtgttctttgcttcgattgctcgatcagaatgtgttctttgtgattcgcaggctctgtcggtggtctgattcggcgggttttggttggggaattttggtgttcctgctcggttttgtgcttgctgctggttgtggtggttcttgggagcggtggagatgg

SEQ ID NO: 18122 - DNA, 1501 bp, Oryza sativa
ataagaaagttgcattggtgaatgagtaggtggtagtattaaatgaataaagttttttgattcacgaccgatggtaaataagaatataccccctccgggctgataatacttgtcgttttggacaaggatgaagtcaaactttagaatatttgattatgaatcatttttaaaatatttatctttcaaatatggtgactacatgtatagattagtcttaaaaagtattttaataagatcatatatttgctaacaattttatatatattataatgaaaaataatggtcaaagttgttttttggagaccgtgcccttgtccaaaacgacaagtattatcaacccggagagagtaggtgttggtttattttgggacagaattctagaagttgatttattttgggctgagaaagggtattacgactagtgagacataacctcatatatatggttttaaagtttcataaaaccttatccctgtacatactgagcacacatttacttaaacttttaaaacatattgtatgtgaaagaattaattattgagcttgtgattaaggttgatagtttaactattcactactttgaaaaatattgttttagatattttaaatttagtcaagattcaaataattgtggtgttttatgaaacatttaaactataaaacttgtgtttatttgtcacaaaattacaatacatgtggttacatgtggttttcttcaactttgatcatataatgtggggtttctgaatttactctttttctagagataggggggagggatgagctttggtcacgattttaattttcttttagagaatgccggatgagctttgatcacgattttaattttcttttagagaatgcctacatacattttttttaaaaaaaaacacaagtacaaacgcatgagctcactgtgttgagactgacaaatgcgagcaaccatgtcaaatctaagatttgaacctgagtggggtggttccaccacaaggaaccaatccagttgagctacgctcacttcgcatacctacatagattcttgtttgtgtataaaaatcaaggagcagaatacatgtctccgtattcgcgaaaattaaggggcaaagattccgagttttgaggaaaaatttggaacaatttgaatgaaatcattcaaaaaaaatatttccacatgaaacaagggaagttcaaattccaggcaatatattattattttatcgtagagcacaatttgaatcttctcccagaaaattccgataatgtggccatgcgggtgataggaaaatgaaggcctccaagacggcaagaacaaaatacagggcaagcctatgatcttgtcggcctccatgggcttgtcgacaagactaccctaagcccaaatcgccgaaggcaagtaactgaaccattcctttcaacagtacaggttacagacaccgggttaaatgtgtaattaggatgcacacggctatcttggttgtgcattcttcctgctcgtttcagt

SEQ ID NO: 18123 - DNA, 1501 bp, Oryza sativa
tgcaaacacaaggtacaagcgacgcatcaatggcgtcctcatcgatgaagctgtcacgttatagtttggtccccttcgacctgaatttggttggagaaaattggggatggaattaatacgggaatatcatatcaatatatcattgatttaagtcgcaactgcaatgtgttagcaaggtgggaaaaatgtcggacaagtttggttgagcgacggtcactgtcaccacgggtttggttcggttggtccttcaattcgatttaaatttactcaaagatataaatttgccacgtctttaggaacaaactccgtgtgttgcatctaccgacagatggcaagttgcttaatttatttatttctctttctcttactgtctctaatctctagtgcaaagactttggttatatgttgcattgctgcttataacaagatatgaggagataactagaaataaattcttcagggctttgatctttgtaggtcagctttttctaccctgttgtcgatcagtcgatgtaataatctctgtaaccacatttccaggatcttaatgaaatttggttggccttaatgaatgtggatgatagctctgtcaatgttccatgagagctgatcacctgaaacaagtgcagttgagctcccatttctcagtcaccacaggtgggagatgcttttgatgaactttgtgttgtcatctcggcagaagcagaagcagaagcagccaaccaggtgatcatccatggcgggtttaacgtctgcatcaagagattcccgtgggctcacgacatggattaggcttaagccaagtactagaattttatttgtagtatgtgctaaaataatacttccatgctcatgtcaaatcatgctgtttacaagtgttttttagcatgacgcattcgttttggtttatataagctgctgaatgcgtcactaattagagccataacggtgctcctacatgtttttttttatatttgctccaaatatcaacttttttgataaaacacatattaattcgtaacaaagtaatgcctttttattcccagttttactcaggtacgtaattaacttatttatcataaaaacaacacctactttttcactggtgtagaatgtattattttctaataaatggctcctaaatgatgtaatttcgtaaaaactttctacacatgaatttattagaaaataatttaaaacatatttttaactttataataattattttttgtttgcatgtatgctaaaatagtcatggcaaaatcattcagttatttagccatttggctatgtaggtaaagaaaaaaccaaagtcgaaagacgaagttaactcccaaaaattttagacaaactatccaaacctacccatagtaaattacacataactgttaactgttttaagagtaagtttactggcttcacttctgtctatattctttcacatttacattggtaatatagagtattttgggtagtaaattgttgtatgagcagaaacact

SEQ ID NO: 18124 - DNA, 1501 bp, Oryza sativa
ataataccacataagcatccaccaagcactccacggagctaagccagagccgcacttcctgaagaaaagtaagcacaaataagctcaaactctgttgatccctttgacaacaaagtaaagtaatactctaacaaacacacacaaattcaatttaggcactacaggatgcagcaacattcctacaatatgatctatctactaatctcatattaaacaatactaaaacatccaggagttcaggactgtttaagcataagcactgagacatcagacaaggacaacatacctcaccatccccacggccaaaatgcagcaagcactccgcaagcaatttcagcaccgggactgcagaatccggccttgccgctgcaacagccgctgcggccagtgcgccaatcaaatccttcacgaacgcagtgtcccccttcctcaccgcagcaaacataacgaatggcctcaaaaaccctacaaccccgtgtaccccctcggcgaccaacctggccgcctgccgctgcagctccgcgcgcgcgccatcggcccccgaggcgagcgcctggacgaacgggtgatcgtggggcgggaagcgcgacgcggcggagccggagcgaagcgcgcaggagacgagcgcggcgacggccttgacgaagcaggaggcgaggcgcggggacggggaggcggagaggggcgcgatgaggagcgggagggcgagctccggggagaggaggtcggcgcgggatgcggcgagtcgggcgacggacgccgcggcgtgcgccgcgacggccgggtgcggcgacgcgaggagcgaggagagcgcgtcgtgcgccgcggaggggagtggcgggggcacggaggtgaggaggtggcggaagagggccgcgacggcgtgccgctgcagggtggggtcggggacgcgggtgcggtcgacgagtcgccccaacgccaccgcccccgcccccgcccccgccgccgccgcggcggcggaggaggaggaggccatggcgatgcggtggccggaggcggaggcggaggcgtctctagtctactctctctctctctctctctctctctctcgcggacactgtgggctgcggggagaagaagagaacgtggccggaattggtttctgtagcgttcaattccgcgtggccttttagggcccacttctaagtctcgcaagcaactaagcccactaggcccaactcaggtgggcctctcttcggacgcatcagagagcggaataagatcactttgactccctcaactgaccgccgaatctaaatcgtatccctcaaccgcaataccagaaatcttgacccccgaacttacaaaaccggtgcaatttgactctctcggtggttttggagggtggtttcgctgacgtagcgcacacgtggcagtgttgaactagtctttgtaccacgtggcattgacgtagcgctgatgtggaattaacataaaaaaatatatgcgggcccatttgtcattcacaaaaaaaaaatcg

SEQ ID NO: 18125 - DNA, 250 bp, Oryza sativa
ccgaccagtagtagtcgccgccgccggcctcccccctccctcctccggccagatctggaaggaaggggggaggggagccaccgccgcggccccacgcgtagtcgtcgccgccgccgccccgcgccgtatttgccaccgttggcctccctcctccctcctccgaccagatttgggagggaggggggaggggagccgccgccgccagccgaacgccgtgtcgccccgctgccttccgcgccaccccgcgcca

SEQ ID NO: 18126 - DNA, 379 bp, Oryza sativa
acatttgttcatgctacattacctcgaattctttaaataatatcattacacaggcatttggcgctagttgcgttgcttcttgcggtgaagtgagcatttgatttcaggcttgtgttgcttactctatgctgcataagaagcttaggattcacgcgccaataggaatgcgcgcacgccgattattagtatgtacaggacacaccattaagaaaacggcgcagagaattacagtgttttcgaatgatacaatactagtcttacagagaattgttcggatgcatttctgaaatatgcaggagtgcatctgaagagggtttctctgtgttttgttttgtatgagcgctgtgaataataacgagggagctattttgattatttt

SEQ ID NO: 18127 - DNA, 360 bp, Oryza sativa
atctagatcaaataggacggtctaaagactttatatttaaaaataattcataactttttcatgtgaactctaatgaagacaaactttatatcaaacttgtagccctcgacacgatctacaactttgtagttgaattttttgttattttaagtcattttttgtccaaaaatataatattaaaattaaaatttcaaaatctataaacatgcaacaatattttgggaccctaaacagttttaattcaaaaacttttcaactacaaagttatgatataaagttttcaattttgatataaagtttgtcttcattagaattcacatgaaaaagttatgaattattttttgatataaaatttttaga

SEQ ID NO: 18128 - DNA, 532 bp, Oryza sativa
tccatcttgtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagt

SEQ ID NO: 18129 - DNA, 163 bp, Oryza sativa
caatcaacaacaggacaaaatgtcctgaaggaaccagaagcagcaaagcaatctgacgtttctggtgaatatgagtcagtacttgttggtaagcaaaatgaatccgctaacaatctgacaggagattctgcgaaagaagagccccctcttgtgggactgggaa

SEQ ID NO: 18130 - DNA, 201 bp, Oryza sativa
tttagggaaggaggtagtagttttatatatttcacaaaagtttttgaataaaacgaacggtcaaacatatttataaaagttaacgacgttttctaaatatttagggaagtcggctatttagaaacggagggactactactagtattgatcagcacaaacagccgaacaaagttttctgaaccaatgcaattgctcttcagc

SEQ ID NO: 18131 - DNA, 1501 bp, Oryza sativa
atatatatatatatatagaaaataatggttaaaattttttagattgtgtcattgttcaaaacgacaaatattaggaacctggatggtagtaaagtacgtacgtacatgatgattaaatccgtgagtatatactacgtacgttggtcaatatgcagttagttaggtgtatgttggttgcatagagcgatgtttttttaatatagtttataccttgtatttgtatacatgaactctatgagcacgcgtacgctcgcaggcagctggaactatttgcgaatgatgatgagatgaggaaggcactgtggtagatattcttacgagtagtggcaatgtcaccctcacactttttcttgtactgccattaatcccgatttgtccttatttatctgtttactttctccctcgctctctctctctctccccccatgtcttttttgcaacaccataatattcttcaactctcactccatcattcaatactgggccttgctttttcatattttgttgcctctacatctcacctttcccttgtgctgcagttgtgtatagtaggagaagctgatttctatatctctcttcccctctctcctaaagatcactaccagaaagaagtcatgctctcctgcttgatcgtatgctagctcatcctacagacaattctttgattcgtatccaaacagacaagattattgatcttgtttcattttccgtttctactgtttctcctctattttccattctgcagcttggatatcagtggatcttggaagaaacaagcagcaactaagaaaatctgccacatattgctgttgtctttcttcgtcagatcatcagatctatcctcttcgaccacaaataggtaaggatgagcaggttttgactagctggctagatccacctgagggaaatttgagaaaaaaaagagcatgattcagtctctgtctctcttcccttaggtactaatatatatattaatatctattcgagctctttgagatttgagcaaacatcaggttgttttcgcttcgaaatttgtgcttttcttgttgagagtcgcacacatgtgctcatacagtggatcattgtccaagcatttgtttcaatcggaccattaattctcatcggtacctatttcaaataattctacagcataaaatctacagtttcaatgtccccttgtttttctatagtttttctgtaagaaaagcaaagctaatttccccatttcttgcctccaaagtttttaaaagatcagatcaaaacaccttatgctctgaaaccctatcctccgcccatcttttcagtacaatccttgctgccatgaaaaccctaaccctagaagaagttgcacaaatactcatgcatttgtttgagaaataactgacaatttcagtaccattcttcaatttgcaggtgtagctagctagctcgccggaaatggcatcctcgtcgagcaccagcaactccgccatctcctcggtggtcgcgtcggcggtggcca

SEQ ID NO: 18132 - DNA, 1501 bp, Oryza sativa
tatattggtggaaggacctgtcctatccaattttgagagttgatgaatgagttttattgagtgttgaaatggatatacggaaattaaactgcaccagaattgagagatggaaagtagatttcttgtaataaattgttatagctttctactatctccattctcaaaaggatgacgtctagatagtgttccttttagattatcgatggatgaaaactcatgaattctgattatagagataaattaaatattatatataaattataaaggtccaaataatgcggtagacgaaagcttttcattttggagaaaatacattttttaaattgtggagtaaataatccgcagcaatagatgaataatctaaaaacaataagtggctttaaataggatgcatgcagttgaacctcaaaatcttgaattattaatagatgcaaaactaccatgatttgaaatgtgaaaaaaaatcatatcagtagatttaccatgaaaaactctttcatagaatattattaatcatttttatgaatatatggtttgagaaattaaattaaagataaacacgcgcattggtcgccgtgtcaatatataaccaggggacatttaattatttgcattatgtgtctatgacatgtgggttcagtgacaaatcgtttagaaccactcataagagtggcaaatagttaattattccatatcctaaacgtcatcctgttgagaacataggtggtagctagctaacaaggaacaagtaatgcgaaaagtcattcgcaaaaaaggtaaccccaataattaaaccaagtatgattgatggtccaggataaaaactattcgttagacttgatagtttacctggccatgcatcgaacgatcgagatcaagcaaatataatacatatgcatgcatatatatactacatgtaattcaaacatatggtcaattggatcaccgtcccagcaaacacattggcttgcaaatcgaaaaaaaaaacgaagatatttagacaagaactcacaccaatgaatctgtttctcgcattgcatgcatccatgaataaagatgagctcgtcatctccgatgattagaatggacgcagctagagacagagctagtggttgttgaggccaaaaaagcttctgctgtgacagcagcaatcacacattcacacttactaatcatgattcattgggcacctttacagccaataatgccagttttaaacctcccaattacaccattaactatatggcacaatcagagatcctctcgagacagctatcaatcaatggcgatcgaattaaacttaattgttggcactccatatatccagcagcagctgtagcagcagccagcagcatgtgatgtgagctactactgatactgatactgagctattgcgatcgcatgcgaagaagattcagtagaagttaattgcaagcttaatcagattcagtagcatttgagctgagctgagctgagatgatcatggggagagcagtggagc

SEQ ID NO: 18133 - DNA, 1501 bp, Oryza sativa
agtgtatatcagtatatgatatgctacgtgctaattaagtcattaacaatttgattaacaaattggtattgctactgagaaaggcaataactaaaatttaatttcctgcgcaaccagtttgatggagataccggggaagatactaataattcgagtaatccatggagtacaaaagataaactaattaagcaagcatgtcgagtggttggctactactaatactaatttatattcatgaatctatttacattttgtatatatactcaaataccaaccggacacctaatttcttgaattagtactacttgataccctttttaaaactatcatctagaagcttcttttcttaaactagaaagttcacgtgctaaattagccaaccctctatacacttgtatttgggccgacagcacagctagcttttatctgtagttgggctccacttctattagggccgaatgctagtctgggccttctatctctagcgctcttgggccgaatctgacgggagaatgcttccggcccatttcgaagtttgcactgaggtggtgagttggatatcaagattcgtgcaggtgcagctggttgagctgggtggcgacaaatcgaatcccagtcaaattgcacagatcttggagtggatctccctgcactgcattcgaaatttctagcggctcagggtgcagatctcgaggaaatttaacgtcggtaacagtgctgtcaaatgcatgggatcactctacctgcgacaagcgacgacgacgacagatagaaaacgatttacctgactacataaatttgttcttttttttaaaggatgggggagtattctgctaaacaaactaattaaccaaggaaaccaaggtgaaatccatctcataatattaatcataaggaatttcgatgtacttgtcacctccatcaactttaattcaattttctacctattttaaaccccaattatcgactcactagttagaaccaaatctcatttaatatcggtattctaatcttttcttactatccttaattttacccaaaagaaaataataatttatattatgacacagagagagtataccttcattcatagttttatgatgtgtctcatctagatctacattactatattttaaaacggagtatcatatactgctgcagtaactacaagctactataacaacttattgagaattctttcaagatgataatattgtttatagaagttcagaatgagacttctgtggtcaacgtttatagtaagcttggaataatattgcaagatacagatagtcagctgacacttgtgagatctaactctattataattggtgcactaatacccaagacttctgataactactagttaaactgtgaaatgtgtcagctagctataggttagcagatcgtcaatcaaaagaaaggtaatgattgtgatagtaaatctgccacccttttctagttccattgtaaattttacaaattagcctttgaatttctt

SEQ ID NO: 18134 - DNA, 579 bp, Oryza sativa
ctagcctgataatgggatcatgctatttggcttattgcaatctccatatatactctattgtcgttactactacttgacaccgtatctttaaaagtagtagtacttgtctaatgtcactgatatgtgagccagaaacgacagattgcaatgactttacaaaaggattgcaacgattttacaaaaggacatctttacatttcggatcagaagagaaaaagaagaaaaggcttgatcagaagaggaagaaaaggttcatcaagtgcattcttactgtccactgccctgatagaatcttgtcggggccgaggttttctcactttctttttgtcctcaattccctggaattgtgataatcctcttggcaaagttgccggggttgtttgagattgctggattgaaggtacgatgggattgttcattttgctaccattttcaatcttattttatttagcaatttttttaaaaaaactagctacatttagtttattgctaaattttagtaagtacatatgaaatcttgccaaaatttggcaatcttatcaaaattttgacaaccttaccaaaatttgacaatgccaa

SEQ ID NO: 18135 - DNA, 151 bp, Oryza sativa
tcctggctatactatgacactcgtattttttttatataagtactaacagagttatttgatgtatagagttatatacagtggtttgtaatagttctgtccacactgctatgaggtttactctgttgcactataattatttttttgcatcaca

SEQ ID NO: 18136 - DNA, 1501 bp, Oryza sativa
tgatatatatatatgacataaaagctcaagaatgaaatacaaatctgagcttatattgtagttctacttctgcaaggccatatagcaagtctcagatctgcatgttgtgtgatactgcttcatctcaaaattgtcaatacatgaacgtgtccatccatgtattcatggtacgttgctttcttgacattgatacccctcttgattattttctttgtactgtttacctctgcgtgttctgaagtcaaagaagctgcttattttcaatggaatgaaatcaaatctgcgtacataactcgcagagaacaactcgatcaatgtcgatcagatggatgtgcacgacactgttgtggagtccactacaaaatttccggtgaaaagaacatctgaccagttgctacttgtctctctgatgatacgtataatcaaatccttcacgtcggtcacgagcagggctgtccgtgtccatcatcggtttgcctcattatccgtcgctaccacaccacgccgcccttgcaacttatcatcagctacaaaaaccacacattatcttatcctgaaattaaacgatcagagaagaaaccgatgatttttcattagattaaggcccaaatcaagccagcaagatccaaaaagcaacatttcatcacacacacgctctcgagagatggcacgtccctctagagtctagactaaacctgcagatcgccgtcggttagtgttaaaacgacgagatcagccacgacactgacttgcagatgcagcttcttcatcactgaaaactgggagaaacaaagaaaaaaaataatcagagggaagaagattcagaaccaagcaaaagcaacgaaagtacgatacaataccgttattctatcacgcaactgttctttcattctcaagcttctgagtttaaaagagaggttgggattgagttactttttaataaaaaagatgagttattagtacgtactctttattcccaaaataattcaacctaaaataatatgtgtcttatattaggatggacaaatctatgtacattcgttattttagaagaagccgtataattttctaatcttctagattgagttattttgggacggatagaataattaattaagttttagctattataaattcgaaaatattttttttttaaaaaatactaatcaagaagcttgtgctcacggaaaacacgatggaatagctcaccccaacttccgtttcgaactcagtctcagctcacatgatgcatcatcagccatggctcagaaagctaccttaatcaagccactaaatacgtttctaatccgttcctaatacccgacacgccaatgatgaaaacaactacggtttttaagcccgtttctaatacgagacactgacaaaatgataaaaactgtcaaattgtgcgcactgcaaaccgggggctagtcagctagtgctacctgtcattagagactaattggattagtttaatcacctaattaattttaatccggcg

SEQ ID NO: 18137 - DNA, 296 bp, Oryza sativa
ccaacatctttggaataattaatctctcactaccaaccaatgcaaagcttcagttttagagcagcagagtgcagtgctcagtgctcggtagctagtagtagtagtgaatatgagtgtgtgtgagttgtacgagcaaactgggccgctattaatagagaagaaggcgagcgatcgaacgactgaacgagaggctgatcgatttgaatattgtttaaggtgcacaagatatttgcgatcgatatgtacgtgaaaagcgtgcgtgtgggtcgcgcgcgcgcgcacatgctttgcttgca

SEQ ID NO: 18138 - DNA, 228 bp, Oryza sativa
gagtggttgccatcatggactcatggttcgctcacttgagccagaaaagtcagggctaatgggcattttttttcttttttgatttacaacttttaatttctaaaaatatattttttttgaagggctcatatcatgaaaaactaaatcctgattatctaatatactttttggttactgtccacactccgttccgttcatcatacaaatttccatccgtcgccttttagg

SEQ ID NO: 18139 - DNA, 1501 bp, Oryza sativa
ggtcgacggcgacgcaggacagccaggtgctgcggctggacatggacagcatgaggaaccgggtgcaggacctggagcgggagtgctccagcatgaggagggccatcaagaagatcgatggccgcagcgccgcggcgtcgccgcgccacagcgacgccggagacgacgacgccgcgtcggccgacgggtcgtcgaggccggcgaactggcggtcgcggtacggatgcaagttcagcacgcaggtgtgcgactcgcacgcgcgcaacgtcgtggcgtcgagagcgtcacggatgggaatgagcccataggcgaatcgtctgaattctgaacaaaaaatcgatgctcgagatgaaaatgatttgagaaatcatccaacgtttccaatcgaagatccagccagaaatcgccccatctgtatgatttcgcacgcttacgttgcatcgctcgtgtgcacgaacgccactgccattcgacacggaacataagggatccgtgtgtgttgtgtgtatgtacgaaatgccattttgtagcctgtcatctgttacgtttcatgtgtgcttgtcgacttgctgtttggacaaaagcagtcgcgtagatttgagttgtcagggtgtacaatacacgtgcaggtgttgccggcctcagaaagcacaagctacaaagttggatttacccttcgatccgtacatgaaatggatcttgtgccgtaaatagatccagtagaaatgtacagattgttgataacttgatatcgtcgtttttttttcctctggtgttctgaagatgaaggaacaaatgactctccaccctgagaagcatgcaaactgagagctgagcaaaatgggttggagcatggtccatggatggaattgcttcattaacatgccttctgtgttagctgtgtcactctgcatggtggcattatctctaccattcgattggactaactaaattgtaaactgaatcttttggtcatcgtaaagcctgaaatgtagcagaaagtaggcactctcgatctactttgcctgcacagtccacttctctacaatattcttgtactacaagtatttggtatagtgctatacttataacttatctggcatttctggcttattttgcaccgccactgatcgtgctccaaatgcatctgccgggttggcagatgtcccaactcccaaacacactccagcaacttttattttcctctcgagtgcccaaacctttgtgactgccttttcagtgctctgccgcaatctacttttgttgaaatgcactcttcagatataaaaacatgtaaacaatagtctgttggtgctatgtggcataatatatcacgacagatgggagacataccggtaaacaacgatgctttacccaacactcatgagccctaaacagataatgttagaatacagattgactttaaacggcatcatggattcatggctgtctgcgtttgttgtcggagaagcagcagaagaagttcagcgcatgattttgt

SEQ ID NO: 18140 - DNA, 527 bp, Oryza sativa
aatattactacctttgccccaaaataaatttatgtttagatcttagaatgcaaattaagatagagcgaatactcattataataatataaatctggacagaggatctgtccaacatccgattctaggttgttatattctactttctccgtttcatattataaatcgtttgacttttttcctagtcaaaatttattaagtttgatcaagtttataaaaaagtttagcaacatctaaaatatcaaattaattttattaaatctaacactaactatatattttggtaatatgttttttttatgttgaaaatagtactatatttctctataaagtttgacttgagaaaaagtaaaatgacttataatatgataaagaggaagtagtgttggtgatgagtaatcaagggtattgaagattttgtggaccagggtaggtagaaggaagataactgaacttattttgggacagatgcaatatttagagagatatagaacggagagaaaaagaccttgctgtccctcagtgaggga

SEQ ID NO: 18141 - DNA, 296 bp, Oryza sativa
tttacttgtggggcataataacaattaataagatagtacacaagttattttttaactgtgtcttgaaaaatggcaagcatataaagcacgtttttcaacgccctcaacaggatatgagtgggtgagaatatatagtatgtacagtaaaaaggtactgttaaggacttttgatcaattgaaaaataactcattttcggatagccaacatttgtcacacgatggcattgctcaagtctttaatacatattgatataaactcctgacagatataagacatgcgcatgaaaacaagcaaa

SEQ ID NO: 18142 - DNA, 185 bp, Oryza sativa
ggtcgatcgttccgagcagagggcggaacaagtgaccgaacgaacggcgcccgagcattttcgtcggcgtttctggaacggcttctgtttctctccactgtcgcagcggtggagatctttcgtcaactgagtttggagctgtctgctctctctctctctctctctctctcccgttcgcgtgcaga

SEQ ID NO: 18143 - DNA, 498 bp, Oryza sativa
caaatttttttttcaaaaatatcacatcgtatctttgaacacatgtataaagtattaaatatagataaaaagaaaaaactaattgcacagtttgtatgaaaatcgcgagacgaattttttgagcctaattagtccataattagtcataagtgctatattaacccacatatactaatgacggattaattaggcttaataaattcgtctcgcggtttccaagccagttatgaaattagttttttcattcgtgtccgaaaaccccttctgatatctgatcaaacgtctaatgtgacacttaaaaattttcttttcacgaactaaacacaccctcggtcgatagtcagttgtgtacccctccataaaaaaaaatcaaactctgggtcacacacaaggtttgattctttttgggacaagccagtatgcagctatgcagtgtctgaacgaaaaccaacggcagcagtagttcaggacttgacgacctgaccagatgacaaacga

SEQ ID NO: 18144 - DNA, 208 bp, Oryza sativa
gtacattgtagatatttggattgatgccaaaatttaccaaaggtatttgctaggacaccaaaccaaatgatcccactctttctaatgtttactagtagtaccacttgtttaatgttttttttaacggggacgatatggattgatcttgtgagtagagaagcagcagcagcagaagatctttggtgaagcaggatttgccgtgacacaa

SEQ ID NO: 18145 - DNA, 348 bp, Oryza sativa
ggggtatacccttattacattatttcaaataagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttatttgggattaaaatatgccgaattatgaccaaatttccaccaatccaaaaacctgataggtcattctcggtagttggctttgctgctgcactgaaaccacatgcctttgatggttcaaactataagagatggaaagcacgtgcactattgtggttgacagcga

SEQ ID NO: 18146 - DNA, 584 bp, Oryza sativa
gtggtcaatttagtgagaggggtggtccttctgctccctcttctcagctaaatctaatacctgaatctgatggcttgactgtttctgatgaaaaatttgatggtttaaatgaagagactataatgggtgacaaggcccagattcaggaaagtcttgtggcaaagctctctgctatccctgaggcagtaatctttccatcaaggaagagtaaaagaagggcaagtgatagcgatcagcttgttcttgaaagggccgaaaagttgaaggctggtaagaacttggagaacctgcaggctagaggtaattcagttaataatgtttcttttacacatttttcaaatgatcaaatatctgcacatcatcataatcttggtgttataccttctagtaaaaatgttgttttagatgatgtaattaatgatttgaaatgtgtagaaaataataggataagcgaatatgcttgttcttctattaatcaagtttgtacccctaatgttgatactgagtcattagatgaccagttggaggataatttttactacaacatttatgtagtgaaattatggaagaggtcatggatttta

SEQ ID NO: 18147 - DNA, 909 bp, Oryza sativa
ccatgggattcccctgtctcacgcgcccctagcgcccccccctcgcgcagcgtgccgccatagccatggaacaacccgctgctgcccagccatcatcatcagcagcgtcgggagcaggagcaggagcagcgggcccggttcttggcaaggtcgcggggcaggagggtgcctccacctccgccgccgcggcggtagctgctcgtcggggtgagggtgactgccgcggggaggaggaggtgccgctgcgggtgcggctcgggagggccgcgaggaggcgggctgggccctgcacgccgtcgccgtcgtggaagctggagggggaggaggtggaggtggcggcgggggaactggctccggtgcacccggcggtggcgcccgccaggcggagctccgcgtcggcttccgcctcggcgcggcagctgggagccagcctgtgggagatccacgacgtcatgcgggaggggcgcggcggcgggtcgcggaggcgcaggagcgggaggccgctcgcctccgccggcggcgagctgcatcaggtgaggggttaattaataggtgtcttccttcgaactagcccaaaacctcctcctcatgtggcaaaagtaacatcaactgaattgtaattcgttggcccgcagcaacaagaggaaggagactgattactgctagtagtagatgatttatttacttaaacatagcaaatggatgcactagcactgatgaaatgtagcccaaaaccaagacatttgcagcgctcgatttactgtctttccatgtttttgcctgtttcctggtgtgatgttctgctttttgtttgtttcgactgtttcttccattagtagtgggcatttttttttgatagtagagcttggtcgtcttcactaaattgattttattaatgccgctactgtt

SEQ ID NO: 18148 - DNA, 1501 bp, Oryza sativa
cagttgatgtaaggaatgcaggaaacttcaataacacaaacagagagggcggaggacaaaaaagatgaggcgtaatgatgaaagaacacacaaagttgttttaacacaatgaaattatatggcactagagagatcatcaactacaatttcctacatcgaactagccagattacatacatatatataagcaggtcagcaacgtcccaattaatgtttacaggcatctattgcagctgacggattattagtgttgcttcacaaactaaacttataaaccaaattaatcagcaacgtgcatgtgtgtgcatactgctaaacacaattggccaataagctcaaagacgagtatacaggggtagtccggtagattagataacaattacagtagctcactgaattgttcttcccatcatcttgcacatgctaattccattgtcagttggttaaatatggagtagttcgatagctaattagacaagatggatatcactagatcgaagaccaagtcatcatacatatgaatgcgttggctggctcgccgaatggatggatggatcgagtttaatctctacttgttcagaaatcagaagaacagaaatcagaagaatgcacagctgctttgtggattggcctgctgctgtgtctagccacctcccgcctccctttgctgcgccgcctccccgtgctgccccatatctcgccggaccctacgcggcggtcgcggccgcgactagcgcctcagctataccacaagccctagcccatggcggctgcattcggcgccacacgctgtgacgcagtgcaccacgcagcttagacagttcgaacgagcgagaggatgcagtgggaggaggagactcacgtacgtgtgcttccggcgagaggcggcgcagccgcaataggcgggagaagggcggagacggccatgccgacggcggcgcggcggcgcgagatgtccgcctccggtggtttcctttttttctctctgattttttttttcacgagaggagtaactgagctggatagggctttgtttgggctcagtgcagtatttgttttccttggaactgggctgggcaagagcttaggcctccttctatgcttgtccacctcatacaaaagatagaaaaaaagtctacctctctaagattgtctcatagcatattgtttataatattttgggttccacaattcctctcacattttctttaggagcttagctcttgaagaagagataatgcattctctctccttatcttttttctcttccacatcatataaaagctgatgtggagatttatgagctagctgactcacccttgttagaggaggccttatggcccaacctttcgaaacatgatactacatgaaaaaaagatattctgatttacatgaagtgccttgtgatactgttagactcatatttgaaaatgctttttacataaagttggttcgtagttcttgatatatactaatatattgttttaaaaaattaatagtt

SEQ ID NO: 18149 - DNA, 1501 bp, Oryza sativa
atgaattaaatggtgtatcaattctataaattggatataaattggatatataaataaataaatcagcaaaaatcttttatttaagatagaagaaacttttcttccatctaaaataaaagaatgtacggcctcctcgccaacttcaagaacatcttcgacaagttcaccttcaaggattcctctgctgccgccaaggtatacagtagacaaacagattggtataagatttatctcctacgcagcaagtttggctgccctgtgtggagatatttgacaagtggattggtattttctgataggattacgagaagaaagatgaggctggcactgatgcggcaaacaaagctgcaggatctgattctgacgacgatgacaagcaggggacacggcaaaaagaaggaatatttgaaagatatgtgttttgcttatccgtttgtttgcaatggctaaaatgtggattcgtcaatcatccggtcattagaatttaaattagaatttaaattagagtaaagtccatcaccggtccctaaacttgtaccgctatgttatcccggtccctaaactcgcaaatcgatcgttcaggtcctcaaacttgttcgattgtgtcatcccggtccctaaacttgcagatcagtcgtttaggtccaccaacttattcagttgtgtcaccccggtccttaacttggatttgaatatctagatcaaataggacggtctaaagactttatatttaaaaataattcataactttttcatgtgaactctaatgaagacaaactttatatcaaacttgtagccctcgacacgatctacaactttgtagttgaattttttgttattttaagtcattttttgtccaaaaatataatattaaaattaaaatttcaaaatctataaacatgcaacaatattttgggaccctaaacagttttaattcaaaaacttttcaactacaaagttatgatataaagttttcaattttgatataaagtttgtcttcattagaattcacatgaaaaagttatgaattattttttgatataaaatttttagaccgtcctatttagggaccggggtgacacaactgaacaagttggaggacctaaacgagtgatttgcaagtttagggaccggaataacacaatcgaacaagtttgaggaactgaacggtcgatttgcgagtttagagaccaggatgacacaacggtacaagtttagggaccggtgatggactttactctttaaattatatatttgaaagctatgtgttttgcttatccgtttaagaacggtttcgctcaattggtaaataaatagttgatggttcttctatatagtttacctgcaggtcaatcagaaataagcacaagttaacagaactaagtattaaatggttcccgtgcataatatgttttttcccaaattaattctgatgatcccctatatgatgtgaaacaatgtctatcaactttacgttttagttagcgaataatgcatattt

SEQ ID NO: 18150 - DNA, 1501 bp, Oryza sativa
accttgatttgattaattagtgttgtcttcatcatcatacacaattactcctttgaaacattgaaacaattctttttccgccactaattaactcgcacacatccatggattagcaaatcttaagatcatttgctaatttaaccccctagctagtgcaatcgacaagcatgcatggtgtgcatgcatcacacaacactgcatagatgggtagctgatagattcttcagaaagggcatgtatgcatatgcagcacaagataattataccaacatgctacagaaaatttagtaactttttagccaatatataattaaataattaatctccaaatcatcgttttgctttacagctttatttggtccaacgtaagatcgatcgatttgatcgattgatctagctagccgcccaggtgcagctgagaatgacactagttaaatcaaagtagctgcccatgtggtcattaacaattgaacttaacctgcagagacctgcatgccccaggtgcatatatatgctaattacaccacctaatttgttgtatctacatgccatgtattctgcttagtggcttaattaactgtgcttaattaaccctactgtttacatccgtgcatgcgtgaaatgtgactaatatgtctactaattgtcatcagctagttaatccggatttatatatgtactgctgggatcagcatgcttacgcatgttgtatcactgtatcagtgtatcacacctactgcagaattatacttgactgcgactacgtggctaattaattccacatttcaactaccgctaatattagtaccttaacttttgtaaatatttaagcatctttaattcaacatgctgttgatcaacggagatgctggaaaatgattcgaatcatttttttgggtgatcgattaagctgttgcagagcttcctggtccgggcctagagacgacagcatttgggcccaacccaccactccaattgggccatcctacataatgggccgggcctaacaccagaagatccaaatctaactgatttctggtgggcttccgctttcaccggcccaactcactaaccttctagaagctttagctagctaatctaatcatcgcactagctagctaaagcacccactctaactactactgttagacagtctcgctctctgacaggtggggcctgttaggtagtgagagcttatcagagcaccgtacttgtagtagtagcaatgcatgaactctccttttctttgaagtggttgcagcaagccagcaaagagaatatactgcaattttcaaactccttttgagaaaaaaggggagaaaaatattgtgtagaatttgaatttattattctccactaagtcatttacagctagcaggtgattataaatccaattttaaatccatttcgacgattcgatattcatggagccaaactgatcgttcagtcacagacacagctcagagctctcgagagagagcggcggccatggggttcgccg

SEQ ID NO: 18151 - DNA, 1501 bp, Oryza sativa
atgaaattgctagatttttgggatatacagaatcctcctctcctgtagaattgaggtcaaattcattattcagagttctaattcagcctctacaccttgatttgattaattagtgttgtcttcatcatcatacacaattactcctttgaaacattgaaacaattctttttccgccactaattaactcgcacacatccatggattagcaaatcttaagatcatttgctaatttaaccccctagctagtgcaatcgacaagcatgcatggtgtgcatgcatcacacaacactgcatagatgggtagctgatagattcttcagaaagggcatgtatgcatatgcagcacaagataattataccaacatgctacagaaaatttagtaactttttagccaatatataattaaataattaatctccaaatcatcgttttgctttacagctttatttggtccaacgtaagatcgatcgatttgatcgattgatctagctagccgcccaggtgcagctgagaatgacactagttaaatcaaagtagctgcccatgtggtcattaacaattgaacttaacctgcagagacctgcatgccccaggtgcatatatatgctaattacaccacctaatttgttgtatctacatgccatgtattctgcttagtggcttaattaactgtgcttaattaaccctactgtttacatccgtgcatgcgtgaaatgtgactaatatgtctactaattgtcatcagctagttaatccggatttatatatgtactgctgggatcagcatgcttacgcatgttgtatcactgtatcagtgtatcacacctactgcagaattatacttgactgcgactacgtggctaattaattccacatttcaactaccgctaatattagtaccttaacttttgtaaatatttaagcatctttaattcaacatgctgttgatcaacggagatgctggaaaatgattcgaatcatttttttgggtgatcgattaagctgttgcagagcttcctggtccgggcctagagacgacagcatttgggcccaacccaccactccaattgggccatcctacataatgggccgggcctaacaccagaagatccaaatctaactgatttctggtgggcttccgctttcaccggcccaactcactaaccttctagaagctttagctagctaatctaatcatcgcactagctagctaaagcacccactctaactactactgttagacagtctcgctctctgacaggtggggcctgttaggtagtgagagcttatcagagcaccgtacttgtagtagtagcaatgcatgaactctccttttctttgaagtggttgcagcaagccagcaaagagaatatactgcaattttcaaactccttttgagaaaaaaggggagaaaaatattgtgtagaatttgaatttattattctccactaagtcatttacagctagcaggtgattataaatccaattttaaatccattt

SEQ ID NO: 18152 - DNA, 409 bp, Oryza sativa
cttttgctcaagagtactgcctctgcctacggagcattgttcaagagtagcacaaattgttctatcaacataaggatgttaactagcagaacaacataacttgatggcgccatcgaaactaagttacctgctctgcgttgatttcctggactgctcccaattcaggaacaaacatgcataacacagacgcccaaacatgaccgaatgttagtttgtcacgacaaatagtgctaaatgcagcgattgctctgatgatttacacgccaaccgtttcactgtttcagtaaaaaatgatggaaaccaagcccaaactaattgcgaggaagcacaacagagagagatggagggagggagatctggggtactcacggcatacaccttcctccgcgaaccacccatccattgcagc

SEQ ID NO: 18153 - DNA, 1501 bp, Oryza sativa
aagcgctccctgcgtctgcgtgcgccgaacgaaagtcggaaagaggaaaaaaacgctaaccacgactccgtctcttcccccaaacaaaaaccaggtgaaaaaaagaaagccgcgttccccactcgccgccgcgccaccccgcgacgccgctgccgccgcggattccttcggcgccgccaccgccgcggtaaggtaagccccgccgcactcccgttcctctcctcccctcccgaagcctccgtcaccgctcgcggtcgcggagataagatccatttggatgaacagttcatctacctttgttccaccagttcagtataggtgatgcccccccgcgccgccagtgagcatcgagaggaaattttagctaagctgtttgtcactcgcatggtgtagcttgcgttggtcactatattaccctttttttttcattgcgaatggtgtggagtgggtttaaaactaggtttgagcatttgagaattgacatgttgcagttcctaggatactacttgtaagagcatttcttgggttttctctggttggtatggtacctcagttgagtggataacttgggttgattttgttatctaagtgcttcgtattcgtttaacaagaacttgttcgtatgctcctcatacatcatggactcattgttcatgctatagattactgaaactggatttgaggctttgagctgatcttgaattggggtgcattcatgtttggctgcagagatggacagatttgtgcgagtttacagtggcggggagctggtgaagggtccaaacggggtggagtttggcaacctcgccgaggagggtttatggttcaaggcgaagcctgcattcgatgaactgattgatgccgtgtacaagaagctcgggtgggtgcctacgatgctcagcattcgtgcgcagggaaggttgaacgttggtggtggtgctcatcggcacttcatcatggtgcctatcgatgatgacatgtcatggagtagctatgtgaaagctgttttcaatgggactgagtggaactgcctagagatttttgttcaagcaagaatttgttccttgacagagggcatatcctcagagagagcactaatggctatcaaaccgctttatgcacaacgtcaaaatggccaaccgcagaatccagaacaggacatgtcgtttgttatcccttcaacggtgaatgttagtccactaaatggacatcctcagaacacacggcaacgaaaaccaagaaagagcaccaggaccttctctgatgatggttgtccagatcagaatggagcttcagaagcagttgataccacttcctatgatttaattgggcagtatgatgctgatcatcgggctcgtgctttagcatcaggccaggtagatcaaagagtacctatagcatttatattacaatcttttgtcgtgtaacaaactgttgatttgcaatttccaatgtttggtacagcatttgactgagctcaaccctcgtacccgtgaacctc

SEQ ID NO: 18154 - DNA, 630 bp, Oryza sativa
tttgcttattggaatggatacgtcaagttgaacaagctgtcctgagcttgaatgatatacaacattatagtacttttatgattcaattattgtaagaccgtggttctaaagtgtgtgacaatactaggtaacgtaaaaagttagtacataaatagacgtgtttcctgtccaaattactcaacttcggtctgtgttttgcagccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccaggtaggcattgtttttgctctgtcctgatcaaaacttaacaggctatcatctggtagtgttgtacttaatgtccttctaattgttggtacccctgctgctattttttcactcacaaacaacggcttaacaaagagggtttcagttaaacttattgcatgttgtgagatgcagttatcactccaccttgcacactaaccactgcaccaaggtcatgctaaaatgctgaatgctctttgttttcaga

SEQ ID NO: 18155 - DNA, 1501 bp, Oryza sativa
gcatccggcccctcacgtgcaactgcaagctcaaccggttgctgcccaagtacatcctcaaccgcctggccaagtgccacatacaatggcagaaggggcttcggctctgcaggcgcagctccaagctttccttcaacagctcagccaaccccacaacatttcaagtactgccccttcggctcacccggaggggaatacaagtcatggtgcacctagttggttgccttcgaatcagccaggtctgggggcttcgccgtggagtcaaggactgcagttcgactccatcaatgttgctcaggcgccaaccgttcggctgcaaacaccaacgccaggcttcggagcaaagcaagcaccaaaccaggtcaccatgacatggtcacaaccaactttcgacccatccatggcggctcagcaaacatcaccaatcggggccgggcagccgaatgccatggcccaaccacacgcgcaagtcgtgattttgcccttcgccacaccgtacccgcagcaaggtgccgtgaacagggcagggggcgaaaaggggctaccgctcagtgggggaatcaagacccatccaatcccaccccagttcaagttctcacccgtccacgctacttaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccaaccaatagtatttactgatgggagcaattgcgcgatgtctttgtccttaactttcgaggcacctatgagaagccgaagacgcagcagcatctactcagcattcgccagaggccgggggagtcgataagggagtacatgcgtcgcttctcgcaagcccggtgccaagttcaagacataaccgatgcgtctatcataaacgccgcttcagctggtctactcgagggcgaactcacaagaaaaattgccaacaaggagccgcaaacgcttgagcacctacttcacatcattgacgggttcgcaaggggcaaggaggattgcaagcgacggcaagcaatacaagccgagtacgataaggcctccgtcgccgctgctcaagcccaacaacaagttcaagttgccgaaccacctcctctcgtggttcgccagccccagccggcgatctaaggacaactgccaaggcaaggtcaagcccccatgacctggaggaagttcagaaccaaccatgcgggcaaggctgtgatggctgtcgaaggagtgcaagcccttcgcaaggagtttgacgcccagcaagcaagcaaccatcaacaacctgtccgcaaaaaggtctgaaaagacctctactgcgccttccatggacgctcttcacacaccacgaagcaatgccgaaacattcggcaacgtagcaacgcgcaagatccaaggacgcaacagggagcagcggtcgaagcaactcgtgaagtagctcaag

SEQ ID NO: 18156 - DNA, 349 bp, Oryza sativa
atagtaactagtatttggctactgctgtggcaatgtattggttcaaatgctgagattataagacgctgcctttttagaatggttgtctcgttgtgcaatgattagtgaacatatcatgtgttggaatgtgcggggtctaaactacccggcaaaaagagaagcaatccgcgaagtggcaaccaccaaccgcatatccatcatgtgcctccaacatacaaaattggcaatcatggaccaaagaatgtgttcggaaattgggggtccaagactgaataatttcagctaccttcctgctgatgggagccgtggaggagcagctaccttttgggatggatgatatcctccagca

SEQ ID NO: 18157 - DNA, 872 bp, Oryza sativa
gctgggcgtcaaggtggcacagcgtggaccgtcgacgtcgccagcccgctcagcgtcaaggtggcacagttctccatctccggcacgtacatcatcgcctccgcacactgcctccacgacgatcgctagaccatcgaggaccccgtgttgacacccatggggttcctgccgtcatcgttgctcgccaccgtgcggaccaggcggcgttgattggggaggcgggaaaggacagcgacgaagaggaccagatgcagaacgccgccgctagccccctcccagcctgttgcgtgcactctagctgcggcgggatgcggaacgtggccgccagcccgccgccgccagctcgagttcggcgtcgggcgagaacgacgatgacgaggaggaaaaggccaccctgtcgccacgcagcaccagcagccggctggctgacatgtgggtcccacctgatgactcagccattcaacggggtcaaagatgccacgtgggacaaaaaccgcctccgaaaccgcccgggaagtcgatttgcaacggttttgggagttgggggatatattacacccggttttgcggttgagggatgcgattcaaccaagcgcaagagatgagggaggcaaaatggacttattcctatgcaaaaccttaagctcctatttaccggcccattaaataaacgtgttaggcctgccccatgaaattcctgcagtccaggcccaggtatcggcccggccccacaggtcggtcatcttcctcgagtcgagggagacggtggtggaagcgtccagaacgagcgccaacgacgagtcgtcaccttcctcgcgaacactcgcgaacgctctcctctccatctcccgatcgccctccgcccgccgccc

SEQ ID NO: 18158 - DNA, 1501 bp, Oryza sativa
agggcaagggagaaatcaagaattctttttttttatttacggggagagaaatcaagaattaaatagcatgccaccagagaaggcatgtaattaatcgtttgtacgtgcgtattcacgatactatcaccctctgggcagtgtgaccctcgacaaagcgatcctcgcaatcaaaaacggatcgtgcaatgccagtgcctgcgcaaagactttggccccgttcttttctacgacaagaattgaatgaagattaaaattttcgtggcacgtttttcaaactactaaatgttgcgtttcgtgcgaaaactttatatgaaagttactctaaaatatcatattaatctactttttaagtttgtaataattaaaactcaattaatcatacgttaataccacatcgttttgagtaaaaaaacttaatcttcattttcaagaaaaaagaacaccacctttgtcgtgcattaccgatgcatatgagacatttaactccatgccacttttaagatgtggtaattaattatttaccacccgctgtctattacacgtgggcctctttacaatgcgtgagcggtacacggcaacgacaattgtattgtatctccatccaacggctataatctatccgtggaccgcgcgtggccacgtatgccgtaacggcacggtagcaggagtaggagcatccaacggctactttcagtcccagctacagcctaccgtgtacagtaaaagcacgctgagttctgcatggaaaggttccacctttcggaacgacgaagaatttttttatgggaattaaaaataattaataaaaatcatgtaaaatgcctgcatttcaaaggaatatgtagaaatggttaaggggccataattaggacatgcaagtcattttccattgtcatatctggtgtctaggtccctatggcacacgaagaaattgtttagaagagtttccagtagctgcaggctacaacttctcttacaattatccagtttttcttttaagctaagaagataggccatgcatatgcctgagcaccttgtttaatattgctttaattttcattattaatgttcatgttacgatggtattcttgaaatattctgacttcatttgaaacatgttttggttttggatattggttataattttcttctaattacccttgtgttaacaaccaaatttagtaattcaagtatcggaggtgaaggtaaaaccgaagcggaatccaagaaggagatcgttccgaaaacagagcaagaatcggctaaagtccgaatcggccgcgatcaggattggcagagtgcgagtcggacaaggttagccgattccgacaatatgacttgttacacgacatcgggttaagttaaagtgcttcatatggattgccatgcatggattgagtcctgaaaaggcaattgtatctattaattaggatattttatgtaatttccttaaagataagtttggacaaaagtctgccgcaaagacttatggtatcttaga

SEQ ID NO: 18159 - DNA, 1501 bp, Oryza sativa
gtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagtttccttcggtgttccctaccagaacaagagaaggatcctaacgatgcgagtctactgcgctgctgatgaaggttagtctaatggtaactgtagattggcaagttgtagaagcggtcaaatgttttattttaggggcaaatgcaaatttgccactactttaaatcgttattgcaaaactgccactagaaaattgcaaaaatgccactagaactgtcattcgagtggcatccttgcaatattgaaaaaaccggtggcattgcaaatgccctattttacagttttttattctggagtgaaatttcttgtacccaggctcagatcttgaggtggttataaacttttgatgtatcttacactagggactactatttcaactcttttcttctttttttttttaaaaaaataagtagaagtatttatgtcctttctaggctaagcattgcacaccacatttactttcaaggtacaagagtgtgtgtaagttttgaactttcacacactgcgaatggctgtgcataatgtctacaaaatgtgctgcataagttcataatgagtcatcacagaactcagtttaggaaaatgtacatagcctgctatggaatattatggcacaaatttcccaatccatgcatctcgtacgtaagtaaaggactaagtctaagcaattcattatgggattaggagattgcagattgggctttattttaatggaagacaaacttgtgttttttttctgagtaaaactatagaactgatcgatacgagtgcattttgtgtttttgtgattttaagaagaggaagtcaatgacttgggagtcaacgtggcactatccatgctaaaattttacaaaagtgagttcattcttgctgttttcatcttaaacccttgtatttatgtgcagcaatcattggccttgcgcccttgccttttgatatcaactatatctctatagcttgctctcctttatgtgaacagg

SEQ ID NO: 18160 - DNA, 1501 bp, Oryza sativa
ggaaaaaacatattatgcacgggaaccatttaatacttagttctgttaacttgtgcttatttctgattgacctgcaggtaaactatatagaagaaccatcaactatttatttaccaattgagcgaaaccgttcttaaacggataagcaaaacacatagctttcaaatatataatttaaagagtaaagtccatcaccggtccctaaacttgtaccgttgtgtcatcctggtctctaaactcgcaaatcgaccgttcagttcctcaaacttgttcgattgtgttattccggtccctaaacttgcaaatcactcgtttaggtcctccaacttgttcagttgtgtcaccccggtccctaaataggacggtctaaaaattttatatcaaaaaataattcataactttttcatgtgaattctaatgaagacaaactttatatcaaaattgaaaactttatatcataactttgtagttgaaaagtttttgaattaaaactgtttagggtcccaaaatattgttgcatgtttatagattttgaaattttaattttaatattatatttttggacaaaaaatgacttaaaataacaaaaaattcaactacaaagttgtagatcgtgtcgagggctacaagtttgatataaagtttgtcttcattagagttcacatgaaaaagttatgaattatttttaaatataaagtctttagaccgtcctatttgatctagatattcaaatccaagttaaggaccggggtgacacaactgaataagttggtggacctaaacgactgatctgcaagtttagggaccgggatgacacaatcgaacaagtttgaggacctgaacgatcgatttgcgagtttagggaccgggataacatagcggtacaagtttagggaccggtgatggactttactctaatttaaattctaatttaaattctaatgaccggatgattgacgaatccacattttagccattgcaaacaaacggataagcaaaacacatatctttcaaatattccttctttttgccgtgtcccctgcttgtcatcgtcgtcagaatcagatcctgcagctttgtttgccgcatcagtgccagcctcatctttcttctcgtaatcctatcagaaaataccaatccacttgtcaaatatctccacacagggcagccaaacttgctgcgtaggagataaatcttataccaatctgtttgtctactgtataccttggcggcagcagaggaatccttgaaggtgaacttgtcgaagatgttcttgaagttggcgaggaggccgtacattcttttattttagatggaagaaaagtttcttctatcttaaataaaagatttttgctgatttatttatttatatatccaatttatatccaatttatagaattgatacaccatttaattcatgtacttcatctgtattttaatgtatgataccgttgactttttaaccaacgtttgaccactcgtcttattcaaaatttatatg

SEQ ID NO: 18161 - DNA, 436 bp, Oryza sativa
attcttagcccaagccagaatgcacgtgggccacaaaatttgatggcccagcatggatcgacgcccggtggcccatgttgcgcggtcgcgtcgccgccctccccccttctcccagacccagcgtggcggcgccgccggccgcccccacctcaccttccgccgcctttgcctcccgctttctccaagcgcggcagcgccgccgccgccgccgaaccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggagga

SEQ ID NO: 18162 - DNA, 1501 bp, Oryza sativa
actggcattctccaagtacattagctaagcactgatcatgttcaagttgtgggatatcctttgacagaacaccatgctttctgctaataaaaatcactatagcacaaagctcaacaagttcaggtacagcattggacaatacttgcacagcaaatgcatttggaggacacctttgcaaagtgacaattacatacacacccacatttactaccttttctagtagtataacagactggtagaaactgtccccaagatatcatacaccacccttcaacatcaatatatatgctcatcagaagaaattgccccatgcttgcaacaatgcaaccctgctggtaccacatcactgagctcacctgctggctggctgaaagggtctctttctgattctctgaaggcatacacaacatacatcattgacagctggacatctgaaacaatatgtgtccttcacttgcagagcagagggtgtggctttacaggctttaagcaacatttgggagcagtgacagcaggcaagaaaatataaaaagggagatgctgctttttaggattggtggtactatcaagcaagtacagagagttcaggcatgaggaaaatagtgttaacgtatccatccaaaaccaaagagagactctgagtccgggagtccctgatgcagcatgcatgctcctttacctgtctttgcacaatcacatgccattgctatgtagtatgacacagatgctgcatcagaagcaggcaaggattctggcactacatgaacagcacaatgctgtatgagtaattgggataaagtatggtacagtttagcagttagtagtttagtactataggacataagtagaagaacattatggataaacatgagcttcaaatagcatcaaaggaacttgacagaggagataagtataagaacattagggataaacaatgagtacagtaaaaccagagatcaccaaatgtttgcctaatatttcaataaaccagctcttcgcgatttacatggcatggtttgatatccatgtttttattttcagttaactatctgcatttccaaaaattctgattatgtaagtgctaataagagtgatggacagattgattttgtgcattggactaaaagagaaggcaaccttaacagctctgctgtccatcaatggttatacggcaagcagagcaaggactctgcttcaagtactgactcaacaacaaaggactctgcttcaagttcagatgtttgcatgtagtggtgtcgtaataaaacaaaacataaatcagtagcagcggggaccccaaacgcaaatgactactataaatcaagaaagtaacaatcttttaggtttgggacatctgaagtggcactttgtttgcaggcaacataagaataaagaaaacacaattcagcaagaattgttcttgtgtatggcatcatccctccctctattatccaaccatcaaatcaacaaaaatgaaacagggaagtttagacgccctttc

SEQ ID NO: 18163 - DNA, 1501 bp, Oryza sativa
ggagtgccctcgccaccgcagccaccttcgccatgtcagccgcgttcggcacctgcacagaggcagtaggggccgaaggcggtagtgatggcgcaggtgcggaagcagatggcgctcctccatcttcggcgacaggcgccgaaggctctgctccctcttcggcggccatatccgtcccggcgtcgctttcctttcgcctcgtaaccttctccttcacaaccttcttcggtggcattcgctctcagtggtttcgctcggaggtccccacggtcggcgccagctgttgtcgaaacgacaaccgcatacgtcaaagacgtggtcacccaacagtggttggaaaagaagtaaaatgtattaatttgagaatttttcttcggatccccctattacatggccctatgagactatttatagcccccattacagattcttactactatggttttggttatacaggggaatttacatggttgcccttagaaagggacatttacatgggtacatagtgtaattgaggttcatgggcccctgatggccgttgggcaatcgtcggcccaatagcccctaggcttgatgggccggaaaagcttcttcggtcctcgcgggggagaacttgctatggcgaagtcgtctcccttcggcatatattcttcgccctgcatccttcgcccaagaggcctttggcttggcaaagcacccacgtgatccctcacctctcgccgtccctgttccatagtcttcgccatggggggacttcgccctgactaactttgacgtctcgggcttgaatccccactcttcgcatggtttcagcaggtttggtcgaagggcctcatgccataccgccaacactaataatgcgagttgcaaacaaattaataatgattttctaattataggagcaattggttaaagggtgacttgccttgctcaagatcttcacgaagcttcacgaatcttcgagaaatcccacgatcgacaaaaatccggtaaccgcaactatacgcaaacaatcaaaacctaaacaaaagaccaagagaagatcctatttagactaaataatagtgacattagatagatctcaaatttacggaattattggaagtggaacggaggttaatcggagttacggatcgagagatatgatttttggaagtttaattggattttctggacatggggatatatttgtggaataaggaaaattgatttatggaagggaaaaaaggatttattaaatttatggaagagaatatttgtggattattggaaaagatattctcgagaatattttgactcattgacaagtggggcaaacaagaaggtgagagcgtaaattgagagggagcagatatggactttagctcatgagggatggacactgggcttggagggagggactagaagtggacttttcttgtttccttaagccgagaagggaggccggccaatgggccaagcccacgagcgcggagagagagaaggggacggctgactgggc

SEQ ID NO: 18164 - DNA, 1501 bp, Oryza sativa
tggcagcaatgtccaaacttctgctgctggtgtggagattatagatgaagctcaagaagaggagtctgagcctggcaacaacgtccacactcccttcagtgctgacgtggagatcgcagatcaggctcaagaagaggagtctgagtctagtaacaaggcccagtccgctgctggcgtgcagattgcagatgaagctcaccaataggagcctgagtctggtaacacaacaggatcaggtagaacatcagaaatacctgttaaaagacgctggagatatgtcctgggattgagatgcagtgatccggaagggaaacagtgtccggacctcgcagctgatgagctgatgtgtgaacacacatcaagccgatgaagagcagtgcctctcatagtcaaggttgagtacttgagtgaaactgtgaaagccttgtctgcaaaagcaagaaaaaactagaagattattcaactcatgcagtgtgatatcttccgtctcccgaatgcgtgcagcaacgtactttacaaatatataactttctttgtacattgtgcttatgttcaattttgtttgcagagtatttatgttcaaggaaaaaaaaagagagtttttgtgttcagtttatctttcgacagcgtttatgttctgtcgacagtaatactgcagccatgaatgtttcacaattctcctcaggttttcgttcaagaattttgtttggatgtctatggttgccacattcttggttgcacaaatcatttgggtgtcaaatgccttattgccacatgcttgtggttcccaaactgtgtatggattctgcaagcatttctggaaagagagacaaactacaaacccaactatcctacaggctgcactaaattgcagataagcgcagataaaaatcaaactatgaatcataatactagccagcatcattttgagatcacatccaaaacttttctctccaatatgcggagataccatggcagtacagtaatcagtactcagtaggtacattgtttcagtagatcaggagccgcacctggatggctcgccggcccagaaggaatctgcgccggccactcgcgacacggcggagtgcacactgcgcctctgctccatccgccaaaccagagcgagccaggctgcccgacggaaggtggccggagaagccgcttctgggaggaaaccctccagggcagaccagagcaacggcatctccagcgagaatgacccccggaactggatcggaatcccttctccattctccctctgccaccaccacggcgacgcctcctcctgtaatcagcatgatagatgcattttttggtccattagaatgttctttacaggattggctacttggcatatacttgcagaacagactttacaagcatttaaaagtgaatattggtataatattctcctaaatcaaacacatcaattcttttcatctcccatagcaacgtgcagggtactaccagtctaaccacatgattagtggctctgatc

SEQ ID NO: 18165 - DNA, 1501 bp, Oryza sativa
  unsure (1)..(1501): unsure at all n locations
caaacgctctggctgccattgtggctacccctacccatcatggcctgtccatttttgcaagcatttctgcagtgcaagatgcagagccgggatgtttattattccattatctaaaaaaaaccatttctggcaacgtatacaaattaactacaaacccaatactcgcttanctncaggccattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttatagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcgctttacgtccttcggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacg

SEQ ID NO: 18166 - DNA, 627 bp, Oryza sativa
cgacggtggcgagcggaagggggtagcggaggggaggcggagacagtgatgggagggacggtggcgcgatgacaacctcccttctgacagccatgccatcctcgctcatgcttcctcctgcccgacggtggcgacgcgacaacagcctcccgtcatcaccgccatgccctgttgcttccgccagagaggaaagtgaggaggggaaagggaatgaagagaataaagaatgtgtgacattgacgtgcgagtcccatagtgtgacttagcgggttagaccaagtcaaagcgccacgtcagcggaaccgctctacaaaactgttgagggaataaaattgcaccgattttcatagttgaggggtcaagatatccggtattacggtttaaggatatgaatcatattggagttatagttgagggagtccaaattgtcgatgttttagatcacgactacggtatttgcatggtgtggggatcgttggtatcagggtatatgtgagattaaggttaaagagacagagataatgatttttatataggtttgggcccctcattcatcagaatcaggtaatagccttactcctgttggtcgaagccggtgttgcttttattcatcagaatctcacaagt

SEQ ID NO: 18167 - DNA, 155 bp, Oryza sativa
gaccaaaaaatgcatctatcatgctgattacaggaggaggcgtcgccgtggtggtggcagagggagaatggagaagggattccgatccagttccgggggtcattctcgctggagatgccgttgctctggtctgccctggagggtttcctcccaga

SEQ ID NO: 18168 - DNA, 196 bp, Oryza sativa
ttcctgcagccctttgtgaggcccctctggtcgatttggtgtgttctgctactgcggtccatgtaccggttcatcgcagagagccttgcgctgttatccctgtggcatggccgcagttaagagctccttccagagtacatgcgtaacaactttgggaggggaggattggcatccggtgtccacaacgcggaaacga

SEQ ID NO: 18169 - DNA, 595 bp, Oryza sativa
attacgttcttccgggttcctgcacgcggccacaggcaatacttgtatatatcaacctggatgttaatttagatactagtagtccataacccatgcattcgtatatgatgaaggcttatctactttgtatctcagttttgttgaatttcagtttataactagtatggcggtccgtacatattgccggttaatattgttctattttatttctcaccgaatagcatatatgggttaattcacgaattcatttataggccaaataaatgaataaccttatttggcctatcttacaccgttaggtgcagcccgtcgggtgaggatggcacaaaccacaaaggtacgttggcacgtaggtcggcaaggctctggcggcgtggcgcccgggcctatcgcacgatgcgacatgttccacagaagaggaaagtcttgatgacccagcaacgataccagtatttgtgctagggatcgataacttgtgatgggccaataatgtgtagtgagccttgcattttcaggtggaataagtccattgtgactcctttaattaagtagtggaatcagccatgcggcgatagcggaggggaggcggatgcaa

SEQ ID NO: 18170 - DNA, 411 bp, Oryza sativa
ttttgtgaaatatgtaaaattatatgcctacatagaaatatatttaacaatgaatcaaatgataggaaaataattaataattacttaaattttttgaataagacgaacggtcaaacatgtttaaaaaagtcaatggcgtcaaacatttcgaaacggagggagtataaaattggcaccaaaactcccgtccacaaccaaacacaggaaaaatcccttagaaaattcaaattttatgacaacaacgatgcacaaagttactacgaaacctactccctccgtcccaaaaaaagacaaaccctggtttccgtgcccaacgtttgaccatctgtctgatttgaaaaaaaatatgaaaaaaattaaaaagacaagtcacgcataaaatattaatcatattttatcatctaacaacaa

SEQ ID NO: 18171 - DNA, 1501 bp, Oryza sativa
ttctgaccataaataagaactagcgaaactacattcttaagcaccttctgatcagattttaaattaaaacacactatatgctatccaagctatcagtcgattattcactattctctctcgtgcggatttattggtctgtaactatcgcagtttttatgtcatttgttggtacacaatactattgtcttgtgcaagatggtttagaaaaaaatgtccctaaaattatcgagaaacatcatgcacaaaatagaaacatggaaaagcgattccacagaacaaattagcattaaactagtgtatagtaccaaattagtttcatttcacctagtactctataagaagtttatcacaaataccaagaacaatattatcagttgctcctatcatgtgtggttactggtcatgtaaacatcagtcatcagggagcattcggtctgtcaaacttcaaataattaccagagcactcccccatcacttatctacaagattctgctaccttcttccattttttttaaaaaaaaaaacaccaaaaaccaatgttctgtcacgggaatgccagaatttcagaaaaaaaaaatctgggctaatcgcagagaaatccttttgaacgcgttcgattccatcaatcacccggttttctcgtccccaaaatgcacaccgatgccaattgccatccatcgtaatcagtcacacactagtactaatcagaaacaacagatcgtttggctcatgatactacctaccaactcacgcgataaagcacaacaaccaaaattacgcaaaaaaataataataataatgcgacgcgaagcaaaaaggatcggaggggactcacagagcagagctgcccccgatgtgcggtgcggccagaagataatccgagacgaacaaccaccaccaaaaaaccttttggatctccacggggccgagtgaggtcagctaccggcgcgcgatgcggtccgcttttccctagttcgtcgtcgtcgtcgtcgttggcgagcgcgttgcttcttcttctgtatgaggaggaagacgagcggatccgccatttatgcggcgcgggcggcgggcggagggcgatcgggagatggagaggagagcgttcgcgagtgttcgcgaggaaggtgacgactcgtcgttggcgctcgttctggacgcttccaccaccgtctccctcgactcgaggaagatgaccgacctgtggggccgggccgatacctgggcctggactgcaggaatttcatggggcaggcctaacacgtttatttaatgggccggtaaataggagcttaaggttttgcataggaataagtccattttgcctccctcatctcttgcgcttggttgaatcgcatccctcaaccgcaaaaccgggtgtaatatatcccccaactcccaaaaccgttgcaaatcgacttcccgggcggtttcggaggcggtttttgtcccacgtggcatctttgaccccgttgaatggctgagtcatcaggtgggacccaca

SEQ ID NO: 18172 - DNA, 175 bp, Oryza sativa
gactcggccagcttgggcgagcggcgcaatctccttcccactcgtcgcccgccatgctaagagagaagagagagagagagagagacgaggaagggagagaagagggaaagagaaagctgatgtggattgtctgacatgtggggcccacgcaggtcccgcgctgactcagctgtca

SEQ ID NO: 18173 - DNA, 1501 bp, Oryza sativa
attggagatcaacggctcagattagatacccatgaaaaacatgaaactatgccctactagttttttagcgatactgcacgtactcattttgtttctcctttctaaagtttagaatcgtttgatttaatcagttaaagattataaaagagttggatcgaatgtgttgattagaccataaagaatatgcgaattaacacgagtgatgagaactctcgtgaactctcggacgaaagagccaaactgaactactacgcctcctcgacccctcttcctcacaggctcgggtgaccttgccgccggcgaggtgagggagagaagtccgacaaactctctctttgtaggtcaatcaatttagttgggtttttcttttagtttgagcgtgaaggtcggcgatgttggccttctagtcctaggtttcatggagaaggcaatcgaagtttcttctctagtggtatccctctaaaacaccgggtaattctctatcaccgtgagttaggagaaagctagacctagttaagggaagttaggcaagttatctttcttttctccagcaggcttttcgcaaggatgatagttttcttcctctttattggtggcaaaccttcaagaagcagttgagttttgtttgctatatgcttggattcctcaaccttaggctatggaggccctaataaggtaagcttcttggtgcttttttatgcaacttgccatgaaatctttgtctctatcaccaatatcaacgattaggttgtcgaccttgatggttctgctccaagaacaatctcatttagctctggatgtactcatctatggtattgatgaaccttttcatgaattgtcatggccttaacctctattgttgtgaaaccctatttgggaatgcgtcaaggcaacatcttctgtagctcgccgtgtccatgtagcacccactgccatcaagtatgtcaccagtcaccaccaatgtgggcataagacagaggaggacctgattgttgttttttttttcaaatcttgttgagtcctcctttgcttatattttgacctagccatcttaaagagactatcttccgtactcccagttctatcaacaatgaacattgacatgttcagtagtcacatttctatggcattgcttcgactgtgtagccgtagccaatgcaaggtatagcgcactattgcttggcctgttgctatatgctgcagcccatgcaagcgcatcaaaggctatcaaacaacattgataaactgtgagactgttatctaagtttgtctttaaaaacaagagtacaaaggacaacctttttattatttgcaatgataagttttctaaattattaagaaactgtgcagtacgatttccaacataaaagaatatcactttaaaggccatgacaatcgatgctgaatcgattaaataccatagcttatatagaagatgtttattatgccataatttatggccttttatcattcgcaaccataactttttccaaattatgct

SEQ ID NO: 18174 - DNA, 493 bp, Oryza sativa
gactcggccagcttgggcgagcggcgcaatctccttcccactcgtcgcccgccatgctaagagagaagagagagagagagagagacgaggaagggagagaagagggaaagagaaagctgatgtggattgtctgacatgtggggcccacgcaggtcccgcgctgactcagctgtcatgtcggacaaaaccgaggttaaaaccaacgaaggacctagaatgaatagttttgtaagttgaggggtaccacatatcatgttttgtggttgggggacgattttgtatctcgatgacaagttgagggaccttcggtgtactttttccttctgagatattacaacaccaagtgggctgggcctccctgggccacagtacagtggactatggccttggttgacattggattttaggcatggatcgtgcaaaatgaatggaaaaagtacgaattacacccccgaactaccgcgatcgtccgaattacccccttgaaccataa

SEQ ID NO: 18175 - DNA, 245 bp, Oryza sativa
caggcggcgcacacacggcgcgtaacgtaacgcctcaaccccggtgtggcaaaccacgggttccgttccggagaccggcaaaatcacgagggaaacgcacgccctcgccctcgccctccgccgcgccccgcgcaccgcgcccgcacccgcacggcgcgcggggctccgccgacacacggacaaaaccgccgcctgttcttcccgcgactccccaccccaaccccacgcgaaccgcgagagccaaa

SEQ ID NO: 18176 - DNA, 1501 bp, Oryza sativa
agcatcgattgtcatggcctttaaagtgatattcttttatgttggaaatcgtactgcacagtttcttaataatttagaaaacttatcattgcaaataataaaaaggttgtcctttgtactcttgtttttaaagacaaacttagataacagtctcacagtttatcaatgttgtttgatagcctttgatgcgcttgcatgggctgcagcatatagcaacaggccaagcaatagtgcgctataccttgcattggctacggctacacagtcgaagcaatgccatagaaatgtgactactgaacatgtcaatgttcattgttgatagaactgggagtacggaagatagtctctttaagatggctaggtcaaaatataagcaaaggaggactcaacaagatttgaaaaaaaaaacaacaatcaggtcctcctctgtcttatgcccacattggtggtgactggtgacatacttgatggcagtgggtgctacatggacacggcgagctacagaagatgttgccttgacgcattcccaaatagggtttcacaacaatagaggttaaggccatgacaattcatgaaaaggttcatcaataccatagatgagtacatccagagctaaatgagattgttcttggagcagaaccatcaaggtcgacaacctaatcgttgatattggtgatagagacaaagatttcatggcaagttgcataaaaaagcaccaagaagcttaccttattagggcctccatagcctaaggttgaggaatccaagcatatagcaaacaaaactcaactgcttcttgaaggtttgccaccaataaagaggaagaaaactatcatccttgcgaaaagcctgctggagaaaagaaagataacttgcctaacttcccttaactaggtctagctttctcctaactcacggtgatagagaattacccggtgttttagagggataccactagagaagaaacttcgattgccttctccatgaaacctaggactagaaggccaacatcgccgaccttcacgctcaaactaaaagaaaaacccaactaaattgattgacctacaaagagagagtttgtcggacttctctccctcacctcgccggcggcaaggtcacccgagcctgtgaggaagaggggtcgaggaggcgtagtagttcagtttggctctttcgtccgagagttcacgagagttctcatcactcgtgttaattcgcatattctttatggtctaatcaacacattcgatccaactcttttataatctttaactgattaaatcaaacgattctaaactttagaaaggagaaacaaaatgagtacgtgcagtatcgctaaaaaactagtagggcatagtttcatgtttttcatgggtatctaatctgagccgttgatctccaatcgaacggctcagggtaacctccctatccacaatattatccctcttctttctttccgatacgatagcccacactctcatccacactgctcttccccccc

SEQ ID NO: 18177 - DNA, 650 bp, Oryza sativa
gagctcggtacccctttcgagagagattcctgttcatatgcgttaaataaaccagttttgcttgactgatacgttaactaattgatatttatatctaagcagtttctgatcagtatccgtccaaatttgattatgacaaaaaaggaacaatattggaagggccgttgatatatattaattcaacatgacaattatttgcacgtttatattatcctgatcccaatatcagccacttgtatgtatcttactctgcaattatgcccgttctaaagtacaccctggagctgattttttacgtgaagatagtacatcatcatatctactacctccgtcccaaaataaatgcagccatagatatccgtgtttagcactttgaccatccgtcttatttgaaaaatttattaaaaatattaaaaaaattagtcacacataaagtactattcatgttttatcatttaataacaataaaaatactaatcataatcataatcttttttcaaataagacgaacggtcaaacgttgaacatgaacagtgctaaaactgcacttattttgggacggagggagtaaatgatattgtatatcatgccatttgattctctagcgtcatatattagtgaaatatattttacattgtctggaccgaact

SEQ ID NO: 18178 - DNA, 368 bp, Oryza sativa
cccacaacattttaatatgctttcctctatatatgctgaggataaaggttgcagatcgaccattcttctaccggtgtttgcttatatatatgctttgcactcgtgcgatatccaattactaatagaatctaaaatttacccttgtcaccatcactactacacaaaatgttttcaagtgcggtcgaacatattttcacgtgcagagcttcagcccgtctggagcaattcgtctgcgaaaatcgctatctgtgcgtgcgtgcggtgcaattgcacgcgaaaatcggattttcgcgtgctggtgcttttgtcgcccacatgcaaaaataaaaaatcaaaaaaaaatgaaaaaatgaaaccctaacactagc

SEQ ID NO: 18179 - DNA, 1501 bp, Oryza sativa
atatcggctgaacctctagtgtatacttgtatgaacccctttgcctcactatatcgattaagctcaaggatagatatgtgccatcctctaatagctcaatcattcactcgaacctgttgatagattatataacttgtgattgactcctcaatcacctttggcatggccatgcacttccataatctacaacatcgaggggcctagagatatctctccataggaggggcaaatcccatcttgattattcatattccactacatgtttcatagcatacccgaaaactacttttataactacccaattacggagtagcgtttagcaatctcaggtctaaggattcaacaccaacacttaatgagatcactgatgacacaacacatatggctcttgcagtgtctcatgttgggtctatccaacaacatgtgtccacattattaatttggtatctctataccatgatccatgagacatgatcatcaattaatacatgtgctgattatataaatatatttgttccacatatgatatttgatcagggatcctttagaaatagtaacaaacaacataaagagtctcatgaaagtatcacatattcattaactaataaggagttatctatttcaagaacaatatcggataaatatgtaaacatagtatgtgatacaatcatctctatgattgcctctaggacatatcactaacagattctccccaaacagtacactgcaaaaaaaaagggggagaaagttgcatgaaacgtgtggctctaaattgttcagatgccaaatcgatttgttgtttgtttcattgaacggacagccatgtcgcactgacgaagacagcataatgcatcatcacacagttggtggctggctcatgcagatgtggcgagccagcagcgtgttgcagagttaataataaccataattgtttcttgtagtatttgatgacacttatcaaagcggtcgaattcaatcttatgatggctaggtcaggtgtttgagatcagaagaacaacaggtttcagcaaccgcataattgacaggcaaatcattcggaggcattattggcagaacaatagtattattagtatcttttagcaatagtctgaatatgcaggaaatagtactatcttttagctagatatgcctaaaatcttattgtcatcactgttgctgaatcatctgttttcttggcactgcattgtcctgctgtttgtggggggtcctggcatgtttgtttgcagtgagaggaaactgatctactgctatggaagcagagatgtgctgcatctgcatctaaggtgcctggccgatcctgatgtgcatctgaattctcaaaagcctgctcaggccagagcatacataacatgagtatcctgatctccaaatagtctgactatgcaggaaatatcttttaggttctgagattttgtttcattaagatcagaaaatgaagtggggacgcaacaactgtcgtgtaccgcagcagcaagagcat

SEQ ID NO: 18180 - DNA, 1501 bp, Oryza sativa
ataaaatggctaggatgctagatgcaggcggaagaaagaaaggtaaaatgtataagggaagtgaacttttcagaggtgtaccttaccactttatccatcatctctgcataaggaaccaacttcttgacattccaaacattaccatcaaacggcataaactctataaatctgacattgacaggcttgtctctcgtcatttcaacaaaatcacagatctcgtcatcattcattccacgcatgacaacgcagttgacctggcagcagaaaaagggaaaaagaaccaattaaactgaggataaatgctcaatatgatgcggatatagctccagtttgtggtatgttaaaaagaagacaaactgcagaaatttcaggtatgcaaaaatctgcataccttgacagattggaatccaagttgtatagaagcatctatcgattccatgactctcgagtgccctttacgtcttgtcatgaactcaaactttgcagggaccaacgtgtccaagctaatatttagagcattgagcccacattctttcaaccttgggagcttcttagaaagaacgagcccattcgtggtcatcgcaagagttttcagccccttcaagccggaaagatgcaaacagatatcctcgatatcctttctaatggttggttctccgccggtcaaccggatcttatccacaccagaagtaacgaacaggccggcaactcggattatctcatcatgcgacaggagctctgagtttggcgtgagctgaactccttgggcaggcatgcagtactggcatctcagattacagcgctcggtcaaggagatcctcaggtagttgtggaatctcccgaacgaatcgacaagcatgtctgacagtggcgcctcactcagtgctacctctggcacattagcacaagaagaagttgcatataacctttgactatcatcagtagctttggataacgggcaagtgctcatcaaacatcggagccccactctcattgcatcaacctgaaaattttggttttgactgttacagcaccagaaaacaagcaattcgtttttgactggaaattaaaaattaacagcacaagctcatcccttcgatgtgatatggtactgcatcaatacatcattacttgattattactagtacccaacgcacaattacagagacccaatgcataattacagtacaaagacacagcgacgtgcttctagctgaatgattcatccaagaaagaaaatgagtagaatctcaccgcgcgatcaggccggcggcgggccagctcggagaggcaacgcagcggcatcatcatcatctgacagactatctatcccctctcctcctcctcgtagtaatcccaggaagcaaactttttgggggaacaaacaaacttttacacaggttaattaagaggagagcttcttccagatctacaagagaaagctagggttaacgaacgcgagcgaattccagacaaaaaaaaaactactccaggtgggaga

SEQ ID NO: 18181 - DNA, 1501 bp, Oryza sativa
agttgatgtgactatactagagggagggaaccaactagtactagtagatgcttgcatgcatgcatgtagctgctgctagccactaaaactcgatgcatgcatgtagctgctgctagccagagcattagtcttttcactaacagttatattttctacactaatccatctacttatagctagacattagatgtttattctagccatgcactcaataaaatcaaaggacaaggttctatgtattacctgagaggcttctattagctctaaactctcaagtgtctcacagaactcttgccacagccagagcagggagaagtactactgatggacaagagttgtagggtcacgtacggcttaaatagtgcagcttccttcagtgtgaagcagacacctatccaagccatgatgatagggataggattcaccctccctcttccttacactggaagggttcgatcctatccattaacctcggtgatatttatctgtcctcctcccaaaacaattcaagaatgtttgaacggttccctgctgctactgctattactactactactactactattattattattattcactactactacatttttcatttttttcctagtttcgtcagtaagaggccgcccagtccgccgtgcgcataaatctttctactttcaagtgtgtttgtctctcttttttgggagtttaagggaaaccgggatcaagtatgaccggtaaacatttggtatcagagccaagtcgatcacgtgcggaagtccaaggcgcaatagctgaagtggcagtacaacttcatcgagttcaaccgtggaggaattctcccttcggctcagctgcatcatcacgtcgttggcgacgctcaggccccaatccctgagtccaaggtagttgacaagctcttgcgggttgtgcctgagcatctctcgcacattgcttgctccatgaagaccctcctcgacattgacactctatcactctatgaggtaactggccgtctccacgacgacaaagagcacaagggtcgctcctgagcctattcatctcgcaaggccccctcaagcccctagtcccacgcatagtagagaaaaccgtaccggacgtcaaaccattcaagcccatggtatagtggtctagcgattgaaccggcgattcacacaattcaaatgcaaaactaggacaactatattatatgcatattcctcgtacttcatttattactacttaaaatgttactccctccgtcccatccctccgtcgtagaatataagcatttttttagagttggacacggttattaagaaagtggatagaatcaaatatgagagggttgtggttggatgaaaagtgcaggtaagcataggtgtatctgtagggtggtcccggtggtccccagaccaaaaaaaatagtgattgatcccactatatattggattttagaaaaaaaaagaagaagaaaatcccttacgcagtcattgcacggcgcatgcggaaaggc

SEQ ID NO: 18182 - DNA, 1501 bp, Oryza sativa
atagcaacacttaagatattttgtttggatagttccacaggaattgaaacaattttttttaaggaaatcacatgcggggagagagagagagagagagagagagtatacattggacattagcaaaggaaaaaaaagatgagttcatgttagaattcatatattgattgagagcatatgaaaacaatccttatgcattttactttgttccaagagatagaacataggaaaaaaaattcttagtccaaaggagccctgatgctacatcacaaatcacaatatgaagaaatcaagaaatattgcttgtagggaggtgtgaaatggttatgactgaggaggatcattcatgcacagagaccgatgcatgacactgttgatcctacagaaacgccattgtttactgcaattaaaaatgttcccagtcgtaacagtaatatgtttacagcttttgtttagctttttatgcatgcccttttggactttagctttacctttgatctggccccgctttaaaggcattgtttagactgttttggattctaaagctgccatggagatagcagcagtagtagtatgggggtgcctcactgactgaagctgccaatgcaacacttgttggactctactatcaagcaacaataatctactcctactggtactagcactggtagtttgcaatggcaatgaatgtgcagtgaagaaatgggagtagtaaatatgtgtctcttgtgtcatcttgtgtgtgtacatctccatgtccttggtatgtgcatatggttccatggccaaggtttggaagcttgcaggcaaggggatataggaggagtacatgcttgagcctcttgtgtgtttgcatgctttgtcccatacgtggtgtcctactactagcaaacacaaacaggagtagtagtagtagtttgcttgtttggttttctttgggcttgtttctctgcaattgctttgcatggtgtagttcctcttccattccctgcatctgcatttaatcagcacaaatgagggcacactagatttagtactccctccgtctctatgtttgacgccattgactttttaaatatatttgaccattcgtcttattaaaaaattcaagtaattattagttcttttcctatcatttgattcattgttaaatatacttttatgtatacgtatactccctccatccctaaatgtttgacgccgttgacttttttaaatatgtttgactgttcgttttattcaaaaaatttaagcaattattaattctttttctaccatttgatttattgttaaatatacttttatgtatacatatagttttacatatttcacaaaagtttctgaataagacgaacggtcaaacatatttaaaaaagtcaacggcatcaaacatttagggaaggaggtagtagttttatatatttcacaaaagtttttgaataaaacgaacggtcaaacatatttataaaagttaacgacgttttctaaatatttagggaagtcg

SEQ ID NO: 18183 - DNA, 220 bp, Oryza sativa
atggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagt

SEQ ID NO: 18184 - DNA, 863 bp, Oryza sativa
atggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagtatgaaccttatatattggattggttcagctaaatgctatatatgtagggatgctctagagtcatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagg

SEQ ID NO: 18185 - DNA, 1501 bp, Oryza sativa
  unsure (1)..(1501): unsure at all n locations
attaggatcccggggtggggtgggggtgggagggggaagagaggggagttcgtcggctttagagggatggccgtgggaggcggcagtccggcggtgggcggcggatcgggcaggtggcgaggcggcggcggcggcgcgaagccgcggggtcgggagcgggcggcgggccggttgaggcgacgggggcaaagctgaaagagtggtaggaggaggtagccggtgatggcgccccgccgccggcgacggggaagacgacatacagcgcaccgccgccggcttgaggcaaaggaggggaggggaagggggccagcggncggggcctcgccggcgtcgttgacacttttcggccagccggcgaggccgggtgacggaacagtgaggcggcggcggcagtgaaggaggcgcgcggtgctgagaggaggggaggagcgcttgagcgttgtgcggcggcagggaggaaaaaggaaaaggtggttagggtttggtggggtttgcacgaatctcaaatcaatccaatgaacaaaaatttgcaagatattaggaggggttttctgtcgaggagtagacagtcccttaattttattggttccgtttcgttacatttagagcttaaggtgagtctgaactgaaaactgaagtgaacttttattttgtttagaagatataaactatttattttatgactatgtaagtaagtagaggtacatttttctactagtatttcatatactccctctgtttcaaaataagtacaatcataagtttccgtatacaactttaatcgttcgtcttatttaaaatttttttatgattagtaagtatttttttatattagattataaaatatgaatagaactttatgcatgatttatgtttttagatttttttttctaaaaaattaaataagatggacgattaaagttgtgcacagaaactcatggtagcacttattttctagatagagggagtatctgtctgtgctagaactacgcatctccaaactttaaaaacatttccttataaaccatggaagacgtcgctggctacgcttcggatcatcgccggtagccggagcagccgccgccgtcgtgtccatgctcgtgtcgtcgacgcgccatccccacgccttgtcctcacagaggagcctcaacctctcccagtccaagccgtatttacgcgctgccgcgatcagctgcggcgccatggccggcacctctcgcggggccatcgtctccggcagcgtgtcggtgtacacgaagtgaagcagagccttgaacgcagcggcgtccatgtcgccgacgtcgatgtgcctcccgacgagtcccatgaagcaggaggcgccgccgcgacgacgacagagcttggccagctccggtgcccgtcgctcgagcacccgcctatgcgcggcgatcgtctcgccgccggcggccctgaacgcgacgtccgcgtcgtccccggtgtcgagcaggcatctgaacatgtcgtgctccaccgggcagag

SEQ ID NO: 18186 - DNA, 543 bp, Oryza sativa
aataaattttagtggaattttcagagcacaaataataatagaaaagaaataaacaaagttaaaaaggttttataaaaagaaaaccctaaaagaagtcttttccccctcctcctcccttcttgggccggctcggcccattccttccctctccctctctctctcttcccccgcggcccatcggctccccgcgcgcgcgcgccgctgacaggcaggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgctttcccctctctctctccctcggattcgctcggatttaatcccgcattcatcgccggcgcatctatggcggccgaaatctccgcgaccgattcctccctctccggccgctctttccttcccccggcgctatttaaacgttgcccgagc

SEQ ID NO: 18187 - DNA, 686 bp, Oryza sativa
ggcggagttcagtgcaaggcgcggcccaagtagtggcgtggtccagggcggccgtgcaggtgctgtggccggcgagcagccgaagtctccatcagtgccctttagttttcttttgttcgccggggacgagagagggtgctgatgtggcatcctattacgtggatcccacgctaactcagccgccacgtcgtataaagccgaagtcaaaaccaccgaaagactcaaatcgaacggttttgtaaagttgaaggatgtcagttttgcggttgagggatgattttgtaatttgatgacaagttgagggaccttaggtgtacttttttcatttcctaatttatatactacctgaaaggctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctccccttccgcgtcctcgccgctgccgcggggtcccacttctccccctgcggtctcccgcctcgcgggccgcctccgcctctccccgtcca

SEQ ID NO: 18188 - DNA, 955 bp, Oryza sativa
agggtatgcgaaacggtaaattctcattgatcgggccacacaatgataagcccacgaagggaagcccatcactgttcatttcggcccagagaaaaataaagactgtttcgccgtttgcaaaaggcgaaagctagaaacacatgtacacatagtgcacacattctccgcaggactccagtataggtttcggcaggagcgtcggtcgaaaagggggcgcgtcataccataccacatggtttgcacggtctcggccgaagctcttatctcacccttgcccgtgaggggcttgttggcggtatgtcatgagacccttcgaccagtcctgccaaaaccatgcaaccagcaaggattcaagctcagggcatcaagttcatctgggcgaagcccccatggcgaagactgtgaagcaaaagcggcgaagggcgaaggatcgcgctggtatcccacaaggccaaaggcatcttgggcgaaaactaaatggcgaagggtgcatgccgaaggagggtgacttctccataacgagtccagcttcaaggaggccctaggggccatcccagccgctcaagcccattggcccttgggccaatgttcgccaattggcccattataggcccatgtatcacaattacgctgtgtacccatgtaaatatccctttcgtaagggtaaccatgtaaatttccctgtaaaacctaaaccctaatgggggaacctgtgataagatcataaatagacccctagggccatgtaaaaggggggatcccaagaaaaattccaaaattaatacacttcactgtacccaacaactgttgggtaaccacgtccttcgacgtacgtagttgtcgcttcgacaacagctccccctcaagccttttcctgagcgcttcaagcatcttaccattcgaacgttcggccgccccatttcactgtgggtgcgtgaccgaagcgaacttgatt

SEQ ID NO: 18189 - DNA, 1501 bp, Oryza sativa
atatatcggaggacgatttcgtaactcgatgacaagttgagggaccttgggtgtactttttccaaatgaatactccctccatattttaatgtatgttaccgttgattttttgacaaacgtttgacctttcgtcttattcaaaaaatttatataattataatttattttattgtgacttgatttatcatcaaatgttctttaggcatgatataagtatttttatatttgcataaaaaatttgaataagacgagtgatcaaacgttggttataaagtcaaggcgtcatacattaagatacggagggagtatattgtttccgtaaaatggcacttcatggttattgataggaacaatcagctatctgaaaacagtggtatcatatcttactataaagttatcccccactaacttcttaagcttgatatgaagatgcctcatcatcattcactaacaagataccacaccatcatccactaattaacaagatgtcacatcatcatgcactaacactcatcacatttaaacatcatgcaaacatgctatatctttatagtttttataatttaagagcttttcaaatacaaacatgttaaattatcatccaacataattcatataatgtttcaatgtatatctttattatgttttatgatatcttatatatttatatagttcatcctcacttagttagtgcttaaatgattaatctatggtctaaattatctttttctttttttcctctaattaagttatatcacatcaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaa

SEQ ID NO: 18190 - DNA, 1501 bp, Oryza sativa
aatgtttcaatgtatatctttattatgttttatgatatcttatatatttatatagttcatcctcacttagttagtgcttaaatgattaatctatggtctaaattatctttttctttttttcctctaattaagttatatcacatcaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatgtatatatatatgtatatatgtatatatatatatatatgtatatatatatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatttgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggcc

SEQ ID NO: 18191 - DNA, 1501 bp, Oryza sativa
taactaaataaccgtagatccgtttcaggtggttcaagttgctaaatttttctaaaataaagatctacatattaaaattgtccataaattgaattaaatttatttaattttttttaaatgggctttaaatagatttaatcttgtaaaattcataataaattcatttgaagtcagaatgaggccgttcaagtctcataattcatctaaaattatgatctacatgtttgtttactttatatgtattgtttatttggtttttattagtctttttcttcgttttacgtgttagcttgttgtttccgtcgttgcgaaggttcgtgagtgcaccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatatcctattccttgataccttgggtaataaattgattagcttgaaccttatgtattggtttggttcagctaaatgttagatataattgcttagcaaagcttagaaacattagctcactaataggatgaatcatatatattacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggtaacatgtgtggaatcgtgtcttgtgggtacagtggtacacctctggccagactaaaactattcgaatagccgtgcccgcggttatgggcgggttgagcaatgtttttcgtgattagtctcacacctctcacaataattatggatgttatacctggtaataatttgcttagctcctggtttggagaatagatctgtacagccgggtatggttgttcaggatggttgggcctgtgcagcatgggtgtgttgttcagtgttgattaaaatttctgattaattactccactgttttacttcttttaaatgttttgctaaatgctgcttttgcaaatgagcctatattatgccatcctttggtatccttgtgcacttgcatatttgctgggtggcttgttgagtatgtcatatgctcattcttgcaataatcaatcaacctca

SEQ ID NO: 18192 - DNA, 1501 bp, Oryza sativa
gcaaaggagaaggttgctaagcgaaaggagagtgaagcaggaggggaaatggccgtcgaagagggagcagagccttcggcgcccgtcgtcgaagctggtgcagcaccatcggcttcggcacctgcgccgcaaccaccaccttcggctcctgccgcttggacggggcaggcgccgaacacggttgatgcggcataggcagctgcggcggcgagggcgctctagaccagggcggagatcctttcgacaagccaactggtggcgccccaagccgcttcgccgcaaccggctacgacttcgaccacgctcgccgctgcacaagtcaaccccaaccttgaggcacaagccgaagcagacatggaggccatgcgccagaaaatgacgcaacttcaagacatgcttcgccaaatgcaagagcagcagcaggcatacgaagcagcaaggcaagccaaggtcgcttcggccccaattctccagtattcagcgggctacattccaccccaagtctacccgcaagcaccgattcaggcccttccgccacaagtcatgcaagcgccagcgtacttcgccgggtagccttcggccgcaacagtacacccgacccctcgtgtatagccacaagttcagccagtcgctgcccaagtacgccccccaccacctggtcaaatgtcacaagcaatggcggagggggcttcggccttgcaggcgcagcttcaagctttccttcagtaactcagccaaccccacaacacttcaggtacaaccccttcggcccaaccggaggggcaaacaagtcagggtgcacccagttggctactgtcgaaccagcctagtccgggggcttcgccatggagtcaaggaccacagttcaacctcagcaatgccattcaagcaccaaccactcgaccacaggtaacgacgctaggctgcggaacaaatcaagcgcagaaccaggtcgctatggcatggacccagcctccgttcgacccatccatggtggcacaccaagtgccaccgttcggagctgggcaaccgaatactgtggtccaacctcatgcgctagtcatgacttcgcccttcgccacgccatatccacaaccaaacgggccttcgcagcaaggtaccgtgagcaaggcggggggcgaaaaggggctaccattgagtgggggaatcaaaatttgtccaatctcaccccagttcaagttcccacccgttctgcggtactcgggcgaaacggacccaaaagagtttctgtccatctacgagtctgcaatcgaagccgctcacggagacgagaacaccaaggcaaaggtaatccatctcgctctagatggcatcgcccgttcttggtactacaatttacaagctaatagcatttactcatgggagcaattgcgcgatgtctttgtccttaactttcgaggcacctatgaggagtcgaagacgcagcaacatctactcggcattcgccagaggctgagggatcgataagggagtgcatgcg

SEQ ID NO: 18193 - DNA, 536 bp, Oryza sativa
gggcattatacttttgcaacttgttacagcacaagaaccaaaggatttgagaaagaatgggctcatcaaactaggagatattatacgattccaaggaaagagcatggagcagcaacatgaggtcctaaaaagcattgtggatcctgacctgaagaaatgccagttagatgacgccgcagagatgctgttcctgggattgaaatgcagtgatccaaatgagaaacatcgtccagacctcgcagctgatgtgtggccactcatcgaggaaatgaagagcagtgcctctcatcgtcagggttgagtgaagctgaggaagctctatctcttgaagcaagaagaataaactacaagattactcaacttgtgtggtgtgaaatctcccctctcctgaaatttgtgtggcaagcaaagtgctccacggatatgaaactttctttgtgtattgtgtttatgttgagttttgcaaagttgagtttatgttcagttcacaatagtcaagcctgaattcaataatttagtctgagatgtttgtggtt

SEQ ID NO: 18194 - DNA, 1501 bp, Oryza sativa
caggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaacgggggaaactacttaggacagagaattactttaacttttattgatcttaactgagtttcattattacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcaattgaaggctcgttcggctcgtcttcatcatcttgggttgctacccactcaatcttggaattgttgcgcttggattcttcttcttcatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctctaaacgatccaccttgtcttctaacttgcaaatcttaccacgattccggtcttcacgatcttgagctgctaacacagtctccgcacgactttcatccatagcccacagcatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatcgaatgacaaaggacatcgtacgcaactcctggacaaaaccctcaacaccaaacaggtactcaggcttgtaacgcggcatgtaaagacaagtgaaaggagagagttaagacctttatccaattaatagcacaagtttttggattaatttgaataaagttagaaaatcagagtaaaaaggtaagcaaataaagtaaaccaagctttgcgagataagttaaaacagttggaaacgaggtcacaaattttgtaattttgaataactggtttctaaagaaatgaaag

SEQ ID NO: 18195 - DNA, 965 bp, Oryza sativa
gagggacgcctagatctggataaatggcgacggaggtggatgccgagctcgatgcgggagcacacccactgcgtgtcgctcgatggctcaatttcttagcgccagcgccgaagtttttgacccttcccgtgctgttgtttgcctctttgtgccgtcgccgccactccctctgtgcaccgccgccgccgctacttccgtgttcagcagccgcccctgctccctccgagcgctgccgcatcctccacccaggccaccgtccggtgcaccttcctctatgcctgccttgcgagatgaataggctcaggggtggatgagcagaaatttggggataggcgttgtgtactcccagacattttcgtaagtttggcttgtcaatacattttttttattttttttctttatgatatcgtatgggtgtaacgaaaactgggtcaacaccaaccctgattttgaaaagtggtgtcacatgagtaaacttaaaagagtgagatcataatcgtagttagccttcaaagcagagttaaaagagcaattgacgcaacattgttatatttctaccaatattgagttgttaatcgattcattttcatcgttaccattctgttgtactagtagcccgatacatctaggtgatactccaagcctataatgttccactgacattgtggggcccaatgtcagtgactagggtggtggtggtagaacaatcaccatctttagtactctttccgttccaaaatataataatatctagcatctaaaatttgtcctaaaatataataacttatacaccaacattctcttcttaacaaatcacaaccctctactattcaattttcccacctacctccagtgacgaatcttggttttagaatatgggtggtccgactcaaaaattatttctaaacaccgcaaatctaacgatgctaatatatactccctccgtcccaaaataaggaaaaagt

SEQ ID NO: 18196 - DNA, 743 bp, Oryza sativa
tgttgcggttggtgaaatgggttggccgcaattaaggcgcgcggacatttacgggatgggggcggtacacgagacaaattaaacaaaatcttggcggggcaaagctcgacacgtggatgcaaatggaaatggacggcccggatcgtcaccgatggcagcagagttttttttttttttttgacacgagcagcgtttgttaccagcaaccactgcaacgcgtaaacgaggccgcacccgcacgcccatctggtttttggcgggcgaatttatgacgcacaaaccttaccaaccagtggggataaattgtacccaggtcctcccactttccactatttttatggtccctatggaacagtttggagaatatatatgtaggggtactattatgtaacaggtaggcctcagtgcaaatttgctatacgcttgtttggccgattggctcattgccgttagcatttttttttggcacagcaaaaattggtcattaccaaatttttagcaagaattgacaatggcttcgtttgatttgctgccaaattagttatatatgtcggctcaatctttccaagatgctcataagaataggtgtatgtgcacacaagtcttatcgtgtacgcaactaaaaatctagaaaaaaaattatagaagtgatttcaatagtattacacttatctgcgaaagggcctgtagcctagtggttacaagagactcagtagaggtcttgggttcgactccccatggga

SEQ ID NO: 18197 - DNA, 1501 bp, Oryza sativa
gaaaaaaaaatgaattgaatgttcggttgcgttattcatttctctaaacatgaaactttcaacgcatgcctccttttttttttttgaaggaaatgcctactctaattattaaattaaatcagcttaacaccttccaaattctctggaagaggcatagcaaactcttttgcagtccacatcactaaaaaatattaagaatataagctagtatatcttgtacaatagtagtagagaaaaatctcttgatagtatatatttaatcgaaccaatactcctgctttgttaaagagaaaaaatatactacccaatcctctcttactataaagttataacccactaactcttaaagcttaacatgtaaagatgtcatatcatcatccactaacaacatgccacatcaatatccattgacaatcattacatttaaatatcatgcaaacatgctatattatatataattttataattttttaaattttagagctttataatgcaagcatgttaaatcatcatctcacataattcataaaatatttcaatatatatcttcattattttaataatatcctatatacctatatagttcatcctcaattagttaatgatatttctctcttctctcattaagccatatcatatcaactatttttaatgcttaaataattaatctatggtccaaattatctataccttttcttctttcattaagccatatcacctcaattgtttttagctcatagataattaatttatggttcaaactgtctccctacttttcttctctaataaagtcatatcaccttacttttacatttgaatcgttattctatatactatttaaatttaaattatcgtaaaccactttaacatattcttatgttgtctagctattttatacattagttattgttatcgtacattattttcacctagtaattttgaatttctcaccctctgattcatcacgattttctactctccatcggtccatcctaccgatgcgtcggtatagctgctccacgcctccaccagctgcgtgctccaccactgaccagtgaccacaagtccacaactgggacgagatacaaatcatataacggtgggccgtgggctgctccaccgttggataaatagtctattttacctcccttaactcttgcccctgaataaatcgcatctctcactagcaataccaggtataacatctcttccatcttcaaaaaccaaagcaaatcgagtctctcaactgtatggataactgtttcatcgtacgtggcgctcatgattgataaaataaataaatacaaccccacatgtcagtcatcctaatcttctttttcctttttcctcacctctctccctgttatatctctccaacctcctgcgatgaactgcccgctagtccggccgctccttaaataaatacaaccccacatgtcagtcatcctaatcttcttttttctttttcctcacctctctcccccttctatctctccacctc

SEQ ID NO: 18198 - DNA, 1501 bp, Oryza sativa
atataattaattaagtattaattacttaaaatttaaaaatgaattaatataattttctaaaacattttttctatagaaaattcctttaaaacacacggtaacacttcgggaagaatacgcgtgaaaaagaggggtttttcctatcattgtgctgctgctgaacgcaaatcgctcccaaagagtagctttcatgcagtagatggaagttgccacaggataaatgggtgttttctctgctccatagaagcaagtattctgaaatggccaaatgggagtactgacctagcatttgtttcaacgttgatcagttcacacctcttgttgcttcctgtgaacactgaccagcacatctctgtaattgaagtgccaaagcttgatgggccccaaatgcttagccaaggccgagacaacggcccaagtaatctggataaaggcccaaacttcccaaacgcctacaactccaaatgggtaatacaaaggccgagtttagttccaaactgttttttcaaatttccaacttatccatcacattaaaactttcctacacacacaaactttcaacttttccgtcacatcgttctaatttcaaccgaacttccaattttagcgtgaactaaacacacccaaaagcatcacattattcagtactatgaaattcactgttctaatcctatgtagtagtaagtacatcacattgttcttttttcttgctcctactccactaggactcattcacattatttctgtagtgtcctggtcgatttgatgccttgtcaatttttttgttttcgcattggcctttctccaagcaagttcttgcgacgatgatttcgactgaataatctgaaccgctcaaaattttgtcatctggagcttgagagtttcttgggtccaagattccttgcctgttcttgcacaagcatcacagttgtttttgctcgtaccttcctcctctcatgagtcatgaatggtgacaggggtgcattgaagaagcattgacaaatttcactgctgcatccatgtattcactctgacaagctcttggatcctcttggaaaacgaaagtttacagcaagcttcttcagcatgtgctacactgctagtatcacactcttggagagcttgttcagcatgtgcttcttcagcatgatgctgaagagcaattgcattggttcagaaaactttgttcggctgtttgtgctgatcaatactagtagtagtccctccgtttctaaatagccgacttccctaaatatttagaaaacgtcgttaacttttataaatatgtttgaccgttcgttttattcaaaaacttttgtgaaatatataaaactactacctccttccctaaatgtttgatgccgttgacttttttaaatatgtttgaccgttcgtcttattcagaaacttttgtgaaatatgtaaaactatatgtatacataaaagtatatttaacaataaatcaaatggtagaaaaagaattaataattgcttaaatttt

SEQ ID NO: 18199 - DNA, 1501 bp, Oryza sativa
cggatccatgcggggggcggccgccgccaccgtcacgccaccggatccgcgtgggggggggcctccatcggttggaggcgccgccgccgtcgcacgccacctcgtcgtcgcaaccgcccaccgtatcctgcgcctccacggccgccgcgctgccgctgcgcgccatcgtccccgtcgccgcgggcagccgccgtcgcctacgcccgccacgcgccgtcgtcgccgtcgccacgggccgccgccctcgcctacacccgtcgcgtgccgtcgtctctgtcgccgcgggaggagaggagagaggagtgaggagaggataggagaggcgcgcgtgacgcatgaggagagaataggagagagagagcacttaatgtgtgagagaataaaggagagggaggggaccgaggcgtggaaaaagggaaaattttgaagtgggtaggagggaaaagaggaatgattatttttgcgtgcggctctcttaataggcccgtatggaaaaatcggcttatttttccgtgcagttcatttaagaggaccgcacgggaaatcccgtgcgggcaacaacccgacgccggtcccatatttttccgtgcggttccacttacgaaccgcatggaaactaaaggggcagcgtctaggaaaaatcaatcgtgtagtagtgcatcggcgatatcgaaatatgtgatcaagagtgtactgtgtacctttggctttttaccatcagcattcaggtaatttgccgacggtaatgtcggctataaccaggtcacaacaatggaagtccgatgattcacattcactccctgctattgcttgaccaatctaagttccacttaatgctggtatgatttgaaacactccaaaccggttcagtacaagcaaaaaaataaccaccagaaaatcacctaaaaatctgggtaatgcataaataatgcaaagactgtcataaataaaaagaaatggacggcacaccgtccggacgaagcatgacagagatggaattaatggaaaggaaaagaaagctgagaacagaaggaagcaataaagcataaatatatatacgatgtttaagctacttacatgtcttagttgatatataacaacacattagattgaggcgtgacaccagtgcctttcgcccccacatattgcatgatgtgggttggtgcccaaatagacaagtacaccctgcttgcttttcactgaagaaagttgagaagcccttttcagatataagaactgtatttttgtatgggtgtatgtccctgcggcatcaattttgatgttttgtaatgtacgtcgtctcagcaacttaatcttgaagatgtattgtgtgttactacaaaatcatattcatacgtacaaaagttcagatagtaacattttttaaaaaatgatgctacatctcagggtaaattggtcgaatatatatttttttaagataatggaaatgagttatagcttttgcaaagctacaaccaccatataattccactcaacagag

SEQ ID NO: 18200 - DNA, 1501 bp, Oryza sativa
tgataaaacagcatataatgtgatgtgtgtatgtagggactgtgctgcctgcccagctgtggtggcctgaatcatctcatcctccccaccttcatccaccatgctctgtctcttgccttgttgcctcctagtacctcttggcatgcatgcccacttgtaatccggattcacaatcctggtactccctgcgtctcaaaaaaaaaaaaaacattctaggagagaatgtgacccctcccagtacaatgaatctggacagagtgttgcctttttctggaacggagggagtacctttttgtttttagttgtgtttagttcccttcaaactttcaaaaattctatcacatcaaatatttagacacatgaatggagcattaaatgtggacgaaaaaagcaattgcacagtttgcatgtaaattgcgagacaaattttttgagcctaattacgtctaatttaacaatgtggtgctacagtaaacatttgctaatgacggattaattaggcttaatacattcatctcgaagtttacaggcggaatctgtaatttattttattgttaatctacgtttaatactttaaatacgtgtcggtatacttaaaaaaaatttagacagggaactgaacacggcctttgaatggaaaaaggctccccactggtttattgaaaaccgatgactttcgatcaatgttgaaaaccaattaatactgatcaactttcacagaccgacaactaatttcatgaaaaacaatcggttttatgaacctgcctagtaccggatcaagaaccgattggtatgtcgaattccgtggaaatcgttgataaaccaaatcaaaactgatgaaattagaataaatcttgtcaaaagtttgaaattcagtttgaaaaccgagcaatttgtatttttttttcgttgtctaggaaatctggtttccatcgtttttataaaccatacttgtataatccatcagttttataaccatggctgtgtttagtttgtgtgccaaaattattataagtatacggacacacatccgaagtattaaacgtagactaatagcaaaacaaattatagattctgcctgtaaactgcgagacgaatctattagcctaattaatctgtcattagcaaatatttactgtagcacaacattgtcaaatcatgacgtaattaggctcaaaagattcgtctcgcgatttacatgcaaattgtgcaattggtttttttcatccacatttaatgcatcatacacgtgtccaaacatttgatgtgatggaaaagttagaagtttaaagaaaaaagtttaaatctaaacacggcccatgcttgtagtaatagtacatcatgcttgtataatccataggcaggagaggaaaataaaacagatcataggagaataagggaaagggcaaagaagaatataaatcgtacttggattgccgtttcggatttgtacagtggcaagtaaacaataaactccgtggcctactgcaatgttattgtc

SEQ ID NO: 18201 - DNA, 768 bp, Oryza sativa
attttagtggtgataatgttaatattcataccactttggattctatggtaccctctcctaatagcaacaaagttggaaagacgggtaaaaagaagaagaagaacaataaaaatcagttttaaatgaaaggaatcttttcgaattgtgatgggtttaaggacccaaaaaaacataagtttatttccgacttaaccaaagaacatctattggactttattgttttgtctgagactgttaagaaagagttttctccggctgctcttaacaatctttgtgctggtaaagatttgttttggcattgtaaaccccctaatgtaggtctggtggacttcttttgggtattaatttacttaatgccgacattggtttgattgatgagggcgatttttatattaagtttcatttatgtaataaggtttataatttcaagtgggctttagttttggtgtatgggcctgcgcataatgagtacaaggatcaatttattgctgaattagttaatttgtgcagtcattagtctttactagtgcttattggcggtgattttaatattcttagtagcccaatgacaactatgatgatagatggccctttctgtttaatgctattattgatgggttgtgcctcagggagttacaaatgtctggtaggaattttacttgggctaataatttagcaaatccaacttatgaaaaaattgatagggtcttaatgtcgacggagtgggaacacaagtttcatctatcttctgtggttgctcttaataga

SEQ ID NO: 18202 - DNA, 1501 bp, Oryza sativa
aaattactaggtgaaaataatgtacgataacaataactaatgtataaaatagctagacaacataagaatatgttaaagtggtttacgataatttaaatttaaatagtatatagaataacgattcaaatgtaaaagtaaggtgatatgactttattagagaagaaaagtagggagacagtttgaaccataaattaattatctatgagctaaaaacaattgaggtgatatggcttaatgaaagaagaaaaggtatagataatttggaccatagattaattatttaagcattaaaaatagttgatatgatatggcttaatgagagaagagagaaatatcattaactaattgaggatgaactatataggtatataggatattattaaaataatgaagatatatattgaaatattttatgaattatgtgagatgatgatttaacatgcttgcattataaagctctaaaatttaaaaaattataaaattatatataatatagcatgtttgcatgatatttaaatgtaatgattgtcaatggatattgatgtggcatgttgttagtggatgatgatatgacatctttacatgttaagctttaagagttagtgggttataactttatagtaagagaggattgggtagtatattttttctctttaacaaagcaggagtattggttcgattaaatatatactatcaagagatttttctctactactattgtacaagatatactagcttatattcttaatattttttagtgatgtggactgcaaaagagtttgctatgcctcttccagagaatttggaaggtgttaagctgatttaatttaataattagagtaggcatttccttcaaaaaaaaaaaaggaggcatgcgttgaaagtttcatgtttagagaaatgaataacgcaaccgaacattcaattcatttttttttcatagagaatgtatcctattaccaacgaatgactgaaaattaattgcataagctctctgtacatgattgcaaataattatattcatttcaatcctgctggcgggtatgttattagtatcaccccagctgccgtacgttcaagagtcacaatctgaacatatataacatggcaattcagtagaattaattccttgctcgagtgactcgaggtacttaaataggcaaaatgtctgcattccttttccttaaaaaaggagtcaatagaagagctatggtctgtttctttcggcttgagattattataatctagattattgagttagattactataaactagattgttataatctgtagtagaataagcggttagttgtttctttcatagattattacagtctagattatttggtttgcaagtctaaagagagagtggggtggcatggtgggtaatttttcatccaataatctggaaaaagctcatctaaatgagcttatcagattataataagctgggctctagattataataaactattttaataagttgtctgtttctttcagc

SEQ ID NO: 18203 - DNA, 1501 bp, Oryza sativa
tcacccaaaaatcattttttactaatcaggacctaaaattgtgaaaggctattgatcaggtttcttatgaacacaacacacagtttgtgcacttgcatataaatcacaatgcaataaaacatccaggctaatgcgattagatgtgttgtgtttgtgctatgctacaattattttgtatgcaattagatgctatgctatgctacctcttttctcatgtaaaatttattttccctcatctcgagtaaaacaattgtgcatagatgtgttgagttgaccttgggtaaagccctaaagctaaatatgtggaggtgagacctttgtgaattcaagcaagtttccagttcattctatgtatttagccataattaataatggacaatttgagaggaaaatatttctatggaaactaaaagtggctcttaaaacttgtgtggtatctgctcaaaggagtaatattaactaaagataatttagtgagaagaaattggaatgacaaaaagagatgttatcttttatgaagaataagatgatttatcatttattctttcagtgtcattttgctaaatttctttggaaatcactacatacttctttttgacaaagatcccatattacttctcatatatctggaaattagcttatggatattgattaaaaaaactaagaaacttattttaaatggagtatttgctatatattaggctggttttgatgaatcctcatctaaatcttatgtgataattgtgcttttgatcttattctgaagtctaactactaacttggcccctcttttccaattttgctcatttgatcctgcttttcaaaaactgacccacttctacctgcattgctaggagtgttattagaaaatgcatttagagaattaacaagaccaaaatgccccccggaaatatatgtcaaacctacatcagtttcatcacatactttagttaaattccatcgcatattttatggggactaagtgaaaaacctgggtcgaataaacaaaaaaaaagattaggatcaaatggcaagggtataaatggtattttccccttatataacaccgttagttatcttcacgaaatagggtcggacctgatctccatttttgaaaaagagggtcaattgagcaagctttaaaaaacagggccaaaataatagtttggcttaaaaaagggtaacaacgcaattgcccccaatgttatatgcaggcaatgtaccggcctcagttctagacataagttgaaagatgtgatgagtacaatgaactattggatgctacgtgccaaaatctagctagagtcaacggttatgcaaatatttgctaacttcgtgtggagatacaaatagacttgaataaacgtttacctcctttagtattggtgctatgagtgttgcatcgtcatttcctgggttttatatgtactctctgttgagtggaattatatggtggttgtagctttgcaaaagctataactcatttccattatcttaaaaa

SEQ ID NO: 18204 - DNA, 255 bp, Oryza sativa
ttggcttgaaatattgtcataattatttttttacatttatgtaacatttatgttgcccaattatcatatagttctaaaaattcaaaaaaaatattaatctcaaacatattaaattaaatcatatatctacttaaaaatacacaactaatttgtattgttttcaattattttacatatgtagctttaaattagcattatattatcatcaagtgttatttgacacctaaaatatgatgtaaaattatttaaaatagg

SEQ ID NO: 18205 - DNA, 1501 bp, Oryza sativa
tctgaccttgcggctgctgatgcttcggcttcggacactctcttgcaaagtgacctggcttgtaacagttgaaacatacctgctgctcccttccactactgttattctcttgagactgatcctgctgaactggcaccggctgattagcttgctcgatgttaacttcattgctttcattagtctctgatttgatctcaccaccgatgttcaactgttgcgactgtccttgaccagtagaaaaagattcaccaatttggagtggcttgatacgctgcctctggctactatcctgtgcctcctggaaaacaatccttcctctcttacgattgtccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatactctgccacggtatgatccttttgcttcaaagccctaaactcacgtttcttcaaagcaacaacacctgcaggtatgtgtgtcttcttgaatgcctcagtgaactccgcccaagtgattggttgtccttctgctctgttcatccggatgtgatcccaccattctgaagcagatccttgcaactgatgtgaagcgaaaacaactttcttctgatccgtgcactggagcaattccaacttcttctcaacagcgtgcaaccaatcacctgcttccactgggttggtagtgctagagaaggtaggcggcctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagagaagataggaggagaggggttacactaaagataagaccttaaccaggttaacactgatctgatgtgtgtagaccattatattgttcaagttgattaagcaagcaacctagtatagttacacactcatcaatgaactactccaatgatgggaatgcaactatacctacacacaaagcaaacaacaaacgttctaccctactaactattcttcgaggacagtttggcggcataggttctaagataggatccaaacttcattccatcttgaccacttgcacttcggttcttcctcgatccactttactggcctccataagttgacctcatcaacatcttctagtttcaacaactagtttcagaactactcaagttgaacgagagaggagagtagacaatgaaacaatttgcaaagaattctagataaggaagaaaggagaaattttcacaaattatgttttcggaagatttgtcctt

SEQ ID NO: 18206 - DNA, 202 bp, Oryza sativa
gaagaggctggagtccacaacctagaacttgaggtgtgtaattcagtcgcaaaaaatttcaaacaaaatgttgttcgtaaaaaatttcaaacttgaggttgctaagtatacttctgaggggaacatggtaaagaatcttaggttggctctcacgaggttggatgaaactgctgctggtgttggtacattccttcatctaaca

SEQ ID NO: 18207 - DNA, 1501 bp, Oryza sativa
gttcgcgagctactgttgtgaaacatttaccgtgccaaccacaagccagcatgggcaatggctttatcttttgtatagcatggttcattatagtgtgccagactgtgaagtggcgagaagtccacgggggtcgctggggagtccatgccttgtttataagggggtgattatgatccgggaatggtgcactgttttgagttgtgttgtgcaaagggtattgtcacgatttccccctttgcaatgccgtggtggtattttggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgagtatggttgttcaggatggttgggcctgagcagcatgggtgtgctgttcagtgttgattaaaatttctgattaattactccactgttttacttctcttaaatgttttgctaaatgctgcttttgcaaatgagcctgtattatgccatcctttggtatccttgtgcacttgcatatttgctgtgtgccttgttgagtatgtcatatgctcattcttgcaataatcatcaaacctcagttgaagaaaaaggatccagaaggagaagacgtttagcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggttgattcctggacgaggattttatgcacaaataagttcggaaattactagtgaatttccgggcgtgacaagttggtatcagagccatctcgactgtaggataagccaaatggtcaaaccttaaggacaaatcttccgaaaacataatttgtgaaaatttctcctttcttccttatctagaattctttgcaaattgtttcattgtctactctcctctctcgttcaacttgagtagttctgaaactagttgttgaaactagaagatgttgatgaggtcaacttatggaggccagtaaagtggatcgaggaagaaccgaagtgcaagtggtcaagatggaatgaagtttggatcctatcttagaacctatgccgccaaactgtcctcgaagaatagttagtagggtagaacgtttgttgtttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttatctttagtgtaacccctctcctcctatcttctctaatctgcaacaga

SEQ ID NO: 18208 - DNA, 311 bp, Oryza sativa
catcagtaaggtgtattcactggatctggatccgctgtctttttacaaagactttaataagcgggggctgcgcttatatattgatgaaacgagaatcaccacatattccttgaccagcgtgataatcttggagacgtgggaggtactcacttacttcgaatcaaactggacacgattactagccatgtgcaagtttgtgaattgcagaaacagatgcctgaaatttgtcctgaatatgctatttagattccattacatgcttaacttggtgaaaagatttgatatttcgtgtctgcaacagtgtcccacca

SEQ ID NO: 18209 - DNA, 1501 bp, Oryza sativa
atgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgtcctttaaaatgttgtttctctttttgtttttgtttgtagatggccggcagcgttacccgtcgtggtttggacatgactggcttcgttttggagctgcggggcatgtgcgtggtcttggggtatccacatggagtggattaccaggccaggccgctcccggagcaggagggtgaggatgcagagccccgcgctggttgggaggtcactgcagtgatcctcgccggctcttctgagcggacttcgctgacagtcaccgcgggtggcgactccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtcgagaacaacatgaagatcctggagctgcgtcaggagaacctgcagctcaagaaggacctcgacgcgttggaggcgcagctgcatcagctcaagatcgcccagggagaggacagccgacccaagcgtcgccgcgtctgccgcagccagaagatcaccgcccgcaagagcacctccaggcctgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgttttttctcgtttgtcttttttgagttgtgtggggcatggttacaccggtgtgtggtgtaactatgtcggagcctgtctttatttgtttgcctaagcaacttgaacattaatgaaccaatttaatagcagtaataaattcaagaattatagtagtcgtgggtggttagttttaatcgtcagctctccttctctgtttgctggttctgtgtggggttttc

SEQ ID NO: 18210 - DNA, 1501 bp, Oryza sativa
tatggcaggtataggtgtcggatctgtacttgctcatccatctggatataccagaaaactattcgagttacataaaaaagaaaaccattgaatcaaaagtcaaaactgctgttcccttccatgatttgtttgtccattactccattcgataatctaggattactgtccctatcccattatttcatgatttgaggagaaatgcaccggaatatatatttttttgaaaaaaaaaagaggagatcggactgagctgcgaaaattttaccgcgatgaatcagagaaacagagagctccacatcgcaccatggagtcccattgagcgagacgccaaggccatggccgacccagcaagcatgcccccgtggagcgccctcctcgagtgccggccacgctcaccaccgccgccgccgccgccgccgccgcagtactatccccgacttgacccccatcgctaccgctgcgactgccgccatttcacttcctccggacctccctccccgccggcgagcggcggatacagcggagaaaatgggggaaaagcaactgggagaccggaggaagggagccatcagcttccgccgccgccgctcgccggatctgcgccgccggcctcgaccattccggtgcctctgcaaattgcagcccagtactaacaacaccacttggtcggcccacttctgcttttaggcccagatagaaaaagatggctctgggcccagaaatcaaaacttgtcttattacctactaccttcgtcccataaaaagtttatttttcaatttttgatacaatgtttgagtttgactctttgttttattttttaaaaaaatatgattattattattattattattagatgataaaacatgaatagcgctttgtgtgcgactgattgttttattttttttcaaataatatgaacggtcaaacgttggatatagaaatccaaaaataaacttattttgggatggaggtagtctttcctctgtctcaaataaacaaacctttactacagaaaatagtttggaaataaacaaacctataataaaaaaaagtatgggacatcacatatctgctatgaatctggaattctggataggtacgaattggacaggaggcatgcatgtccagattcttagtaatagattgtgccaaaatttgtttattttgctagattaagcatctgcatagttgcatataatgtgtcagagttatagataccacatacctaatagtagttgattaaatctcggtaggacccaccacataccatgtcttatagggacactgacctcggatatagatgaagttccggataaggaaagacaaccagagttctacatggaaacgacaaggactattcggattatatccatattggtttccttatccctagttctacttggacaaagggacacatatgggtataaatacaagaccccctaggaggagaggggacacaatcaacatacacggaacaacagaagccacaacatacaagcc

SEQ ID NO: 18211 - DNA, 1501 bp, Oryza sativa
cttgatggacagaaacagaattgcgctaaaacagtgaaaatctgaccaaacaagcaacaagaagtaaaatatctgaacacagaacaccaattaggcatttgttgtctgatgtattgtcaagaaaaatgtaatcatatcttttattggaatacctattttactcttagcaatcaatttagcatatttatctattctgaactgctactatgttcataactagtttcaggaaactgggtgttcagatattttactagaggtcataccatacaaagctatataaatggctattgaatgacaaaaatataatctgttgtgctcaattaaattttcaggagaggcactggcgtgtgaggttggcaaaaggaaagctgaaggagttgatattactcaaggtatttgagaaaaaactacatacagttgtacttatatttacctgatacgaagcatttaatcttacccctgcatatttactagagtagcagaagtaatttgaattggcacacaaatatactgacctctgaatctaagatttgtacctctgctacgtgaggttttagcaaaactaagtacacatatctgaatctgagaactgtaccttggctatctctgaggtttaatatatatatcggatttgctaacttgagtataagtaaccatctttcgcatatttatctgatttgattcaagttcattttacctgttgtttggtttacatattaacaatcaccattgtctaatgtctaagactggtttctttttggttgtgtagttacagggtcccatggcccatttgctagctacgcccattggaaggaatcttttgcaagatagttctcagagaccgcttgaattatgaaatgcgatggatggacaacaatttttcctaactgcttcttaattcatgtagctatgatggttgcaggaaccaattttttctacaaaattaacactttgatcagacagagatatattaccttccaagaaccaattttgtagcttgctttgcacaatggcaattggatgttttactgcttgtagaatttaatctatccaaaattatgattttaatattctggactatttttagaattcatctgtggtaaatctacgattttctgtttttacgctttttagaattattttgcacgttgaatttctgttccattttcatgatctttttttttcttgtcatttctgaattattttgactttcgtgaccttccatttttttaatttatccgaatttttcatgatattttctcactctgaatttgaatggtagtaatcccttctaatcccacctctaatcccaccttctactccaaactgctagggaacaagacataacgtgacagtggaatagagggggattgggaggaaaggtattgggtgtggggagcggggacaacccaaaccccacgtgggttggttttccttcggatcatttcccacggctagcgaaataggcctcaatcaattttggaaacggacgggggagtcg

SEQ ID NO: 18212 - DNA, 1501 bp, Oryza sativa
agggcctgtctcgtactgattttgggacatgcaccatattgacatctacaaaaagccatgtagccatgaaaaacttcaccaaagacagcagaagagtgaagaagagcgaaagaagccctctgcagaagaccataggataactggagtggagggaatcccggaggaacctgacatccagctccaggataccgaacagtaccttgtcagcactatctgagaggatcatcttgctgattagctttcgggtcatggaaacagtagcttcatgcaacgttgctccttccagcctacaccggagcaaccgagataatgcaaatgccagggccatgtccttcatgttgttcccctgcatgttgatggaggttagcagcaaggcactatcacatcgccaaatcttgtccaaggtaactagggacttcaagtcttcaacttttagaatgtgtgcactctttcggcttttctgtaactctccataaaccaagtacttgtatccttccatagtctctgggttgcatatttcaggattaaagttgctcttgttaccattggcacccatgtactcctgaagaagttctgaactacgaccattccacaaggacttggatgctatatggcgcaccagaatcttgtagaagcactgaagtaccagaagaccccaaaagaaccaaaatggaaaacgccacaatttggagccacgtgttaaattcatgtatgccacaactaaaagcttcaacacatttctcagctcaaaaaacattccagaactagagcggccatggatgctagagcggagaccaaccagtataagggcccagactgggaacagctggttatttaaaggtgcagcttgcatagcccccataatgtatacaagggtggcgtcagccacaggatccaggaagttcaccatggatctgtatatacgggtgaagaaaaggcttgagaagaagaacatcagatagaggatggtgaggattcccattatgactcggatgcgaagcaagacatagctctccagattccatttgataagaaagtttgcaataagagcaccaggactcatttttagttttcccacagaaaagtgtgtagtcaaaattaaccgcagaccctggcaaattaaacttatagagaaacttcatcagaaatataggttacagaatatataacaagtgcaatgaagggtcatgaacttatgctgacaatgctatactggaccattgtaacaagatttacatgcttcacaggcctgtatgggatgagatgggtggtggtgctaacgaataatcaatatttgaaagtggagaacttattattgcttaatgaaatattctcttcgtcccaaaatatagttacctttatagttcaacttattattgattagtgaaatactctctccgtcccaaaatataactgcttttctaggtagaagataaatacagtgaggttttccatgacctgccctagaaatctgaaaatatattagtggccatatttaaaa

SEQ ID NO: 18213 - DNA, 1501 bp, Oryza sativa
ggcctttcttgaaacacaaccagcaaagctgggagaagcacaggcagaggaagacaaaacatctttgactggaactaacatgcagagatgacagtaggaagacaagctaatttgatgaggggtgggactcttcatggccaatgcagggtacttcttcaggatgcagcgcgctcacaggggcgcgatcgctgccttctttcttgctgccttcaggcggatgctcttgcatcctcccttctccgccagctcagtgattgtcttcaagaaggagggggacaacggtttcttgtagcgctgcaagtaaatctttttgatgttatcatcaaaggaagcatgatcatcaattataccaaacttttttgacatgatctcttgagcaaaagtttcaagttttgctcccgcccgcctcatgccaagcaggcgttcgctatgacattgtgccgaggaaattgcaggtattgtcactttcacgtggcttggatggcgagcatttgcgtccagagcaggcaggagcggcggctgaagcggaatcgagagggtgtcaatgaactcttccacattgttcacctggcttaccagcaatgcagcttgagcttgattgttcacctgtcctgccaccgacgccccatgaacttgagtcacctgttctgcaaaagaggaaaatacgaaaacaggggaaacagcacggagggaatttgtgtccggcgagtagatggagtactgcaccgccgcctcgtgcagcattgggtcaaggtggctctccgggagggtaagaacatcctcctgcccctgcgaacagaagcagttgtcagcttgaagaacagcctggtccgggatggcaaggttgacggagaaggtagcagtggcgtccccgtccgggctcggtttgcggaccgagcttggttgcttgcatggagaggcaagccgattgggagagggtagaagggtgtctgaggcaggattgttctgagaggtgaaggatgaagagagaggtggtctcaccttgcttggctctcgggaacggccgcttctgctacgtggatcagagcgctcccggttgcgcgagcgccccctggccatctctcctttctggctccctgctgtgacttgaggacaggcgcccgagccaatcccacacagagcggctcttgtgacgactcctgcgctgcctgtccctgtccttgtcttcatcatcatctgttggcccctgcatgcttgtgtcttcaaccctcggcgcttgcagaaaattctggactctaatttgcattaaaaactaacaacacgcatgcatgtatataattaatcatcaaaaccatatagttaatagccaaacaactttaaaccatttgttttctattcggctaattactcaattaataaccaaattaaacctatattttagatttggctatcaacccaaacttttaaattatatgaaaaagatttttagtttgcctttttcttaaataaaatgagggtactacaagtacaataccttggg

SEQ ID NO: 18214 - DNA, 681 bp, Oryza sativa
tttggaactcacacttgtcgatagcatttctaggaattagacgcttgccaatggcattttatggattatctctctattatcagcaagcagttagcatgtactattatgttaaaggacttggattcaaaggctatattcaatgactcttcagccttcagatcatatgattatactattataaatgccttcaatcagtctagtgtgaatttggtagcgtgtacttcagaatatatatagctattgcagcaagttgatgggggactatgaattatgtaatgcctgttgatgtcagaccactccaaatgctgatcatccaacttgtttagcttcaacatcatatcatattagtcaaaagattaaaaaaaatagcaagttgatcatatcaggaccaaagaatcacaagttttttcctcaaatgtgttgcaccttccatccaacactccaccagcctattttgtagcttactgctaaaacaaggccgcagcattgagccattaaccaactactgtgtacaacctgaagaatgcctctactacctcccatcctaattcctaaaatacatttgttttttcttttccgaacaaaaacacttttaacatttaaaagacaaattaacagaaaagaaaatgatctacattcccctcatcaaacgaggggtgattggcaacaagataaagagaa

SEQ ID NO: 18215 - DNA, 1501 bp, Oryza sativa
acagtaatcctagattatcgaatggagtaatggacaaacaaatcatggaagggaacagcagttttgacttttgattcaatggttttcttttttatgtaactcgaatagttttctggtatatccagatggatgagcaagtacagatccgacacctatacctgccatattcagtctgctcatgtgaaagctggacatatgattttttttttctgtgattgcttccaacaccattgcagtattacattaaaactgctttggtcatagatgcagagtgtagcaagacagctctgccagaattttttattccgtggcaaacgccatattttaggaagtgtgttaaaaataaagactcatcattcatcaaggcctctaccgcgggatgcgtggttcaattttataatcgctatatcgaattggaggtaatggaggaacttggcctatgacaacttgccagtttccagatcccagtgctgccttctcggctcaaggtcttgcctagagttctctccatctgcccgagctgtggataatacgccatgagaagctgctgaattctgaatgggtaagattgactccttttcgccatactaccgcagtttctgatgcatctgtattgcatgcttgaatcacccgctgcctggatttttcttgtagctgccagcaacagattgcatgaaaaatataacatgcttgcttttcactggctctgtttgtgcagtcagagttcgaaatagcagctgcttggttactggttaggaagagttttcttagtagttacagttttttgcaggtcaaaagcagagcacacattgtcaacaccattttaactgacacaagattgtcaggaaatcataacaaggtccaaatagatagataaacattgctgtggaccgcagcaaggttgccaagcacaagctgaagcaggtacacccatcgtttgctctactcattggctaattggctagaaagtgctacatagatttgtgtagattgtgtcatcataagctaatttgtccattctatccaaagaattgtagcttactgttactgactactgatcaagagaaggatcaaaccgtatagtgaatgaaatgcacaagcaagaagcctcactgtatataaatatttttaaatatggccactaatatattttcagatttctagggcaggtcatggaaaacctcactgtatttatcttctacctagaaaagcagttatattttgggacggagagagtatttcactaatcaataataagttgaactataaaggtaactatattttgggacgaagagaatatttcattaagcaataataagttctccactttcaaatattgattattcgttagcaccaccacccatctcatcccatacaggcctgtgaagcatgtaaatcttgttacaatggtccagtatagcattgtcagcataagttcatgacccttcattgcacttgttatatattctgtaacctatatttctgatgaagtttctctata

SEQ ID NO: 18216 - DNA, 1501 bp, Oryza sativa
ccttttttacatagcttttctaggaattaattagagcgttctatgtcatcttaggagcgtttctaggaatatcacgtggcagttcaagagtgcttttagtatgtaatagatagatatatctatgtaggtgtgtgaaatttactttataatatatattgtcatctttattgttttgttcttattttataaagataaatataatagttgaaaatagtggatctaacgatttattaaacaaatagtgggtccaccggtttattagaacgccatgtggcggtttagaagcatttatatgatgtcacatggtgatttaggagtgtttataagaaatataatggacttttagtatataatagaagattttgctttctaactaataaagcataaaaatatgagaaggaagagttaatctaggaagacgggtgaaatatgaatcaaatatcataattaggtaagtacctatgagattaggacagaatgattagttaaatttataatggttaaaaataataggttcatcgatttaagtgtaaattgttggtgtgatattttgctttttttcacaacttttttattttttaatcttaaattagggcagagattagccgtgaaggattaattagtttaaaaatcctaatctaatcgtcaaaaataataggctcaacggtttaagtgtaaatcaattatatgaggttctgcattttacttagaaatgtttggattttattgatctaaaattatttgcttaactataaattaaatcagactcatcatgtttaccttgaattgcttgctataaaatagaaagtagagagaaggggagacacatgatatatgtgcgctacggataacatatcacaacataataaaaataataatatctgagatatatattttttttcatatataatagttagtcgtacgtgacatctacgtacgtacgcacgtttgtacatgctaggtgggcccaagattgggtgtttaagataaatctaatggttgtaaataatgggtccaccaaatttaatgaaaatcaacggttatttgttagagtgccacgtgtcgggttaggagtgtttctaggatgccacgtggcgacttaggagtgtttataggaagtttcatggacttttagtatataatagaatagatggtgatgaaatacacggaaaagctgcataagtttggcggcacaaaaacttctcgcgtgtgttcttctcttccactgttcatcgtcaagcattgtcgatttccaagggttcgtgtgtagtttgatcctgagttttgccaacatctggtatcagagccatgtcggctccgacgccgcgagtctcgcgatcgccgcgtcatcaatcccgctcgcctcctctgcgccgtggtcgtcgtcggcctggcgacgcctggcacttgggtccagtcaggcgcgtggtcaaggaggtggggggctcagccaactattcgatcctcacgaagacgaactacagtgattggtccctcttga

SEQ ID NO: 18217 - DNA, 1501 bp, Oryza sativa
tgtatttttatgctccatcatctggtatcgagcaagttagaaatttgatagaaaataaaaaatacacttcagtaatctttttgttcagattgactctaattgagagtatctagtcctggatcttatcgtgcactagggcaggagcatcctgagcatcatttgatgacgaaacacgtgatgatagtacgatttgatgatagaataacaaagaaaagataaaattaccctttcaaattttatactgcaatctgattaactaaaaaatcaaatcaatctacaccgatagatcctgtatacttgctgtatatattagcagtatattgtaccgtaaaagtccacattcgtaggggcatttggttgcattggtgccctgagtgatgagcatgagaaaaaaaaataacatgaatgtgtgtaaaagaatctatggaaaattttacctcatcaggcatatgagagggtttattatttttttggtagcctggacaagaaatgagcccgagagaatgaaataatgtgaaagcaaatctttacctaattaaaaatttcgtagtgttttagttgtcctctgatataccgaccctgaaaatagaaaataaaaaatctaatctaactttccgttaatttttttaatcagatcgctccctcgccatatcactccatccccatatcatttacctattataaacattgatatcgtttttgtcgtacgtggtccgtttcattttttcgacttctcatctctttttcatccgactgcagtttggaacatgttttggtgcataaaaaccaaaatggccaattaattcaaagttgattagcagttaatgacccaattaagacgtttaatgatcgagccgaaaatattttctacttgatatgtgggcctataggtcacaacccaagtaagctactaggcatatacatgctttacgtttgtgctttcagcgataggtttccagacaagccaatgatttgtctatgcactatggtattttggtatagaactactttgaataatagttagttgtgcaatagtttgagcatgtaacccatattctgacttttttacaacattgattgagaatagtgcctctgttttcagtcgacctatctcccgttcatcaaccagtttctctgtacgtgacttgtaacagtggtgaatctaggatgaaaatagaggaggtgctcctaatatcctatgtccaacccacaatgcaataaaaacatttaaaaaatatacatttgtcggtctcatgcaaatataatttaaattttgtatatagaaaagaaaaaataaactaaggaatcaactgtcggtacttgttaatcaaatacgatggcataaacacataaaaatgcatcaatgacctgcagatcaaattaaatatagagtttagcattataattccaattataatcacaaataaacagtttcactaggatctaaaacgtgtcttgacatgttgttcttatttgttggatttttcataggacgagatta

SEQ ID NO: 18218 - DNA, 766 bp, Oryza sativa
atgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattagatgtagccttggtcaagctgcctgtggagtggagccgtctacgccgtttatttattttccgctacttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagagccagcggccggagagggtggaggagatgcccaagatcacccagaggtgtgaggccctccgcccgctctttagatttcgtagttttcttttggcgtttgccatggagggcgaacgatgtgaatttgggcgatggccctctccctttcgtattgtagccgaaaacggcatttttaatatatgaaatagatgacccaagtttagccaactattatgtttgatgcctttggtgcatatgcttgcattgtttcacatacgaaagggtgtttacccttttcgccaactttgtgtgttttgctgagtcttaactttgcgctttgccatttaccctttctatactgtcttagcagg

SEQ ID NO: 18219 - DNA, 1501 bp, Oryza sativa
actagattggtaggactatgtaatgtctatcaataccattctactcgtctttttttagacaatgactattctaccagataaccactccaacatccaaatcatctcacgcgtttagccccagtattataaccaaagacacagatcaagttgacggaaagcaatgcacaggagactcctgacgtgtatgccttccatcacccactacaaaaactaatttaaaagtgaaacagcatgctgcattgatcaacttcaacctgaagaatgtgccgtataccactgcagaaacacgaacaaaaagacctcgtacctcccatcagtcaagctgctttggcagcgcctgttgtttatcacggacaaccttctggttctggcttctgcccatggcatatatataaccagcgaccggcaacaccagcattgctcgctcataaccagttacttttcatctcatacctgcagtcatttgattgacctgctatccagttactcaatctaaaatctgcagagatcaagcgtttgcaacctgtttaccagccatggttggaggaggaggccaccaaaatcctgcagctgctcaaccagtaaaaaggtaaggtgaatctggagaatgttttttttttttaaagaaccggcacaagatggtgccaatctggactctttcattcttgtttcacttgaacacttcgtttggccatgtttgctgaaatctacgatcatggttggtgacaagggagaaagcgaaggttcaaaagaatcctcatcagcaagcagaggaaaagcctatggacgttgctgttggcattgttgtcgtcgttgttggcgccatcagtgctgttgcgaccttcatccttcttggtgctgtcatggtcaccttggcgattgttacaatcattgtcgtttgtgtagtcactgctgcacaagtaagtattgctcttcaaacgatgatgttacattgtaatataccttgctcatgcatcagacactatcagtcggcaatattaagaaagaaaatgatgttcaattgttcatcaatgttccttgttctaacatggtccttgcagcaataccttgaacaggcgaacaagaacaaagcttctcgctcaagtggcggaaataagttcattgtgttcaaaccttcagaaatagatgctgcagtcagcaaacgagcgaagtggctccgtggaacagctacatataatgtgtatcggtcagattttgatggaatggatattgctacaactgttcccaaaggaacactaccagaatggattttgatgcaagagtttcatcaagcggtaagtttcgttgaacacataactttctctgcactatgttcaaacataagttcatcaaacaccaccaaaagcgactgaagttttgcattccaaagtatagaaaaccaatgacaccattaatacattatacaccctgttgatttctaacagtacctctgaaaatgcaagatagaaccactgtgtattgcttcatttctcacactagt

SEQ ID NO: 18220 - DNA, 1134 bp, Oryza sativa
tggtgaatttccaattcggcaattactggctgtttgattgtttggaatatctaccaaccgaagaacatgagatgtttttattaactctctggcgaaactggtatgtgcgtaatgaaatcacacataataagccgcctcctccgctggaagtctccaaaagattcctggaaagttatattgctactctattccaaatcagggaatacccccacgctgatctggaaaaaggtaaaactgttgttagcagatctgttataagtgcacttagaagaagaggaccagatggtcctcctactgcatcgacccgtttgcactgggagaagccgaggctgggctggatgaaacttaatgtagatggctcatttgatgctgatcgtgggaagggaggtatcggtatgattctacgggacaacagtggtagtacagtttttgcagcatgtaagtccctggatagctgcaagaatgccctggaggcagaaatccgagcttgcatggagggattgattttggccctgcagtggactatgcgccctatcttgattgaaacagattgtgtttcgctagtcaatcttctgaaggaagggaatagggatctgtctgaattagctaatttagtccaggagattaaacgcctgttgtcagagcgtagggaagtgttggttaccaagatccatcgtagccaaaacggtgttagccaccttttagctaatagggctagggccgattcaatttctgggctttggccggaaggaagttgtaatttcatttcacagctagtctgtgaggacgttttgaatgagtaatacacttttttccccgcaaaaaaaaatatagtatgcattctgccctgcatttttgctcaggtgcatctagtaatggatgaaatgcatcatcaataacccaatatttttcaggaaaggcgtaaaaagcttacgcatcattacatatttaagattggaaggaaacaaagacaataacccaatgtgactgaagtttcccattgaaaattgttgaaaataatgacagcaataatttgacattgcatgtataacatttcaatatgcaatagctgtatatcttcatgcaagttatagatattatatattcttctgtttttctgactatatctctgaa

SEQ ID NO: 18221 - DNA, 346 bp, Oryza sativa
tgtacctacttcatgcaccaagccccacgttcctcttttttttctctttttcacgcacctgagataaaaaccgaattaattattctataatgtattatgtgttttatttattcatatattattagagatttaatatcaaatatattattttgacaccttgtcatgtcatttatctcccactttagacttcgatcaatttcattgggtgagcttatccaatgcacgcagaatggtgcaagtcattagcacaggattaattgagtattaaatataaaaaatagaaataaattaattttatttttaaaaaacttttatataaaacatatttgcaatacatgcatccggc

SEQ ID NO: 18222 - DNA, 1501 bp, Oryza sativa
gttttctttttataagggctaaaaacgaatcacttatttttttggctttttgaccccatattgtagggtggatctcgaaagataggaaaaatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatctttgacttttttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcga

SEQ ID NO: 18223 - DNA, 595 bp, Oryza sativa
ggtttttgatctagccctagtggatccccccttatttgaaatttttttatgattagtatttttattgctattagatgataaaatatgaatagtactttatgtgtgactaaatgtttttaattttttcacaaatttttcaaataagacggacggtcaaacgttgaacgtgaatagtgtaaaactgcacttattttgggacggaggtagtagtagagaccgtacgtattcatggactactagtactttatatggcctggtttgtcaaccaccacgttaccgctgtcgtgtgatctagctgcaggggagataatactcagtggacaggtcataacttgtgtgcatggagtatacacgaaaagcttatatgtgtatagaatgtgttcctaatctatacccttatagtatatctattcttcacctccatcccatctagccagggccgtctccagtattttggggcctcggggtgaaatgcaaagtggggccctataatttaagaaatcatgtctaatataaataaaacatattttcactcaattatatagatgcaatatgtgttctaatattatgaatttacgatatatcatttactaga

SEQ ID NO: 18224 - DNA, 426 bp, Oryza sativa
gcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattgtagtcttagcatgtaatattagttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagacagatgtttcttgtatcaacaga

SEQ ID NO: 18225 - DNA, 549 bp, Oryza sativa
ccatgagattcatagttgcattacttatagcttccttattcgtagacaaagcggattcggaattgtctttccttccaaggataacttgtatccatgcgcttcagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttcca

SEQ ID NO: 18226 - DNA, 184 bp, Oryza sativa
ccaagaacaaggacccgggatacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggacta

SEQ ID NO: 18227 - DNA, 543 bp, Oryza sativa
tttccatcgacataattttctggggagatgtgcatcaaaacaataaaattctaataataaagtgtgaattacgtcacacatcgccaccaccgcctaatgtctcaaagtttttcatctactcataccagtttacgataagttaaaatttaactcacattccttgtcatgagaaacaacacacatccataaaaaaagaatctacaaaataactgtgttatttttcatcatagatcatcgtctaccagtaaatttttaactacataaccaccaacccgtaatttaagttaatgacgactcattcatatagccggaacataggtaaaattttaactcaacgacgaaatcaccgcagcgcataactcaacatagtattagttaaaatttaacttcacattcagctttgtttggtcctgcgggcgagggttcgttgcttcacgttttccgcgagttattttttaactccatggtctgttggtttggtttggtgggcagtcttttctcactggtggagaaaccctttgtagtcccggttcgtaacccccc

SEQ ID NO: 18228 - DNA, 1501 bp, Oryza sativa
agtaggttaatttgagtacttcgggacgctacagtcctacctaaaaacgaaggatgatatgcatatgccgacatgtcgtctacctcaaaagggaaattaaaaaaaacgatggaaatgtttcgctaattaattaattaactcacgtcaccaagctcgcaaccaatgctcgtacagctcccaacaagtcgcgctaattatagcgttcgtctcggttgttccttgtgacgcaccaatcgccattaatggctgaccaagaactcgtacaccatacgcgtcatctcatctcatctcatctctacacgtaagaatgcttggatatggtcgtaccttcgctggcgccgccgctgccgcctcgccgccgcggtgaccctgtcgccggtgaccatcgtcgtcctcggcagcggtggcgatcgtggcgcggctcatcgtggcgttccgcttcgacacgaactgcttcagcacatctgcagatgatcatcgccattgatccgtcatccgtgtgagtatcaagctcgccggcggcgggagacgcatgcaagaagaggctgtagtgtagacgcaccttcgaaggtgacgaggcggtagacgccgccgagcactagcgtgtcgtcgggccggagcagcttcagccgccgcctcgccgcaggcgccgacgccgtcgccgccgtcgccgccggcgcggtggcaacgggacgaacgacctcggcgacgtagtggccggggttggcggccatcacggcggccgcggagaccgcgccatacgcgcgctcgacgcggccgccgccgccgcctcctccgttcccggacgacgacgacgacgacgacgacgacgacgggtgctgtataacgacggccgccgcgtcggccgcctggcagttccccatctcaacaactacctccgccgccggcagaagcgagcaaggtcgtcgtcggcggcggcggcgagcgatcgagcgaggcgtggtggggggcggctgagttaatggaaggtggaggtgatcgatggcgcgaggtttggtttggttcggtggtggtcgacggcgacgatggccgacgtgcgcagcttttaattggtgtgggggcacgtgtgccgaggcgcggtgatgaactcgtcgcgaatcggcttacgtgggggcgctttgctcggtctgctcggcttactacaggccacatgtgtcagtataaaatgtggtctcgtgttttgttaattgggataataacattaatgtcagtatacaatattgtatatttcgttttcactaataattaaaatgtacagcgttagcgactgttttaatggattatatttttgttgttctgaaaaaatcaactgtggcacatgccccagttgcccacgcttttttgggtattaggctaccaaacatctccaaagtttgtcaaaaatattactagtatagtgtcagtgaaccaattaactaatattccgaaagttttaccgctaaatgtgatctgcactaccccagttcggaaccatattttg

SEQ ID NO: 18229 - DNA, 943 bp, Oryza sativa
atatatatatatatatatatatatatatatatatatatatatatatatatataaagtgcctgtaatatcatgaatcgtcatatattcaaatggtacgatgtaccagttgtgaattaatgatgaagtatatattaattacaattcggtatccatcggctaataggttaagttgttattaatcccatgacagatcgagttgttgtatgcttgctttaatatttttatccaagattagtttagcccctccaagtacaaagtacagagcaacgatactaccctttaacaacggaaattatatagtagaaacataaaaactactaccataagataaaaatacacgtctgagattaatttgtccacatgaccatgagtaaaattaaagttttactaggggtaaagttttacatatggtgaggtggacaaatatcatatgttcatttttatcatatagccggtagtttatacgtttccagtacatattttcgtactttgtagtagggataattttttttagatcggtatgcaggcatgttaattcgagaggggtgtgacttatcaatcttcttccgttgctcatttgcgatctattaggttaattatataattgtttgagtttttttcatgcatgggaaactacggtaaatatcatcattttcctttttcttgataatatgccaaataaactttttcttatttataaacaaaattttccataatgtctatctcctaattattggaggtggactctgagggcagatataccaacacatattcaagccctacataggaccaactggacgtcgttttggcttagacagtacaacacaaatcttggaggaattatcttttagatcatgacaggtttcaacaatatcaaagtgtctcacggatttggaccctactagcttgcagggtaaaataagactaaatttcatcatatagg

SEQ ID NO: 18230 - DNA, 1501 bp, Oryza sativa
aaaatctaattgtatcaaaaagcaagttggcttaccagcaaggtgttgtacataatcgaaatcgactgcaccaaattcatttagtggcaagttcaaatcaaaaccagttaaaaaaaaaggaaaacaatgatatgagaaacgatagagaagaagagatagtacagttgccgtacaaacatgcacgagagaagaaaaatcctgtcaaacagagaagaaaagtaccattgccgtgctccaacggaggctcgttcagatcaaaggcaaactcgccatcgccatcttcggccatgtgtactgcaatagtgagagaaagctagctagaagcctagaactagaagatgagatggctcagtactccaaacgtgaaagcaagttagcgtatatacgggcaagcagtaacccaagcgtcggcattctcagcacgcgcgcgcgaaaaacttaccacggcataggcgcgcgaatagcggtaacgagcgccaggcaaaaaaatttaagcatcacgcgcggcagtgaacccaaactaaaaaagcaaaacaaaaaacgcgcctaaacgccacctgcatgagcgccatgcagtcaaccaagtatccaagcccgcctaaatcagtgccatgcaaaaccaagcaaccagctcgccaggattcgaacctgggtcctgcggaatccagcctcggcgcactagccacttgagtaaagtgtttttctcatatggaaggctacgcgcaaccgtatttaataggggtagacagggaaaaatacctataattaatcacttcttggtatgctaaatgctgtcctaaacgtcattttttactagtatggagggagtatggttgtgaacttgtgattcctcttaacatcagtgagggcctgcatatttaaacaaaatatggttccgaactggggtagtgcagatcacatttagcggtaaaactttcggaatattagttaattggttcactgacactatactagtaatatttttgacaaactttggagatgtttggtagcctaatacccaaaaaagcgtgggcaactggggcatgtgccacagttgattttttcagaacaacaaaaatataatccattaaaacagtcgctaacgctgtacattttaattattagtgaaaacgaaatatacaatattgtatactgacattaatgttattatcccaattaacaaaacacgagaccacattttatactgacacatgtggcctgtagtaagccgagcagaccgagcaaagcgcccccacgtaagccgattcgcgacgagttcatcaccgcgcctcggcacacgtgcccccacaccaattaaaagctgcgcacgtcggccatcgtcgccgtcgaccaccaccgaaccaaaccaaacctcgcgccatcgatcacctccaccttccattaactcagccgccccccaccacgcctcgctcgatcgctcgccgccgccgccgacgacgaccttgctcgcttctgccggcggcggaggtagttgttgaga

SEQ ID NO: 18231 - DNA, 373 bp, Oryza sativa
aaaaccagagtaggaaatcggatgaaccagggtgctgaaccaaattggaccatccattcatgaataaacaactcagccaaaccggatcagatagagagaataacacatgaggattggaggcatcagatccacgacaaatggaacaataattaggtgctcaaataccatgattatctgcagttttttaacaagcacataaacatgccactacttgaacccaaattgtgtccgtatcattttcgatcttcttcaatttgggtatacaataactgatgggtgtacactttaaacttgtagtaaaggaacagaacaaagacatgccattgaggataccaataactcagtaaaatatatcagtttgatcgtgtgtagg

SEQ ID NO: 18232 - DNA, 569 bp, Oryza sativa
gcttgcttaaggatttgatatatctataatatcatatatgctgttgcttgtgttcatttttatgtaattctgtattgttgtggctggtggtagtaacttttggttaattcggctaaaaccgaaaccaaaattaaaaaaccgaaaccgaattttgcggttttcagttttttggagaaccgatcgggtggtgaagcctgtaaaccgaattttatagcaaccgaataaaccgaaccgaattgtcggtttaaaccgaacgcccaggttgagtctgttttcaactcagaatccataatatttctcaggatttcactttgctgcgatggagttctcttgtagaaccacttagcatctcccagatagtagagcacacgttttcttaagccctttgcatctagatccccagtaactagctgcagcaatacgatgcccaaagctgctacatatccaactgaatcttgcaaggctcagtgataagccgtccaaattctttcgaatacagataacacattccgagatcactgagtaagcacgcatttcctggcctgaagatgatgttgcttggtttcagg

SEQ ID NO: 18233 - DNA, 605 bp, Oryza sativa
tgcaacaaccggggaaactgccttccctgcaatgtgcgatttctgatgcccagtagtcaatctgaggctattggcacttatgatatcagtgcttattttactagccttttaccgtttcttggtgctgcttatctgaattttgtgtggaattgtgaattgtgatggctgaaatgatattctatgtgaaaagaaattactcgatggatgtctgttcaaaacttaaaccgctactaggaatgcttaaacatgtgaatagaggtagtaatatagtctgataatgacaatgatgattagataatgagcaaagcaagggggtaaagagaaaatccgtaaaagaacaattgaatttattaactatctatactaatggacaacaattcttgattgaatttaattaacggataacgatatttggtagataatcgatttttttttcttcttctccaagaagcaaacaaacatgattgataacagaatggtcctttccatttttttttccatattaaaacaacataaattgtcgtcctcatctccaattctccacagctcgtaaacccccaaaaccctgactaaaaccttcgtcatccgccgctgcaccgtcgcca

SEQ ID NO: 18234 - DNA, 1501 bp, Oryza sativa
ctaagaaaggaaccacattcggatgactgatatttctgaggatttcaatctgcattttcagaactagtgtgagaaatgaagcaatacacagtggttctatcttgcattttcagaggtactgttagaaatcaacagggtgtataatgtattaatggtgtcattggttttctatactttggaatgcaaaacttcagtcgcttttggtggtgtttgatgaacttatgtttgaacatagtgcagagaaagttatgtgttcaacgaaacttaccgcttgatgaaactcttgcatcaaaatccattctggtagtgttcctttgggaacagttgtagcaatatccattccatcaaaatctgaccgatacacattatatgtagctgttccacggagccacttcgctcgtttgctgactgcagcatctatttctgaaggtttgaacacaatgaacttatttccgccacttgagcgagaagctttgttcttgttcgcctgttcaaggtattgctgcaaggaccatgttagaacaaggaacattgatgaacaattgaacatcattttctttcttaatattgccgactgatagtgtctgatgcatgagcaaggtatattacaatgtaacatcatcgtttgaagagcaatacttacttgtgcagcagtgactacacaaacgacaatgattgtaacaatcgccaaggtgaccatgacagcaccaagaaggatgaaggtcgcaacagcactgatggcgccaacaacgacgacaacaatgccaacagcaacgtccataggcttttcctctgcttgctgatgaggattcttttgaaccttcgctttctcccttgtcaccaaccatgatcgtagatttcagcaaacatggccaaacgaagtgttcaagtgaaacaagaatgaaagagtccagattggcaccatcttgtgccggttctttaaaaaaaaaaaacattctccagattcaccttacctttttactggttgagcagctgcaggattttggtggcctcctcctccaaccatggctggtaaacaggttgcaaacgcttgatctctgcagattttagattgagtaactggatagcaggtcaatcaaatgactgcaggtatgagatgaaaagtaactggttatgagcgagcaatgctggtgttgccggtcgctggttatatatatgccatgggcagaagccagaaccagaaggttgtccgtgataaacaacaggcgctgccaaagcagcttgactgatgggaggtacgaggtctttttgttcgtgtttctgcagtggtatacggcacattcttcaggttgaagttgatcaatgcagcatgctgtttcacttttaaattagtttttgtagtgggtgatggaaggcatacacgtcaggagtctcctgtgcattgctttccgtcaacttgatctgtgtctttggttataatactggggctaaacgcgtgagatgatttggatgttggagtggttatctggtagaatagtca

SEQ ID NO: 18235 - DNA, 1501 bp, Oryza sativa
cctagtgctcttgccttgggttgccatgccactattcatcaagacaaaaaaggtcatctcgagcaattcataagagttaaacattacgagatgctctcaagggttcagcaacaagtcaaaacacggacactaactactatcaaccagagcatatcacaacaaaatatacagctgaatacactgcttttgacatcaaaacaaaggaattatagatataatagaacagtagagggataagacttttcttagaagtttaacaagtagagtatagtgaaaagagaaaagggcattaagaaaatatctcaggacctagtgtatggattgacatgtatgagttatcctgcgttcccctgaggccattttcacatcaaaataaacacagagttcacagtccataacctatcaggcaaagcgatagccatattcatgtatgaaatatggctgcaccattgggcatagaagaattttagttgacctcaatgtcttgtgcaaatgtatttacaaaagtctattggttcagcaaaagaacagatgagttcctacaaattttgcaattacttaagcttcagctatggagcaatggaaatcagcacagaagagaaaccagcccattaattttgttcgcataagggttgttgaaagaagcaatgtgtatctagcaaaaatcccattcagctctaattacatgaatcaccaatagcagcatataatcaagtacaaatcacgtataacaatgccataaatttaataactttacagcaaatcaaataaatactcagagcaggatataaaggccataatagcttagcgaactaattggattgtactataacacatggttgctggaatacatctctttttctcttcccattaggaggggacagccctcgtttttacttccattaaaacagaacaaatcatattgaaccactcacaagaagatcaacatgacaagatgctcaatgcttcagcaacttaactaaaagggcatactggaactaaatatgcaccgatagtatcatagtaaagatcaagtattgcgattaacaagaagcacatcacacccaaccaaagactaatatcagtctttaaacataaggaattagatgtaactggacagcacagagaaaaccttacactttgcgttttaagcagcatactgaagagaaaatggtatctacgacaatatttggggacctagtgtgttggatcgcttgatacaattgataatatgtctcccagggtctatttttcatcacaggaatgcgctttacataacctaccacgcaacgcaactgctgggattttagggattatgggaacagtcagcataactaaattagcaaggaactcaaagtcaaagcacatcaacgatgctgtcctccaaacccaagtgccccctaacacctaccacaagcgatccccgaccagatcctggccgaggacgggcggcgcaggttcgcgcggcgaggggctggccggagaagacgaaccccggcga

SEQ ID NO: 18236 - DNA, 351 bp, Oryza sativa
cattaagtttcatccagcccagcctcggcttctcccagtgcaaacgggtcgatgcagtaggaggaccatctggtcctcttcttctaagtgcacttataacagatctgctaacaacagttttacctttttccagatcagcgtgggggtattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcacca

SEQ ID NO: 18237 - DNA, 588 bp, Oryza sativa
ccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggcggcggcggc

SEQ ID NO: 18238 - DNA, 1501 bp, Oryza sativa
ccaaactccggcagagggccgacgaattaggatcccggggtggggtgggggtgggagggggaagagaggggagttcgtcggctttagagggatggccgtgggaggcggcagtccggcggtgggcggcggatcgggcaggtggcgaggcggcggcggcggcgccgaagccgcggggtcgggagcgggcggcgggccggttgaggcgacgggggcaaagctgaaagagtggtaggaggaggtagccggtgatggcgccccgccgccggcgacggggaagacgacatacagcgcaccgccgccggcttgaggcaaaggaggggaggggaagggggccagccggcggggcctcgccggcgtcgttgacacttttcggccagccggcgaggccgggtgacggaacagtgaggcggcggcggcagtgaaggaggcgcgcggtgctgagaggaggggaggagcgcttgagcgttgtgcggcggcagggaggaaaaaggaaaaggtggttagggtttggtggggtttgcacgaatctcaaatcaatccaatgaacaaaaatttgcaagatattaggaggggttttctgtcgaggagtagacagtcccttaattttattggttccgtttcgttacatttagagcttaaggtgagtctgaactgaaaactgaagtgaacttttattttgtttagaagatataaactatttattttatgactatgtaagtaagtagaggtacatttttctactagtatttcatatactccctctgtttcaaaataagtacaatcataagtttccgtatactagtatttttttttagtaagtatttttttatattagattataaaatatgaatagaactttatgcatgatttatgtttttagatttttttttctaaaaaattaaataagatggacgattaaagttgtgcacagaaactcatggtagcacttattttctagatagagggagtatctgtctgtgctagaactacgcatctccaaactttaaaaacatttccttataaaccatggaagacgtcgctggctacgcttcggatcatcgccggtagccggagcagccgccgccgtcgtgtccatgctcgtgtcgtcgacgcgccatccccacgccttgtcctcacagaggagcctcaacctctcccagtccaagccgtatttacgcgctgccgcgatcagctgcggcgccatggccggcacctctcgcggggccatcgtctccggcagcgtgtcggtgtacacgaagtgaagcagagccttgaacgcagcggcgtccatgtcgccgacgtcgatgtgcctcccgacgagtcccatgaagcaggaggcgccgccgcgacgacgacagagcttggccagctccggtgcccgtcgctcgagcacccgcctatgcgcggcgatcgtctcgccgccggcggccctgaacgcgacgtccgcgtcgtccccggtgtcgagcaggcatctgaacatgtcgtgctccaccgggcagag

SEQ ID NO: 18239 - DNA, 859 bp, Oryza sativa
cgatgcggggagggagaaaagaaagagggcagctagggaggaaacggccggcgtgactctggaatcgttccgcttctcttttctgtttcccaatcgtatcatttcaagatggacggccagatttgatcttgtacctcccggtactagtaccgtctggtacaggctgccggacgccgacgggagtaaaactcttagatcattattactctctccatcccataaaaaccaacctagtactattacgaatctggacatacatatgtagattcatcgtactagaatatatcagtactgatttgttttttatgggacggagggagtacatgtttagagttctgagtgaggaggagaaaagatctttctaggaagaaattacaactctatcatcgagcttaatacgttccgcccaaagagtcacatttttaatgcaattcgtcaacaatctatgaagagacagagcttcatttcttaaaaccactccatgcctgtgattccaaagattccaaaagcagaggaggtaaaagacctggaaatgctttgggggaatgtgaactggtggtagaagggcagccaggtctctcgtcgtcgaaatgtggactgcgattggtggctaatatgttccacatttctctatccccgtcttgatcttttggctaatacttctttgatcttttggttaatacttccattttgtcgtctttccctatcaccatctttccacctttttctattaattgtccctattgggggacatagctagtgtgtggatcgcttgatacatcccagggtctatttttcatcacaggaatgcgctttacataacctagctaccacgcaacgcaactgctggttttttagg

SEQ ID NO: 18240 - DNA, 280 bp, Oryza sativa
ccatcaacttcgttcaccatcaaatttcgtctaaaacccaaaacgttcaccatcaacttggacaggacctgtttacttagaccacagaggatgcatttgatcactgaggatctcaggatatgtttactctgatgctattttcaaccttaccaaattttggtaaagttactaaaaaatggttatatttagtttgctgccaaattttggtaactatataagaaatcctgccaaaattttggcaactgtaccaaaattttgataatgccaaaatttgataaga

SEQ ID NO: 18241 - DNA, 346 bp, Oryza sativa
cctgcagcccctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctcctccccttccgcgtcctcgccgctgccgcggggtcccacttctccccctgcggtctcccgcctcgcgggccgcctccgcctctccccgtcca

SEQ ID NO: 18242 - DNA, 1501 bp, Oryza sativa
tcatataatgtttcaatgtatatctttattatgttttatgatatcttatatatttatatagttcatcctcacttagttagtgcttaaatgattaatctatggtctaaattatctttttctttttttcctctaattaagttatatcacattaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatatgtatatatatatatgtatatatgtatatatatatatatgtatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatctgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggcc

SEQ ID NO: 18243 - DNA, 1501 bp, Oryza sativa
gtttcagccaataaataattccgttgacaaatataatttaaaaacttcagaattttcccttttaagattgaaatctattcaaatttgacattgtgaggcacttcaatcatttaacatttgctatgcctactacagctatctggccacttttagagcatatgtccaatttacgtgattgataaaacgtgtcgctgaacatctaataacaagactccagaccaagtacaactcacaattatttatttcaaatattagagttaataaattaagtaaaatattgaattaagactccaacatgagtacaaatagctgtagtggttctgaaaatcatataaatatctttattttgaaatttgtaattactaaatcaatgagatattcagactccaaaccaagtacaattcaacattattaaatataaattttggaattaattagtaaatcatgaataaattgtagcccatcaccactcaccgaatacaacactatattattttagtttagaatgagtaaatcatgaaaagagctatacgggaggcttattaattccgaattattaaattaaattcttgcatatactcgggggtataaatataaaccccatagaattgcaatagaggacgaacaatccaatacaacttcggcacatcgccacccttttacttttcttgtttcggtgagttctatccacaagaggtaatctgtctcgatggcttgtgctattagggctattatatcgctttagatattttagtccttgtatcatgaccattgatatcatatgtcttagttaatctagctttactatctcgatttagctctatcagttgtctctcgctttagggtttctgccggtatcggctaaatcgtcttgctagattagattagctaaggcatctaccatcttgaaaggtgtttaattccttaattgtttagactctaagcttcttttcatactttgagctgcatcatccctagtcgtgtatatttgtcatccatatagacagatcaccttataggaatatatcaagtctaggttatatcggctgggctatcaatttgacaattgatccctacttgatatattactatagattgatttgcatatataggtttgtactagagtattagctggtacgctatctttatctatcttttctgctctaaatacggtttcattggctattttcgtaatattgtcttgaacttctttattaaacttgattagcaatgttacagccgatgaggcatgtttagggttttatattctttgatctatctagtctatagccaatttggtctacatcggctgagaccaccattaatatgctatcggcctatcggccgatcggctatcggctgactaatcatgctttattgtttccttgctggttgcaggatcaaaccagctggtacgcccttagcacactcgaggcaaacctttgacctgcactggagttaagcagtttccccaggttgtcgtgttttccgtcaacacaac

SEQ ID NO: 18244 - DNA, 1501 bp, Oryza sativa
cacagtgtgagaagagtgcccagatgatggtgataaactccatgttggacctgagatgcttggcatgcacttgtgcatcgcagctaggtgaaagatgcacaagcaagagagcccacaccttggctatgatctcccattgattcattttgtattcatagtggagattgtagtctatcagtgcactgtctctcgacataagatgcacctcttcttaagggaatcggacgtccagccttgtccaactgggatggtattgtcgcgatgagcttgtcatagatgctcttgagtgaggtacaaccatggagcatctgacgagcacactgaattgtttgttggaagtccttcttgataacccaaatgctcccgggcagcaggtcaggctttgcgaccagcaggtacgcacagtaccgcgacaaccaattcgctaccatgtaggtctcccataggtcaccatccagcaacttatccacaaggtatcctctgtaaggattgcgcctacggcgatagcatgacaaggcagagtgcaggaatccagggctgccattgcaatgatcatgttcttgggcaagcttgatctcacataagcttgttgcaatgtgccagatcagaataacatgggagcatctgggtgccccactttggatgatctcggaccagtactgctcctccgcttctgctggtttgttggcgtcgtgctgcactgttgcaaagaagtctcttggtagggaatggttgtcgtcgacgctgctagaaaaatcgtggtgtagatctagtccttggagttcttgagagagtacggtagtacgtactttctcaggcgtagtcagggaggtggcaaagtttgtgccatcgtccttacttgcgatcattcccatagtaagtgagtgcaacagcctacgcttccacgcactgtatttgtatgattgcaggaaggcatactggcctctacatccaccacttctcacctcttgcgaatttattaacttatcaagagggcctctaaatgcaccacctctcacctcttgcgaatttaacctaccaagaaaccacctaacaagcctcaatctctttctcctgtttctgcaatgaaccaaccagcacacagcagacaagctcgtccagtttacaaagttgatgcccattccataatcatccacatttactacgatgaggatggcagccccagcgatgttcagatcggtagcagataaattatgcctgttttgggacaggtgccttgctgcccaaaagagatcactggaaagccataagcccacaggtaacttgatcataagctgcgcaaaagcaaacctgagtgagagaaacccttccgagaagatcatcgggtaattgctgaagaggcagtccttgaaaaacttaacatccctatacaggactttgaatagtcggtcgagacgttccttataactgccaatcagtagcttccggttaatggaatctatgcctgcatgtaatcttgctccttccagcctacaccgta

SEQ ID NO: 18245 - DNA, 880 bp, Oryza sativa
ggattcaaatccccaaacaggagtaaggtattacctctcattgagagggcctgaacctgtctaaatccttgtctctgcatccatccacttttaggtctcgtgcactaccccttttattattgccgaattcatgtttcgacagttggcgcgctaggtaggggtgcgtcgagtttcccgtcgaaaagtgtgatggaatcaatttctccggtatcatatttgttcaagcagcctagattctaccgctgctggcatcatcttctgatcaaatcaatctacgaagagatattgggtttgtcgttccaatttaactctcaatagattaatttttaattatagattgatctacgtactcgggtattatttttgttaccagtgtcgtcgtcgttgccgagcaacaatatcagcctcctcccagtgcaaatccgagcccacacagtgcgagttcggatctacgcctacaccgggaaccactcggcgaccacgtgacatgctaaagctcgtaggcctggatcggttgctgccttgctgctacctgcaactcagtacacaggagatttggccatgctgcatgccgagcgagaaagcacatgcctgcatgttgccttttgcatgtcacctgatgattgttctcgccgggattcgtgccgtatattggcctgagtgcacatctcctgaccgtttcataattttccatatttagattgatttctaatctcaaattaatctctcgttgtttttttttgttgttgttcgcatataattacgcggcactattgaggcgattaatgctggtcatggactcgaggcgtctcagctttccggtcgatcagccgcgagtccattccgccggcttgtcgtcgccaccgccattgctgatagc

SEQ ID NO: 18246 - DNA, 1501 bp, Oryza sativa
ttaaagtagtgtgcgcatggcgtatgcccaatactttaaaaaattctttattcacgtcatacaaggttctttatagctatttttgctatgtgaatttttaatgatgtagtcaactttatgttgtacacatcatgttttacaaagcagtcggtatatcacttggattatattattcggggattcacaatgcacatgctatatattaatatcaagtcgcttggttgactacaattatcgaaaccactttgttggttggattatttattccttaactgtatgcttggtttgttcaattaaccacattgtcgggggcgacacctattaggtgcatctggtcgatgcacctgactttatttttcagccctccacaatcttcagatttggtaaaagtactcgggagaccatggcaaagatgattgaagcactcggctttggagtaatctaattcgagagaagattatcttttcgactgtgaaggtctcaggggctactgtggagattatggataccccatacccacacggcaaggttatccgactagtcataggggatagcttatatctatggaatatgtaacagatcatgacttgggtattacgtttccttttatattatggagcggcctaaagtcctgatttgataatattgtaaaatagatttaggaaaccgataccgtcttggttaaggtttctatcttgtaatcctgccccccatcctatataaggtgggcaggaggccctctagggggcatgagcacaactagatcgtcagatctatactacactcggcggattcaaatccccaaacaggaatagggtattatctctcattgagagggcctgaacctgtctaaatccttgtctctgcatccatccacttttaggtctcgtgcgctaccccttttattattgccgaatttatgtttcgacaaatagtttattataaattggattttatttcatgaaaataatatcatccgattctcatttaaatttactttcatatgattttcattttgttgctataaacattgtagtatataaaaaattataagtcaaagaaagtcttaaagatcgtgccaagtttgaccgcgtcttagtgagtgggatgaagggagtaataaattagtaaataataattagtcaacttgaaaattttaaatttatagttgaaagtttcaaaatttgtaattgaaagttttgaattttagaattgaaagtttcaaaatttgagttgaaggtacaaaaatctatccacaaataacttcaaaataaaaattttaattaacatcaaattcgcaaaatggaaaaaatattttgaataaatagttgcctactaattggcccacaaagagctggcccaagaaagcaacaacgtgctgctgtgcctgtgctagcccacacgcacgcaatgttgacatagtgcgcggaataagtctattttgcctctctcatctattacccctgattgaagcgcatccttcaactacaaaatggctccc

SEQ ID NO: 18247 - DNA, 434 bp, Oryza sativa
caactccactccagacccaactcttggagctaaatttaggagttagagctgtaccaaacaggccctaaatactccctctattctaaaatataagaatttgtatatgatttacaaaatatattagacatcatatgaatagatacatcttgaaaagcgtaaaaaatcattatagcttgaaacagagaagatataaccaagcatattccaaaattagacggattaaccaagccagggacggaaacaagcatggggcaactatggcctgagccccatacctaacttcataatccccattataatcttaattaaaaaatacaatgtaatttgtagaaatatctaagtttttattagcttaattttaggtgtgaagattttctggctccgccactcaaccaaggcaatgttttattgtggaatttcaatttgtgttgtgc

SEQ ID NO: 18248 - DNA, 242 bp, Oryza sativa
agttttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 18249 - DNA, 227 bp, Oryza sativa
gtcgtcaaggattgcctgtggaatggaatcgcccgctgcgggagtcaagtcttcaggcttagctcgcttttatctttttccgctgcatttgtaatcttttgtatttttgtaagatgtggatctgtatgtcaacaattgtcgtttgtgtaccctggctggtcctggacaggggtttaatacacattcagcttagagattctggttcgtgaatttctgggcgtgacatc

SEQ ID NO: 18250 - DNA, 1501 bp, Oryza sativa
cgcaacttatttctcggagaaggcagctgctgcaaactttacaaacaagaagtacagacgcttgcagtattcatcagaaatgttaagggcattggacagccatgcacaattaccagaacacgggctatttttctagaccagcttcaggaaagctgtgccattgttaacccaaatttcaagcaaggtctgcagggaacttgtgctgcaaaccgaagtgccacgtgataatctgcacacaaatccattggtgcatttttccatcaaatattgaaaaagaaaggatggaaagagaccactaacaattgcatgaacttaagtacaaaaatattgcacatgtaagcagggtttgtttccgaaattgtgtttttgccgctagggaccgaaacaaccgaaatcaccgaaatttcagtaattttagaattttttgtccaattttttttgaatttataacatattttgactgaatttgaacaaattttgaccaaatttacaaatgtttggcaaaaaccgaaaatttcagggagattttgacctttccggtgggtgctgaaattaccgaaatttcaaatcccgcatgtaaggtttaccaccttttgcctttctaaattagtaggaagaaaatcacagcactttctcagaagataaaatggcagagaaaacaaaaggatggatgccatattctgatatataggttcaagctttcatcatctcctccctctgcgaactgaacaaagcacggctgataataccacagttgactcacttccactgaggcttgttcctggtttagtgacacactttgccgccaggaagatcttggtggtgacactcagcaagctgtagcggcatccactgtcagagccataaaattttccaagcctgggtaagtctattgatgcatggacttcttgaaattttagcaagagctagctagatagtgttgttcggttcttccaaaaatacagctgaagttagagcacagaaaattaaaaagccgttagcgcattactaattaagttttaattattacaaacttgaaagaaaaatagatttatccatatcataaatcaacttttgtgtagaaggttgaaaaatgtgctaacgaaaatcgagataaaatatgtatgttaatcagaaaagagcggggcaaataagctgggaagatccaactccaatgcaaatcacttcattaagattcatctcttacgtcctgcttgtcttagtactcggctcctgctagtacaccatttgcttttgcctgcctaattaagtagccaagcacccaattaagctagctaccacgtactgcactatgaaccatgcgtgtgacgtgctcatatcatgtgctactgcctagttgcacgcgcgtcctgctagctaggtgcctgctaattaagctcgttgctcaaccatcagaagcacgcagatgtgactgacactgagactcaatccgtgacagcgcgagtcgctcgcggcatccgcgtcggcgtcgccggctcgc

SEQ ID NO: 18251 - DNA, 1501 bp, Oryza sativa
atgatatcatattcatgttggtcatttcatctccatgctgactgcatcagttactatcaatggacaaatgtgactacaacagaaggataagttacatgcttaggggctcatcagcacaagcacgaggattatattttcaatttggacttcttccggatacattcaacatgaattcatgatcatgggtctattttctatgctcaaagactggactatttattattccccgtaagggttattaactaaatacttgcgtcagtcgggatttaattattatatctattttggagtataccataagggataatcacttagatcataagctattcagatgagctacacttggtctacattacccggaagatttattactcgggagcatgttacatgcgtcatcctttaaagggtgtcctaggcctaatatgtctgtagcccatattttcaggtgtggcctgtcacgttcttttagggacttaggcactttttgcttagaccaaagtgcgcgtgatcaagtgcccaataccttaaaatccttttataccgcagttactcaactttttaggagttggtacaatgcatcttaaaaggtgtcaaacagtaaagctatatagctatcccgctgacttttttatataagtcaaggtgctgtttgggttttcaagcaattgattggatataatatcgttgctttttgccacgtaagtgtgcatttttattgaccaatattatggcttaggctgattatatatcttggtcattttccaggcggttggtaaatcctttatgagtttatttactcggattttacaccacatatgccgtatatttccgggtatggtgaaaccatgtgtcttttagggatttaagcacatctgttaaagcagtgtgcgcatggcgtatgctcaatactttagaaatttctttattcacggcattcaaacttttttatagctgttttgctatgtgaattttcaatgatgtagtcaactttaggttgcacgcatcaatttttacaaagcagtcggtatatcacttggatcatgttattttggggattcacaccgcatatgctatatattaatatcaagtcacttggttgactatatttaaattattcatcagccctccacagtctttagatttggtaaaaagtactcgggagatcatggcgaagatgattgaagcactcggctttggagtaatctagttcgagagaagattatctttttgactgtgaaggtctcaggggctactgtggagattatgggtatcccatacccacacggcatggttatccgactagtcatagggatagcttatatctatggaatatgtaacagatcatgacttgggtattacgtttccatgtatattatggaacggcctaaagtcctggtttgataatagatttaggaaaccgataccgtattggttaaggtttctatcttataatcctgccccccatcctatataaggtgggcaggaggccctctagggggca

SEQ ID NO: 18252 - DNA, 1501 bp, Oryza sativa
ggtgagtaccgttgggttcgtctcgtcgtcctctacgcgtaggtgttctccaaaatcccggccgaccaccctagctccggcgaggtcgccaatccgagccggccacctttgatgatgtcatcatgacatcatcggtttttctttttcccgtttttctaatagattaaatcttcggaaaatcataactaaataactgtagatccgattcgagtggttcaagttgctaaatttttctaaaatcaagatctacatgttaaaaatatccacatgtactgtttatgcttgtttttgtactgttttgttgatttttattcttttgctttagtttccgacgttctgaaggagagcgttttcattgagcaaggttcggaagtgtttgcggaaactcaaggcaagtcacacagatcccaaacaaccctttgagcatgttgaacccgtttaaagctattattttatttcaactatgcattattttttaatgtcatcgggtggtgaacctttccccgttaattaatggccgaagatgatcttattttcctatgggttataatttgattagcatgaaccttatatgttggattggttcagctaaatgctatatgtaagtttgcttagccatgcttagaaacattagctaactaaagggattaattagaaactatgttacattattattttaattatggttatatttaatggtagctcacgatgattaatcgtgtgatgttaattaattgataattaaaacctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatgccttgttttataagggggtgattatcatccaggaatggtgcactgtagtgagttgtgttgtgcgaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtttcacactactcatcaatgttaataaggtgagaattaatttgactcctggtttggaggtttgatctgtacgaccggggttggttgttcaggtttggttgggcctgagcagcatgggtgtgctgttcagtgttgattaaaattgatgattaattactctactgttttacttatcttaaatctttgctaaatgctgcttttgcaaatgagcctatattatgccatcctttggtatccttgtgcacttgtatatttgctgtgtggcttgttgagtatgtcatatgctcattcttgcaataatcatcaa

SEQ ID NO: 18253 - DNA, 1501 bp, Oryza sativa
gccctggcaacagcctgccggtcagaatgccttcagctcggtcacaccaacatcggctctcatcggcttagtcttgataggccaaggccacacaaaagacacggcagccacctggtcagaccgaactgagcacagtcacaccggttggacatgccggccagaccggccggtggccctcggttagaccggtgacggcactggcgcctcggtcttgcgagaccgaggccacaccattcggtatagccaccgctcgttcacaccggccctggtccgatcagaccggccagtcacgcacggtcaaaccggcatgtggcacatggtcagaccggccacagagagggagaaaagaaatatgtagtcgaaccaagtgacaatacatatgatctaatgtggcattttgatcatctttttgcttaggttattacctctcttaatagtatgaccaagcttagaaataaacctagcaaaatttgatcgctcaacgtctcgatcaatttaaaataaaacgctagattcaccgtcttggttccatttctttgcgccattaattttaatccttggtgatcatccatggcatatgcatcatgtagtcctaactcaaaatgcataactcaaatagaatagttagtccataattagcgcttatcattaattatcaaaattaacaacgcgagcatagatgcttcagctggacccctttgtatcctcctcagtgaaggcgagtgcacggttgaatagggtgccgagggggctagatccaggttcggccaaaccaaacatcgtggccaccacccgaccccttgtcgcgcttgaccagaggcaagatcgctaggggttccagtatctgtggttcgcaatattcaagcattaagaccaatagattggtgggttcgatctcctctcgaggcggaaagtggagttggaatcggagagggagatcaagaccttcctgtcacaccctgattttcgtttcaggatttataaattatttaataaattattatcagaatttatattcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagcagttcagcaattatttaaatattaaattaatcattaaatggtctgattataatttttttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttttcctctctttcctgaagtctgttttgcgtacctcctttaatcagtgcttggaagtagaagcccagc

SEQ ID NO: 18254 - DNA, 244 bp, Oryza sativa
tctcattgagatacatggatatgtgcttgttgttgtatgtaggtggatgcataggtttccaaaaatcagtttgtcctggagtgcgtgtgcgtaggtaggttcctttgtgctagacatgtgcggagcaagaagggcggcatcaacgctggcagtggtaccatgccgttaattccactggctgttagcatttgcggatggcatggacacggtgccgatgttgattttcatgattgattaggagaca

SEQ ID NO: 18255 - DNA, 1501 bp, Oryza sativa
tgtatcccttctgtaactgttcatcgacttgcttcttgacttccgccaactcgttggctcccattctgtaaggcctcttgtggatcggtgcagttccaggtaccaagtcaatccggaactcgatatccctctttggtggcattgttgtcagatcgtccggaaaaacctctggatactctctgactatgggaatatcctccagcttcttagtgattttctccactgctacctcttgttcttcaccagcagcctggtttaaactaatccctggcttccgcggcactagagactgggaggttaccacctctccttttgcattggttaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacagtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggaacggaactctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagt

SEQ ID NO: 18256 - DNA, 850 bp, Oryza sativa
attgactttttagcacatgtttgaccgttcgtcttattcaaattttttttgtgaaatatgtaaaactatatgtatacatataagtatatttttttttgcagggaaagggaaatatattactcagaagcagcctcctcacaaacaaattgtgagatgatattacaagtttcatccggccaaaactctgtacagagtttagcacgggccttatttgctaggaaatggctaatgcagttctgagtgcgataaattttctggattaagacttccctgtctcctgagatcaaattccctatgtcccggatcagatgagcaaactgagacctctcctctttcgcagcctggatcatattcaccgccaccaagcaaccagactccacaatgatgggcaacaaggtccactgaagggccataataatgccctctttgcaggctatcagttcagcttccaatgggctgctgcagcgctcaatgaatccggaagcagaaaaaatagatttgacagaactattccttagcatcacacctaaaccacctgaacctgaattcaagtcaaaggatccatccacattcagcttcatccaccccgcgtgtggtttctcccagcgacgagggctgcacccttgattcttcttagctagtttggacttattagaaactaagtggaccacatgttttcctttctctgtattcgctcgggggcactgtttaatttccagcaaggaagtaacatagctttccagaaaagaattaatacttacttaaattttttaaataagacgaacggtcaaacatacttcaaaaaaaatcaacggggtcgaatatttagaaacggagggactatcatgca

SEQ ID NO: 18257 - DNA, 1501 bp, Oryza sativa
aacacaaattatgctttttaacttaatatagcatgaaaataggagagataattgaaggaaaataggagaaagggattgagggataggggcgtacgtgatgtacgtacgtacgtccaagtataggctctgggtggggccaggtttgggaggcatatatttattttcttaaaatagatctaacggttgtaaataatgggtccaccagatttaataaaaatctacggttagatattttgttttttcttgaatttccttttaatttattagaatgacacatggcgatttaagagcgtttgtagagtgccacatggcaatctaggagtgtttataggatgtttaatgaacttttagtatatactccctccgtttcaaaatgtttgacaccgttaactttttagcacatgtttgaccgttcgtcttattaaaaaaatttgtgaaatatgtaaaactatatgtgtacatgaaagtatatttaacaataaattaaatgatatgaaaagaataaataaataattaatttttttgaataagacgaatggtcaaacatgtactagaaagttaacggtatcaaacattttgaaacggagggagtaatagatagaagatagatagatagatagatagatagatgttctcgtaagacaattagtatttgcatatttgcttctgcccttcgtccagtacatatcgttcctgcaagcatcctcatacaagtcctatccctctctcatctcccggcagagcccaaagctagaagcgtagtactccttccacccaaaccgatcgaaaggctgatccgaagtgcaaatcgggccgaattatatcccccaaattactgataggatcaatatcaatagtgatgtttgctgtttacatcttcagacagatggttgtggaaaccatccgagggatcttcaagcaagatgagagcactggcacgattggtgtggagttctgggtggtggtgaccatggtgaccttgcggctcaagtttgccgtcggcgccatcgcgccactgtactactccttgaggccactgaacaacgccggccgagctatcctgctgttgaactactccttggtgcactacaccctgggactcatgcagctctcatcgtccgacgaaaaaccagatgacttcttccaggtatgggctgtcctcttggtcactctgcagtacagcgtgaggatcggcatcccgtacaggaagagcaaggacatgtccctcatcgacctgctcatgtccctgtgggcagccaacctcatcagatcccagaccgtgctgagcctgaagatccctctctggttcatctggtccgtcaacgcgctgcggatcatcgccttcttcatctcctccaatagcgcatttgatatccacaccaacaacatgaggctcgtaagcaactacatgagatacgagcatgaacttggcaaccccgaggatgtggatccagccaccatggcagggtacaggtatttggtcctaggagaaggcaagcag

SEQ ID NO: 18258 - DNA, 177 bp, Oryza sativa
gccggatgaaacttgtaatatcatctcacaatttgtttgtgaggaggctgcttctgagtaatatatttccctttccctgcaaaaaaaaatatacttatatgtatacatatagttttacatatttcacaaaaaaaatttgaataagacgaacggtcaaacatgtgctaaaaagtcaat

SEQ ID NO: 18259 - DNA, 1501 bp, Oryza sativa
cacacgtgaagatttgtagggtggattaggttcactaccttaactagtggcctaatttaattcatatccctaaaccacagtaccggatattatatttcgacacctatatatgcacctgcactcatgtgtccctgtcaaggtcactgacaaggaggctgtcaagaaggcgacatccatcagagagaccggtgcagaacagaagcaaaagaccgtgccggttgatgaacaggagggagcaggaaagaacttgaagccttcaagactcgttaagcccaatcgtcgttttgttgggccagaatgggccgtgtgaacttgtaagctggcgtgagctggcagctatcttgagagaggggtaagaactgagagagagagagagagtataagaactctgtatccgaattgaatggtgaattttggcaatccggtggcgaatggcggcggcagctcaatcctgttggattggagtagtaataccatagtggagattgcctaagttcctcgtgttcttctgtgtgttcttccttgttcgattcttccagttcctctccctgtgttctcgttcaaggtcgttaacagtcccaccttccgcatgagcgtgacctggatgaggagcgaagctcaacactggtgtttccctcgcgtttggctcaggaggctgttttacacgcatggagtcgggcccgacagctgtgcaggtaaccaaacgaccacctcctgcacccgcacatgtgagccaccctcccatgtagatgaccaaacaaatccattatgctagctaagttctcgcttcccttgcgtatttcggatgtagattttcatccctcgtggatatgtcctcttgttgcttgtatgtcattaaaaatattaaaaaattaaaaaataacaagataaattaatatgaaacatatcactacacaaacatgcagggtcaaattcaatttctacaagttacaacaaaaaaaattaattaaactaaaaatagttatcatactttagcagatatatttgttatttttgttacaacttgtagaagttgaatttgcctttacatgtttgtggagtgatatatttcatattaatatatcttgtattttcttttttaaatttttttaataactatttaggtaatatgaatgaaacgatgggatatcccctcgagggatgaaatcattttttagtgtatttctgtattatggtgaggtgttgctgcctagcttgggtataatgtaaatggtgggaaattgtaatttccgaaattgctgagctagcatacatttacttttagcattcaaagtgatgttgcttgagcaataccatctaagaaaatggagataaacccaggaacaaaatatgaatacgatttttttccaatctttatcactacatacatgaacaatcctgatacctcctaaatatataatacgtactccggttaccagagggtagttgtgttacataaatacagaatcttgggctttcatatagctggaatgtacaggac

SEQ ID NO: 18260 - DNA, 1501 bp, Oryza sativa
agcggcggcagcatggatccagccgtcgagtgctcggccgccgatcaccaaccgccgcacggcctcccgcctgttctcggccgctgcctcgtcgtcggcggagagctagccgcttcccgcgccccacgcgcttggattggaggagaggagaggagaggagaggaaaggcagggagaaagagagagagaaggtgaaaaaattgaagtgagtgagagggaaaagagagagaggggatgggataaaaaaactgtatttttgcgtacggtccacttaagaggtccgcctgcgaaaataggttcatttttgcttgctgtccacttaagtgttgtttgcagaattagatttttccgtgcggtcctcttaaggacccgccacgaaaatagagtacgatttttgcagacgcggccagttacggttcgtttgcaatctaaagaggggcatgtacaggaaaatcgttttgtagtagtgaatataaaagaaaatcgtcgcttttagggattgctcagctgtctttggcccatggacccacaaactttttactcgagtggtacggtgctccatttttttaaggaaaaagcacaccagaggtccctcctcttatcaccaaattacaaaatcattcttgaaccgtaaaacggatacaatgtatctccaaacttaaacttacaaaaccagtgcaaacgatgccctctggcggtattggccccgattttgactaacgtggaacctacgtgcctcttttgactaggtcttcgtcgcatgtggcagtgatgtggcacttattaggtactattaatttagaaatattaattgcttagaaaccactactaatttagaagagtctcttacaatcctactaattactactccaatccaattaagtagagtctctgatatatagaccactaggtagctagaaacatggacatatgtatatgagattaaagctgcgttgcttcaaataccaaagtgaatttagggcacatatgctagctgtgcttatagcaaaataatcatgagcttcagataacccattcgatgtaatcatcgaaaaattggtagtacatggacttgtgcttgatcatctggacatcatcatgtttaccacgagggcgaaccatgtgaaggccagtgaagatagcgaaactcccatgaattgggtcagagtcttcaattgtgccatcgtcactgtcagagtaggaacaaaatgtgcgatcacccaaaatagaatggaacatcttggtgtggagattatgggtaccccatacccacacggcatggttatccgactagtcataggggatagcttatatctatggaatatgtaacaaatcatgacttgggtattacgtttccttttatattatggagcggcctaaagtcctgatttgataatattgtaaaatagatttaggaaaccgataccgtattggttaaggtttctatcttgtaatcctgcccccatcctatataaggtgggcaggaggccctctagggggca

SEQ ID NO: 18261 - DNA, 1421 bp, Oryza sativa
tcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagt

SEQ ID NO: 18262 - DNA, 1081 bp, Oryza sativa
ccttttttccttcaccccacagtgaaaaagcgtgcaggcggccggcgccgcggtggcgaaggcggcggcgcgggggacggcgcgtaggcggcctgcgcagcggcgcgtggggccacgcggcaacggcggcggtggcgggccggcgggcggcgccgggggctgcgtggaggtggcttgttcggcggcgcggggggcgcgcggcggcggcggcgaggcgccggccggctggcgcggaggggaggaggggaggcggcagtggccgccggccggatttttttctttttttttttagatgtgaatctgtgatgtatttttgtgtgagatgtgaatctgtgatgattttttttagaaccctgtgatgtaatttttttaagagtttgtgatgtatttggagatgatctattttttaagagtttgtgatgtatttggagatgatttattcaaggatttgaggatttggagatgtcctgtgatatgtgatgatttggatatgggaggggatggtgtgaaatcaatagcgatagtcccggttatttgaaccgggactaaagatagcgatctttagtcccggattcgtagtcccggttggaaaaaccgggactacagggggtttacgaactgggactaaaaatcacttctccactagtggtagaagattaatactgagatagaagggcaactatttgtgatttagttagtcactaactcgttctgtttgattgagtacgtgctgatccacctgacttctccatgtatatatatatatttcagtgattctgtatatatattttgagatgtatcagctattattatggatattttgaggtgtttaattgacaatattttataatatatataattttttaatatatgtatatatacgtatgtatatatatatatatatatatatatatatgattgcgaatataattctttctttttcgccaaccggttgtcaagaagaatgtgcatcaaagtacatgcataccctgcatcacatatcaaccatacaaacataagctgctaagagagaaaccgagcccaaaccaaccactgatatacgaggttggtcaccactagg

SEQ ID NO: 18263 - DNA, 1501 bp, Oryza sativa
taaaaaggtatattgaaggtcataaagttataaagaaatgaggtatgtctcatggcttctgcggatatctgaatagcactgttcaccggacatccgaattattatccgtatccgacggaaaccccgataccatatttgtattcgcatccggaagaaaatatccgtattcgtatccgtatccgaactatccgagaaatatccgatccgagaggtatccgttttcgttttcctccggagcggacagaaactatctgctccgttttcaaccctaagtgtggttcatccaaaggaccggagaaagtgggttatgctgcctaatttagttctgctgactctatcagtatccacatcttcagataccattcccataatccctaaaatcccagcagttgcgttgcatggtaggctatgtaaagcgcattcctgtgatgaaaaattgaccctgggatgtatcaagcgatccacacactagctaaggtccctcaatagggacaattaatagaaaaagatggaaagatggcgatgggatgtatcaagcgatccacacgctagctaggtccctcaatggggacaattaatagaaaaaggtggaaagatggcgatagggaaagacaacaaaatgataaaaggaagtactccctcattctctaaatgttagacaccgttgacttttttaaacatgtttgaccattcgttttattcaaaaacttttgtgaaatgtgtaaaactatatgtatacataaaagtatatttaacaataaatcaaatgatagaaaaagaattaataattacttaaattttttgaataaaacgaacggtcaaacatttttaaaaaagtcaacggcgtcaaatattttgggatagagggagtattagccaaaagatcaagacggggatagagaaatgtggaacatattagtcaccaatcgtagtccagtgcggttttttttttgaggaaatgtgaaaattcatcacacgctgttataaaagatatccttttttcgaggaaagtctcccagtcaatatggtgctcctatcgctatcaatttctatggtactaaccacgatctcctatgtaaaaaccatctgaaacgtccggaagtctgtaccatctgaatgacatcattcccagatagaaacaaaccgatgacatcattcccagatagaaacaaaccgctcgtagggatagaagatgaaatgaagataaatattaagtgtttcacataaaataaggtgttgataacgtatgattaattgtgttttaattattacaaacttaaaaaattgattaatttaatattttagaacaaccttcatatataaagttttcgtacgaaacgtaccgttcaacagtttaaaaaacgtgccacgagtatctaaatttttatccggttcttacataagaaacgagcgagaccattcgacagtcaaaagatatgagactgagaaaacgacaggggacagaatgccacatgcccgtcatctctcctcacctcccctc

SEQ ID NO: 18264 - DNA, 1501 bp, Oryza sativa
ctagcaccctggcctacaagggaggttggacatgacaaggactccaggaaggagaacctgaaacccaaaatgaagatagaaaaaggaaaagagaaatgatcgtttgtctgagttcaagatacaatattcagtctagtcaaggaaaggaatactaccatttataacaatttattaggcatgctctaaaatttgtgaatactcaaaggagttttttttttcaaaataagagtatataagatacccctgacattgcttaagctaagataaaacgtgaaaacaatatgtcagattttttacgaaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactctttccatcctctccaatcttaagcaggataacacaacgaattcttccttcccattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcaccagactagctaggctcactccttccacatatagtcacagctgctctcatcaatcaatctatctttccagcttccaggtgacaatcgagacctgaatttctgaacttttttttccctctcgtcacttcgtcagtagaaatccaaggtttatattcctctgtactactacacaacagagtgagcgtagtacgtgtctcatcagcatcaaaaagtgacatactgcaagcacgccacaattgaggccgattgatagaatcgaattccactcaaatttgcacggtggaagagaatcccctgcgtgcttgatttgatcaggatttatattggaggcatccaattccatcactcaaccggagctgtctgtctgtagctatcgccctatttctgctagctcgtggcgtgctagtttaatttcttccaaaattctccggcctcacctcgcgtcgtgtcgtgtcgcgtcgcttgcgttaggaggtgcctaagtactggcttgtcggcgtcagatgagtgcagggccgtgctgctcagaggcgcccatggcgtggatcgactgctccctcctcgcctggctcctcttccgcgtcgtcttcttctcctgccacgccaagcagttcagcatcttctaacactcgatctcagctaggctgaaaccacatatactccagcatatatacacagcaactgattaagtaagctgttgctcgccgacggtggccgagcatgtccggtgcacggcggtgcggtgaccggaggtcgg

SEQ ID NO: 18265 - DNA, 1501 bp, Oryza sativa
ggcaagttttttttgttggtttttcgtgtggtttttaagcattttttagaggtgatttctcaggctagttttgctcattgatttgagttagctagtcatattgaaggactttgcgtgctttttcctacgcttgattgcttgtttttaggggcaatgggaatatgtaggaattttctggctatgggagtagtttgttgttattttttattagatttttcctagaattgaaattatttctattgattttccttgaattatctcttggtacattgtgttttacgcgtagttggttagttgcttatgcaggtagagaaaagagaagggtttattaaagtgtagctttctaactatatatcttgtactgtagactgtagcagtcctcttgctaattacgcgtgcgcaagagagggacgggcgccggcgctgcgcaggaaattttacataacgcccaaaaatggatgagtggctgccgacgccatatatcacacacaagttgtatttttctaagcttttattatatcaaaatagtaaagtttttgaacatatatgatcacgtaaaagagcaatcgtccatcagtgcttccagtttttcttccagacgtttcttttttttttgttggcttcaaaacaaattaagccggaagaaacctttttagtttattttaagaaacaaaatctcttcagatgatgatctaaacatgagcagcagccagtacattggaaggaggaggagaagcatggtgaggcggcggcgcaggtggtggtgatgaagcaggggggagggagatgtggcggcagagagggcaggtgttgcggttggcgagccagcggtagatgcattccttgtggaactcgtgcctgcacgccgccagcgtgcagcacctctccccctcctccagttcccccaggcatatgctgcactccatctccgacgactcatcccgccgccggcgatggtgcgcgtggtccggcagccagatcttcggatcaggcggcggcgcaccggcatgtcgacgtcggcgatcgacgcagcagaggaggagcacgcacacggcgtacaggatgctgccggcgagggcccctgtgaataaggaaaacccgaacgcttgccagatgggcagctctttcaagaacagcatcgcgcaactatatcttgatagtattgtttattttctgtttttccaattccacttgaattgtgttctgcgccgcccatgcatttatgcgtaataatgtgttgcaagcatcaatcagctatatatgttgcaccctttatatatatgcagatcctaaaatagtagcattccgttcaaaaaaaaaatagtagcatcagtgtattttaggtatctgtacgcacaatatatggatctcttgttagctcggacttgatttttaatccttttaagatgagataaaaatattgttatgatctgcatacatacaagaaagaaatggatcaactacgatattattattgcctgttgattggatctttaattaa

SEQ ID NO: 18266 - DNA, 701 bp, Oryza sativa
ccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtagttccggggaatccagctacaggagaaccaggaatggggagctctcccctttttccgcccgactctttgatcttaaacttaagaatgctggttttaagaacgagtgattgcccttctccgacccttactgcccaaccggagagcggatggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagg

SEQ ID NO: 18267 - DNA, 285 bp, Oryza sativa
attcccttcccaggcgttacactattcaaggaattattgtaagtctttcttcgtgaacattaatctcttttgtttcaattaataattaataatgctagtttcaaattgattttgatgtcaggattattgggcaatcttacaagagaaggataacacttggcaaacctttgaaaaggttgaacattaaatcttgttcacattagttttattccaggtgttgcatcataagcaatgtagattacaccttgcaattaactgaagagctttatgttaactttttttagg

SEQ ID NO: 18268 - DNA, 532 bp, Oryza sativa
aatactaaatggtgtattacgtgtgaaaactttctatatgggaatttatttcaaatattagatattttttaaaagtttaaaataattaaacttaataaatcatacgttaataactttcttatttattaggtgatatcccgcgctttggtgtgaaataaatggatgaatatacgttaaatattatagaaatgatgaatattgaaatattttaaaaatgatgtgaggaagatgatttgacacacacacatatatacatagtaaaattagctggggcttcatggtgcccgggcaccaagattcaaattgagtatatacttaattcaaatgagtatgattttttttaaaatgtttaggtatgaacattaacttatttactaacgagttcaaacttgtttgaactgaatttgaacatcttttggttagattttgattctagatatatagcatccaaacatataattagttaggtatgcaataatggattgtgaaataaagttgaatttttttttgagaaacttagtacaaacgcagg

SEQ ID NO: 18269 - DNA, 714 bp, Oryza sativa
agtcgctggaatcaatcaacatgcagagtctcttcgattgtgtctgtagagttgatcggacggcatacacggcgcccgatatttatctctccgatcgggcgaccgacatatagttgcttccaaacaaacaactaacaacttattctatatcggcttattataatccaccttatagtaatatgactcaataacctagattacaataatcttaaactgagacaaacaggaccaaagtcgatggcttctctaggaagccaaccgggagagtccacggccacgctccgttccggctgaacgaatattaaagtacagacaaaggatgtgttcgtaagtgctccttcccaactcccttcgcagttttttatgcgcacgcttcccaaactgctaaacggtgtattttttaaaaaaagtttctatgcgaaagttgcttaaaaaatcatattgatccatttttgaaaaaaaatagctaatacttaattaatcacatgctagtagactactccattttctatgcgcactgttccggttgggaacaacaagcagcgaacagagccaaatttatactttctactaggtaattctagcaattattaaaatttaaaactcaatgtacaagtatgttgtatcattatccattagcaattattatttagatcatctgaaacaacaagatcatctaaaatataatattgtagacttccatatgaggcacca

SEQ ID NO: 18270 - DNA, 1501 bp, Oryza sativa
aaaaccccttccgacatctggtcaaacgtctgatgtaatacccaaaaattttcttttgaaactataaagcctctttgctttgtatgttcaaaaagcctacaaacctatcagtaggggtgtataagtgactaacccgtgaacccacttatatatcaacataagttggttagtggtttagaccatgtttaaggagcttaaaattatgaaaagaagcttgtgagaatcatttgtcttttagttcattttttggattctacaactatagcttcttagaatctaggtgaaaatctagactggttggggagcttttaatagctggagattctatgagaagctacgaggagcaaagttagccatttacacccttaccaactgataccaactgatgaggatgttaggtctcgatcttttgataggtactaataaacagtcgatttgggtggagtcgcgacacaactcgatccggcttctgaacgaacacgctactgagtcccgcaatcgcaacaccacgtctcctctagttatcaaccgtgccaaaacccggttgacctcgccgagaagagcttcagagtgcaatattgttaaggctgaattattttggttcaaaattcagagaagctattttcatattcttttgtgccgtgaaagatcgggctaaattctcggacagcgtaggcatagcctgggttgctcatggtacagctcggtatttcttttggcttctttggtaagaaggatcattttcctttgctcaagaaaatgaaatgtatgccaaagctatctctagaaacatgtcctcgtgagtattttgattggcaagatgcgatggagaatttttttgagggccgtggttttcaatcagtcgtaaagatgtattatgcagaagagacatttgataaagatgttttgctatggtggcttcatgtggatgacccttgtcagacatgggaagatatgacatttgtgttgcgacgaaaatttgtttattcacttgattctgttagatttaattgggtaattgatccatttaaatcaattaaatcaaataaattccaaggttcattatgctaggaattcatgtgtattcattcttttataggatatcaataggatgaaaagttttgagaattaatccatttgtttagggaattggtaacttatatcaattagtcctaattgatggatggttgatggttgtgtagtggaggatggttcatggctagttgatgacaattagttgctctattcctcttcctattccattggtaacttacatcaattactcctaattgattgttggttgatggttgtgtagtggaggatggttcatggctagttgatgacaattagttgctctattcctcttcctattccatgactcttactcttcatcttccattcctcttataaaatgagaatggatttgatctcccgcgagaattgtgagacacactttcatccattttccaacgctgttgctgctgtggtaatcctatcccga

SEQ ID NO: 18271 - DNA, 154 bp, Oryza sativa
gatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgatt

SEQ ID NO: 18272 - DNA, 1501 bp, Oryza sativa
tgcctccgcaccaacaccagcccacagtcagttgccgacccgtggctccggaggcactaccaccgccttgttgttgatgttttgtatcggcaataatttaagaaggctacgcacgagatctcaaagcagatggatgtggaaaacaagggtttaataggttcatgccagaatggccgttgcgcgaacgttcgtggaggagttcgtacgaacgattggcccatcctaaaagagctcctttatataccttggtggacagggttacaaagggggaaaacttagccggacacggtttcagtttcctaatctgtacatagtattcttcggcctggattctatatcctatcttagggtacaaggctacatggcaatcgagttttactttatctcctattacatggatctggttcaccttctatcactagtctgataagaggccttgtgggtatctagtacccatactatccacactcgttgtatgcccttgtccatcgcctcctgcactatccctctaagcttgatcccccacttcccctccctagcaccacaccctccccaacccacccccaataccctaacactaacctggagattgttgttatgcgtccagaacgtgttcatgcattcaatgggcgtgtgtgttcgcgaattaggctttttgatgaagatggctaaccccacaccaccggtcgatgctacgccattgtgcagcacgtcacagtgagcgagatgtgacacccaggaaatgttagggctgagtgatcctcttccggaaatctcatgatgtgttgtcaggtttatgcgtgaagtgtagcctggttggctggttgactggttgactaacaggctgaagaccctctaggttggtcttgattttggaaaagtctattttgccttcctcagctatgggccgagcctcattcgcttccctcagacctctaaactagatatgaaggatccctcaactattgaaatggtttgttttgcctccgcaagctacgtggattgtggtttcatcctatgtagtgcctacgtgacacgtttacctggtcttcatatgatgtgatgccttacatgtcactcatgtggcattgcaattagggaaaaaaataaaaaatatatagtggtacccacatctcagtgagcccatcttcatcctctctagtctcttcccttgcctcctccgttaacctctctttgtcaccctttagggacatcgataccactctctcaatgccacacttggaagtacaagttggcatcatcgagttgctctatctagatgatggtgaccttgtgttcgtccattgttagtcaattagtacctctggctgctcccctcttcattcgccataggtgtacattctcctgcatcagcttcttccccccacttgccgttcctcttcgtcgtggttttctgctccattcctatcaacgagggaacttccccggcctcacctaacctcccaccatggctgcatgggcaataactaccatggctagt

SEQ ID NO: 18273 - DNA, 332 bp, Oryza sativa
acgattgatttgcgagtttagggacgggaatgacacagcggtactagttcagggcccggtgatggactttactcatttgacaatgtggtgctgcagtaaacgtttgctgatgacggattaattaggcttaataaattcgtcttgcggtttacaagcggattctataatttgttcttattattagattactatatgtttaatactttaaatgtgtatccgtattaaatgtgtatccgtatattcgatgtaacacccttgatctaaacacaaacacgtacccttgatctaaacacagcctcagtctatccggaggattcagataaaactgaaca

SEQ ID NO: 18274 - DNA, 1501 bp, Oryza sativa
gaaatcaatgaagcttcattctagaggtgatgcctaggcaaataagacaaaacagtttactaaagaataaaaattaatttataggtaaaatttttactgcctttattctaaaatatgtatagctgtcagttaccgtgtccaatgtttgaccatccgttttatttgaaaaatattgatgattagtatttttattgttattagatgataaaacatgtataatattttatatgtgaccaatttttttaaataagatagacggtcaaatattggacacggaaaccaacaattacgcttatattgggacagaggtagtatatatttatttgtaacaacctaaaactcaacgctaaaggcttggttttaagagctttcttcggatagcactacggctcggacgttcgatatctcaccaaatatcggacgcccagccaaacaccgagcgtatgtgcatgtgcatgttgccgcactttattcttcactcctcaatcatgaagaatcttctcatctgacgtcccatgtcctaaagaaaattggttggtcaaatgttctagttgaccattgagtgaaacatcaaattatatatggtgaaacaaaaaatcagcaactgaaacatttaaaaattttatgaaacatgatgaagatatacgttgaaacatatcgctatcacatatgaaacaatagtgttaacggattgaaacatatgtttttctttcatcaaaatataatcatgtgatatcttgttgtaaagatttaattacaacgaatacaacggtgtgaccgaatcatagattggataattagtttatgagaaaaattattttgaagctcgctaaaatgcatacatgcatgcatgtttgaggtggagagagagtagtgagatatagtttcatgaaatttgtgaaacatgcataagagacatattgaaacatatctatcactatcgcgtatgaaacaaagagtgttaatggattgaaacatatgattatttttaatcagaatataatcatgcgacatcttgttgtaaagatttaattacaacaaatacaacagtgtgatcggattgtagattggattagtaatttacgagaaaaaaaatgttttaaatatcgttaaaggtacatgtgtgtaggcttgaaaggatgtgtcagagtcagcccgtccaatttttctccttccgtccggacgtccgagttgaagcattaacggttttcttctcaaatcaacctatattcggacgatgttatcgttccgttgacttgtgtccttctcaaaggcttggttttaagagatttctcttgttagattgctatttttagatttagtgtatggttttgaccagttttccataattaataagattttaggtctgacttttcctataaactagataactctcttctccctacccgttccctcaaaaaaaaaaaaggggcggactaaggcttatttatatgccagtaaatcggtaatatggcgatgcagaggctgaacggtaggcgtg

SEQ ID NO: 18275 - DNA, 1148 bp, Oryza sativa
cacgagggcgaaccatgtgaaggccagtgaagatagcgaaactcccatgaattgggtcagagtcttcaattgtgccatcgtcactgtcagagtaggaacaaaatgtgcgatcacccaaaatagaatggaacatcttggtgtggagattatgggtaccccatacccacacggcatggttatccgactagtcataggggatagcttatatctatggaatatgtaacaaatcatgacttgggtattacgtttccttttatattatggagcggcctaaagtcctgatttgataatattgtaaaatagatttaggaaaccgataccgtattggttaaggtttctatcttgtaatcctgcccccatcctatataaggtgggcaggaggccctctagggggcaggagcacatatgattgtcagatctataatacacccggtggattcaaatccccaaacaggagtagggtattacctctcattgagagggcctgaacctgtctaaatcctttgtctctgcatccatccacttttaggtctcgtgcgctaccccttttattattgccgaattcatgtttcgacagttggcgcgccaggtaggggttgcgtcgaattacccgtcgaaaagtgcgatggaatcaacttcagaagaaacgctgagatcaatcttattgattttagtggctctaatcttcaatcgggtttgtcgttccaatcttatttttatgagattgattttttaatctactgttatttttattattttcacgttctggctaaaattgagacacagccatcgccgtcgcctactttggcgcctagccgtgtccgagtgctcctttccttgcagatggagatgccgcaggttcggcataggaacacccgacgaccagaagcaaattcgtgcatttgttgatttacgaatcaaacaagcacatgtccactggaacgttcatggcggcatgcatgcacagccagcgtgtgcaaacaggagcatgcatgcaagctatggagaagatgcacaatttacctaataacgctatgcatagagatcgtaaagcatctgttttcttttaatagctaatcaatgcttttcctggcaagctggctgacacaccgacttcttctacacatcgatctacatgcaaacataca

SEQ ID NO: 18276 - DNA, 1501 bp, Oryza sativa
gctgtgccatagcgccgcctgccccagcaggagtgcaggacgccaccgctcccccgcgcttggtccgccgcccgtacgctggagaaaataaggttggagggatggtgctgacactcacaggtgaggtctacgctggcaatctgatttgtctcgccacatatgcaaaagtggcatcgaattaataatccttctctctcctgtaacatattagtaagtgcaaacttaatatgggtatttggataattggcaaacgtaaaattgacaaatagttaaattctccacaaattttaggctgaaattctatttattatcctccatttattttcctcccaccttctcaaaaatatatttgttagaggcatatcacgagggccttcaatcggacctgacgaaaccaccgacaccataagacgtcggctgagtccaaggggtgcacctggggcgaagaccgaaggattcgccaccaaggtcaccatccggccaagtcgctacctcgactcagcaagcagcggcttcgaccacgctcaactctactcaagaaggcgttgacctcgaagcacaagccgaagcagaggtgggtgcgatgcgccaaaacatgaataagctgcaagacatgcttcgccaaatgcaagagcagcatcaagcgcacgaggcagctaggcaagtcaagtaagtttcggcagcccccccatccatcttcgatagcgatgatcgtcgcccaagctccagctacccaccaagctttcggccaagctgtccctcctcatgtggcgcaggcattgagcatgattaggcaggccaaccaagctccgacgtacgttgccaagaccgctccgaccgtcactgcacggccaacccctcacaccaccatggcgccagtacggccagcggcgatgcaagtacagccagcgaaactagtccaaatgccgcataccacgatggaaacaacttcggccctacaagcgcaacttcaagcttttcttcaacaactcaaccaaccccacaccattccaagaccagcccctttggcgcacgccatcgggagctcaagtctggcaaccatcaagtcagttcggcgccgtgcaccaggcgaaccaacaaggacaaggggcattgacctggcagcaggcgccgcacttcgaacagaatgccgcggtccaagcaccttcgactgaccttcaagggatgatcgccggtatcaacaccacgcaacaagcgaaccagccaaatcagggcgccatgacttgggcccacgtaccacagttcgacccaagcatggcggtccaagcggtttcatcagatctgcgtggaacgctgtccagaaccgggccccagccgaactcaatggcacatcatcacatgcaacagcgatggcttcgccattcgtggctccgtatcaaagcttgaactcacctttccagcaaggcatgatgacaagggctggggacgaaaagaagctgccactaagctgggggctcaagaatcatcccattcccccagt

SEQ ID NO: 18277 - DNA, 1501 bp, Oryza sativa
gcagagaggaaagcgaaagagcaagcaggagcagtagtacaatgaaggacaagaaatggacatggcagtggcattgggaacaacaaaagcaaaaaggttgcagagacaaggtttttgcgatgcattgtgggcactggaatggatagtgtgtgctgtcccctcccctggtggcccgttgtctcaaagcaaaagtgaaacaaagtggtaaatgaacgtattgagatgatctttcattccaaccaaaccttttccaacatttgactacttcaaaatcaaatttcagacactttccgatatactactagtagctaggtaaatatatatcacttccaacggtgatatcaaataatggactcttttctattgtcataataatacagaaatttaagtgtatgtaaccaaacttctgaagcttccaaccaattaattacatttttttctaaaaatagaaaaaatgtcagctatacacctcaatatactcttgcgtgaaattcatctgtcaattatacatctcaaaatatacttgtataaaaatactagcggtatgcataagcactgactgcacatatgtataaaggtcaggtgcatatatatatatatatatatgctctcaatcaaatgagttagtacttctctctccgttccaaaataaatcaaaatatgattggataagataaatctactcttctagtttgatttattttgaggcggtggtaggatagagttagtgaaatctgagatagcgtcagaccatgttatctgcggtgctaataatgtcatctgcggcggcgacggcgacgtcagaacggcagagcgggcatgttgtgcggttgcgcagccacttgacgacgcaatccttgtgaaacgcgtgcgcgcaccccggcagcatcctccatctcccccgctcgccgccgccgtcgtcgacatcatcctcgctctccgacagacagatgacgcactgctcgttgtcttggtcgtctttaggtcgtagcagcagcctctcgatcagcatgtcgtacttgttattggcgtcgtcgttgcggcggcggatgagtccgaccaccgtggcgatggtgagggcgaggaagcagagggccacgccgatgcaggcgaggaggaagaaaaagatgatgccccacatgagacagtccacgatatcctccgcgtccatgcctgccaatgcactgcacacacactcgactcgatcgatatgtctcgattttcttgtgtacgtacgtatatgtcgatggatcgatcatcgactctgaattggattagcaaaaagtaaatccgattctgacacgtgaccgtcctcctgcgccgcagccacggccacccttttgcttctcctcctcatcatacattcatactcatacatggacagggcctcgtcgcgcctctggaagcagagcatctcacagatcgatctttttttttatccggtgattaattaaagatccaatcaacaggcaataataatatcgtagttgatccatttctt

SEQ ID NO: 18278 - DNA, 1501 bp, Oryza sativa
tcatctacttggataaccgtgtttctggtttttttagggccttaggggggcatgtttctgaaatttaccgtctggaaaaaattctgacattgcttattatatactcagattttccaaaaaaatgcttatgtattgccagccttctagcacatgagtttggatgcttgttattgactgacataatgatagcttgcaatattaaatcggaatacaaacagtgagtataaaaacttttgtatgaatggaaccgtttgtgttattagagtgaggtttacatttggtcaatattatattcccgtttatgttcatgaaattcatcttgtttctgttcagtgcagtactcccttattgattccttcctcatttctgaacaaaaaggactcactaatcttagatggcatcatctacactattgacgcatcatctgcactattgacctccttatgttcatgcgacggatattttttcagatcagtgtggtacaatcctacttttgattagtgataaatagaagtttgattgttgaactgatcaatacaagatcctaatttgtaagtagcatctattgcacctaaaattttgtatatgcagtacatatatattagttaggatcatgtatattttggtattgctggcaaatataactctcaccttggatcacaaatgatttcagctaaacaccatctatataagtttaacagatatttatctaaactcaaaactgaaacaaaaaatgtgtttaatgtctgaaacttgcaaggtgctactatgatctctgaacaaataaacgttctgagtttcctagcagcaaattgatttgttcagagatttaggtgggggcacgccataataaatcgttgagactaggtcatataacaaattaatatgattttttaaagcaacttttctttatatttttttacataaaatacacagatcggaaaagcgtgcgtataaaaagaagtgagtataagtaaggaagatggagtaaaaagcacacccttaacccactaacatatgttttgcctcattgtaccccttgaactactaaaattggtttgctcgagcatttatcttcttcgtctctttttatacgagtcatattctaaagctgatattttgtagggccagacataacaccattatcaaagctctaaaatatttttaaaaattttcatgactattgtttgaaatttaaaaccacgatgtttaaatcatgcttactgctttgaaatatatgtatacggtggtaaaaaaaatatgaaaaatgttgagaggtaggttataatgtatctatatatcaatcctaccaaatttgcttgcaaaatacgacgtatatagttgtatatctttatctacttaaaacattcatagtgtttttgccgtgcatcgtagaatagtgtgtctcacacaatttttcatccgacatgtgaattgttggtccgtttccatgtcccccgcaaacgtccgactctttcgcccacgtgaaacggaaacaatc

SEQ ID NO: 18279 - DNA, 1501 bp, Oryza sativa
gattaaagaaaggaaagagaaggggagaaaagcatgatatgaggtggatgtcgctgacatgtggatcccacctgccaactcggcgagtcaactgcaatcaagcagccacgtcaacaaaaaccgattgtcaaaccactgaagaaggtaatttgcactggtttgtgaagatgacgtaatacccagccttgtggttaagggaaaccattcaatgatggaggtaaatagacttattccacggggatatgcacaacaatacttggtattcattctagctgccaaactttcagattcagtcacaggaacacaatgcactaaatcacgaatattttggtactacctccgtcccaaaataattgtaattctatgttgtttagcatatattaaggtttgagaaaaaagactatggtgcccctcattaaatggtgtttatgtgagagtggaaagatggttgagggtataataggaagaaatttgaatgagagatgattgatggggcaattagtgctctagaattataattaatttgggacaaagtttgaatcatagaaatacaattattttgggacggaggtagtactcattggcagatttgcaatcagtgcagttatccgcacaacaaaagaaattcttaactcaatttaatcataaatatcgatatagaaaataatatggctatttgtgatgcacggatacgtgatactggtacggcgatacggatacgttgatattacatgacattccagaaaaatggcatacacaacagtctccacgtatacaaaagacaccctgaatattatatgtcaggttgattcctcaatatgccagtgatccacaattcctccatatgtcagtgatccacaattcctcgatatgccagtgatccacaattaccagatgatagaaaacaccaacttcggagtactgtacaattgctcaaatgtgtatgaacataccaaattgttcgatcaaatcctgataggttgtagtgatacaaaattcttctgagcaccggttgtgttccaggttcaacaacagaacctccaccatcttatgccagcagaaatgcatgtaagagcaactgggtaacaatgccatggcagcctgtgtgcatcaacagatagatctcctggcaaagttatgtatcagacacggccgcgagacattttttttgccactcgttaactggttatacaggcctgtaaaatctgagcagatgcatctggtcttcttagttcttacaactcaacgtccccctacagaaaagcagaaccacatactatgcattaataaaggactgttactgatggtaaaaatacatatatacaaatctgttgttcattgcatgaaaaagaaaatgacacatggatgatgattctttcggaattatattaaaatttacccacttgttctgttatatttacacttcaaaggcacctgctattccaattcattttgacccaaaaaaaaaagagacgagaacaagccaatgattggcccatcg

SEQ ID NO: 18280 - DNA, 1501 bp, Oryza sativa
gagggccacgccgatgcaggcgaggaggaagaaaaagatgatgccccacatgagacagtccacgatatcctccgcgtccatgcctgccaatgcactgcacacacactcgactcgatcgatatgtctcgattttcttgtgtacgtacgtatatgtcgatggatcgatcatcgactctgaattggattagcaaaaagtaaatccgattctgacacgtgaccgtcctcctgcgccgcagccacggccacccttttgcttctcctcctcatcatacattcatactcatacatggacagggcctcgtcgcgcctctggaagcagagcatctcacagatcgatctttttttttatccggtgattaattaaagatccaatcaacaggcaataataatatcgtagttgatccatttctttcttgtatgtatgcagatcataacaatatttttatctcatcttaaaaggattaaaaatcaagtccgagctaacaagagatccatatattgtgcgtacagatacctaaaatacactgatgctactattttttttttgaacggaatgctactattttaggatctgcatatatataaagggtgcaacatatatagctgattgatgcttgcaacacattattacgcataaatgcatgggcggcgcagaacacaattcaagtggaattggaaaaacagaaaataaacaatactatcaagatatagttgcgcgatgctgttcttgaaagagctgcccatctggcaagcgttcgggttttccttattcacaggggccctcgccggcagcatcctgtacgccgtgtgcgtgctcctcctctgctgcgtcgatcgccgacgtcgacatgccggtgcgccgccgcctgatccgaagatctggctgccggaccacgcgcaccatcgccggcggcgggatgagtcgtcggagatggagtgcagcatatgcctgggggaactggaggagggggagaggtgctgcacgctggcggcgtgcaggcacgagttccacaaggaatgcatctaccgctggctcgccaaccgcaacacctgccctctctgccgccacatctccctcccccctgcttcatcaccaccacctgcgccgccgcctcaccatgcttctcctcctccttccaatgtactggctgctgctcatgtttagatcatcatctgaagagattttgtttcttaaaataaactaaaaaggtttcttccggcttaatttgttttgaagccaacaaaaaaaaaagaaacgtctggaagaaaaactggaagcactgatggacgattgctcttttacgtgatcatatatgttcaaaaactttactattttgatataataaaagcttagaaaaatacaacttgtgtgtgatatatggcgtcggcagccactcatccatttttgggcgttatgtaaaatttcctgcgcagcgccggcgcccgtccctctcttgcgcacgcgtaattagcaagaggactgctacagtctacagtacaa

SEQ ID NO: 18281 - DNA, 1501 bp, Oryza sativa
cagctatagccacctacatctgctgatcgacatcgatcgatctctactactccagtagctagcaagaattgaatctaggtgaagtgagagtgtgagagtacataattggcgccatccatggcggcattaagccagctggtactggtcgccgtcgtctcattggttgccttgctcccactgggcatggcggcgacgacgtatgatcccatcggcagcttctgctcggagacgtggatgaactacggcgatctcaacagcagcgaggccgtcaccaggcggcgcgccgtcaacttcgtcgtctccgacctcgtcgccaaggcgcgcaccggcggcggattcgccacctccaaggccggcaggggctccgaggtcttctacggcctcgcgcagtgccgcggcgacgtctccggcggcgactgcgacgcctgcctcgcccaagccgccaagcagatggtctccaactgcaactacacatcagactccagaatttggtatctatggattctaattctacatgtcatctacacacatgagtgacactgtatcattctagtagatttcaggccggttgtttaatatatttctttcgtttatgtgtgcttgtggcatgtaggtacgagtactgcttcatgcggtactacagcagctacaacttcatcggggatgtggacacgagggaggacgcaagcgtgaccttgaggagatggccggacatggacaacccaaaggcgttccagaaggtggtggggaaggcgatggtaaaagcaacaacacaggctgtctcggtgggtggcaacggtctgggcagggcgaaggagcagtacacgccgttcgtgagcgtctacgcgctggcccagtgcacacgagaccttgcaccgcctgcgtgtgctcagtgcctatcttcgacagtgtccaagtttgacaaggcttgtggcgctgcgcaggggtgccaaatcgactatagcagctgttgggcacgctacgaaatctaccccttctatttcccactcgaagccaacggccgtgccactattgatatgaacaagtacactaaagttaccatgcactgaataaatctagcatacatatgctacgcatatagtacggtaagcatgcgtacatacatcgcgtagcactttaatttcacgaatatgcactagctgcagtttgtttggaatgaataaagatgtgtactgagtatgttgtacacttaagtgaatcgaatatctctttatcattattttgccacaatatattaattggccaagttcgtcaaccattcataatgagcgccgcaatagtgtgaatgggaatatttggtcgagttaatttgatatagatgtgaacagtgacggacgtaggaattcatggccggatattcacactttaaaaaaatgttttatacaaaacacaaatgttgaggaggataatacatattaaattacaatagtgacataaatcatataggaataatatattataaaaatctcgagaatttgag

SEQ ID NO: 18282 - DNA, 1501 bp, Oryza sativa
tgttttttccaactttttttcgtacgttgtacctgggcgcgcggttcgattccctcccgtacgcaaaacagacaactctatggtttgctatatggcttaattctaaggtcgatacgatgcgattttgctctaattattgaaaaaacggaaagagaaggagataaggattaaaatccctcaatcaattttgttttatctccgtggatgtggagggatttcacgaaggggatggtttccgacagtgttgggaagctgcggagttggacggaggtaggggacgaccatgtagcactgggacccacgcgacagctagaggaggagaagggacactaattagactttgtggttgcttgatgggctggatgcgcgcttgcaggtcgaggtggaagggaggagaagtcaggttaatgggctggctttgctacgggctaaagaaagaatgggctcaaaatggcccagggagaaaggagggttctcatttaaataaatgataaaatgatgtttgtattatcaaaactagttgggttgcccgcgcaattgcacggctagcacccaaacaaaataatatattttttagtatgattttactagctatctcattgtcttaagactttgaaagaccaaaccttatcatcatcgtgtttttaatcatatagtttttaaaaatcacaccagttgctatccctcatgtcatctccttctttatttgcttgctcgatctaccactatttctattcattcttcgtggaacctttaaaaattggattttatagtttttagagtttattgtcacgttgggtttcatttttataatttctaaatgtcccgtcaaacgttgccattatacacctctacagcccgtccactgtctcttctctttattgttattgagattttaaaaatcgaacataattatcgtttaggttcatttttactttctagaagtaccgccaaaccgtgagtggctttgccattgtactcctttatggctcacccgctgcttcccttctttgttgtcattgagattttaaaatcgaatatgattatcattattttttttttactttttagaagttccgaacctttaaaaattgaaattgtagttttttattttctagaagtcccgtcaatattgcttatatttaattccaaagtttagctatttttaaattgtatttctacttgactctcctttcctattctaattttggattttattttatttttatttttaattttgattaacctcatattgggttcttatatggaaacttctttcaatattgcttatttttaattccgaatttcagctatttttaaattgtacttctacatggactctcattttctttttttctttttatccgattaatgtgggaatttctagctcacatagcgaacgtagtgcctcctttcaaaactatttttaataatataattgtcattgagattttaaaaatcgaatatgattatcaatgggtttttttttttactttctaga

SEQ ID NO: 18283 - DNA, 1501 bp, Oryza sativa
acaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggccaaaaaaaagatttttttttaagaataaggatatccttgtatttgccaaatagccacagagagcgaagttattggtaaacaaaagaaaatataatacacatgttgaaaaatctgaacaaaagctatttaaacactagttgtgaggaaaataaattgtccctgtcactgaggatagatccaacatccaagagctcatttttcacggtactaattgatcacccaacatctttccaagatgttaataatactgctaatcagactgtccaaatgtcgactggatttggttaatctcaacaacccaatcgtagctgtgacaa

SEQ ID NO: 18284 - DNA, 1501 bp, Oryza sativa
acatagaggcgagggcactagtcagcaacagacgagacaactagtgatgaagacgataaggccaatcaacactggcagaatcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagt

SEQ ID NO: 18285 - DNA, 1501 bp, Oryza sativa
gggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacaaaagcatatgcggcgcataaagaggcattctagccgactgctttttagccataataaaaagaatccgaatggttaacactctaaaaggttcacgaatgaacacacttgacaggcatccgaataaaaaactctaaagattacccaccaaatattataaaaattatggtaatgaataagtctaatagcctaagctatgactatccaccataatgaaaacaggcatatgtggtgtaaaatccgagtaaataaactcataaaggatttaccaaccgcctaaaaaaaatgactacaatatataatcagcctaagccataatattggtcaataaaaacgcacacttacgtggcaaagagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacgtgacaggccacacctgaaaattcgcattgcaataattccgaagaattatatgaccgcgtaaaaaagaattttatcagcattggacaacactattgtgcgcataagttgccaaagcaaaaaatgcctaagtccctaaggagcacaatgggccacgctgttaaaagtattgggctgaggtactgttcaggcctaagcccattcgcacctccgatacccttaacaaaaaatcccgtgatccaagcgccacttagtcttccccgccggaactctcgccattttccccactccctgctacagtacggagctgcgcaggcaaactagggttcaccaatccactcaaatccaccttcgaaaagttcatcaaaatccttcccgtaattcaccgcctcaatccctcacctctccctagccatcccccgaatcaaatcagcgcattcgggtaaaatcaa

SEQ ID NO: 18286 - DNA, 1501 bp, Oryza sativa
cctcagcccaatacttttaacagcgtggcccattgtgctccttagggacttaggcattttttgctttggcaacttatgcgcacaatagtgttgtccaatgctgataaaattcttttttacgcggtcatataattcttcggaattattgcaatgcgaattttcaggtgtggcctgtcacgttcttttagggactcaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcgtttttattgaccaatattatggcttaggctgattatatattgtagtcattttttttaggcggttggtaaatcctttatgagtttatttactcggattttacaccacatatgcctgttttcattatggtggatagtcatagcttaggctattagacttattcattaccataatttttataatatttggtgggtaatctttagagttttttattcggatgcctgtcaagtgtgttcattcgtgaaccttttagagtgttaaccattcggattctttttattatggctaaaaagcagtcggctagaatgcctctttatgcgccgcatatgcttttgtcatatgatgcatgattgtgctattattttgttctcaactatatgtttagtttgttaactaatcacatagttgggggctacacctaattaggtgcatctattcgatgcaccatattccttattttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccacccacttttattattgccgaaatctagtttcgacagttggcgcgccaggtagggggagcgtcaagcttttcgccgatcagtgcaa

SEQ ID NO: 18287 - DNA, 276 bp, Oryza sativa
ctgctctaccacagacctccatcacctggccttccttgctgctccatcgggctagccaccgtcctccctcgctgggtcgtcgatccaccctgagccccaacctcctgagccgctctctttatgagcaacatcgtgagagaccgtgagaccctcgtcaatcaggggattttggatctgagcgattccctttttggacacagatctgatttggtgaagaaggaaaaaagaggaggaagaagaagccctccattgccatgcactccactgccttgcagc

SEQ ID NO: 18288 - DNA, 725 bp, Oryza sativa
accaacactggggtgtcaattaaaaaatcaaaaacacttctgttttttcaaccctattttatttactggaaaatggaaaagtttgcactagtagccctataaatgttgcgcatttgagcaatcaaacttatcacttttggttgggtgaatctgcttgaacagtgcaacttgtacaagtagaggtataaaacctaagcattaaataaaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaag

SEQ ID NO: 18289 - DNA, 802 bp, Oryza sativa
cacactatttctcagctggcagtaaaatgtactcttccaagaaaaaaaacatgtcgttttgtagccagctgcataatgtctagctagtttttaacctttttcacacacatatgtttttacatttaaagaaatagttaattgtatttttttggggggcggatccaagacctggtgaccccggacgaccgcccgagctcgtgcacttcaagctagcagtaaaatgtactcttccagctaaaaaaacatgtcgttttgtgaccaactgcataatgcctagctagttttgtttccacatttaattaattaaagaaataattaattgtatatttttgggagcggatccaagacctggctagtggttaccttcgggcaaccgtccgaactcattgacaagtcacatcaatgtaatagcttccatcgctgatgttcaatggcatccatataatcctttggacatatatgtttgttcatgttctaaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttccagt

SEQ ID NO: 18290 - DNA, 325 bp, Oryza sativa
ctttttggtggtggtgttttttttttggggttcgtttcgacgtcatggtatctatctgttgcagtcttgagctttcatcgtgtgatgaattaaaggatagcgatgttgcttatgtttatcgttgttatgtctatccgctgcagtctttgcctgagtaacgtgtggcttatttggatttagcagacgatccttgataatgtttgcttttgtctatcttatgatccatacatgctacgtatacgtaacgcttcctgcatggtttacttaatttgttagcatattttggtatctctttagttcacatttttccgttacacttccgcaa

SEQ ID NO: 18291 - DNA, 1501 bp, Oryza sativa
gtggcccccgtgtcgcggccagattgatggccagagaggctgtggcgaggccgaacgcccccagcgcgcgcgccgcggcgatcttggacgcagcgccgactgcgccgtcggcctgatccaagcgagcaacgttcaccatgatcagcgattatacggtgcgggaggtggtcgggtggtggacgccgtcggagggggagagttggggggtggtggtggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgccactagagttcatatagaaatacaatttagaaataattgaaattcggaattaaaaatataagaaatattagaagaagagactagagtccatatagaaatacaattaggaaataactgaaattcaaaattaaaaataaggaatattagaagtagagtatagagtccatatagaaatacaattaggaaacaatagaaattcagaattaaaaataaggaatattagaagtagagtatagagtccatataaaaatacaattgcgtggctagcacccatacaaaattatatatatttttaatatgactttacttaaaatttattaattagttatctcgttgtcttaagattttgaaataccaaaccttaccatccttgtaattctaattttatagttttaaaaagttacaccaactactaccccttacttctgtcatatccttatttatttgcttgctcggtctactactgtttctattcattcttcttggaacctttaaaattttgatcttatagtttttagagtttattgtcctatttggtttcgtttttataatttctagaagtcccgtcaaatactaccattatactcctctatggtcgtccactgcctcttctcttttcattgatattttaaaaatcaaacataattatcgtttaggtttattttttttactttttagaagttccgctaaaacgtcagcgactttgtcactgtactcctctgcgactcgcctgctgcctccctttgttattatcattgagattttaaaataaaaatgattatcgttggtgtttatcttttcactttttagaagctcgaacctttaaaaattggacattatagtttttagagtttattgtctcgttgggtttcattttatataatttgagaaatcccgtcaaacgctgccactatactcctctatgacccatccgccgcctactctttattatcattaggattgtcaaagttgaacataactatcgttggaattcattttttactttctagaagtcccaccaaccatcgacggcactgccattgtactcctatacgatctgcccattgcctctaatttttattgtcattgagattttaaaaatcaaatatgattatcattggtttttcttttactttctaaaagt

SEQ ID NO: 18292 - DNA, 835 bp, Oryza sativa
cccccccccccccccccccccctggctaagcatgaggagatcgagaaaggggcagctacgaacaccaccgcacctggtcaccgcgctgcagccatttccttctcgtccccacacagcacacagcagcgtttgctgctatcccatcgcaggtggatgaggaggagttgctgtcgttgtccccgcatccggccggcaaaaatctcagccgttcccaccaccatccgccaccgtcctatcgggcatgagaacttgcaaactttcgcatgcagtgcaggacctcgatcgggtttgcgtgcatgttcatgcaaatgatcatccaattctctcattgaacacgtatataaaacataagaatcgaatagagaggctttgcttgggagtcaaatacgtaggtcgaatctacaaaagctcaaaaataattttacgtaaaaggaatatggatggagggagtttatcaagttgtcacggctagctgtgatgcgttgtcttcacgaaatcccaaacgagtagatgcacatcacttgttccgggataaggttatatatctcggagtcaaattggcttgccagccatgcatgaaaaagacatcacgatcaaccttgatccatacctatctatttactacatctgtcacataattatataaaaaaaattatattatataacggaggtagtatttgtaaatatgtactagaatgtacacgacacactacaagaaaatccctgtgttaatatgtaagtgaataaaactgtccatttatctagatggagccgacataagcacagccaatagatttgagtcataagcaagcaattaaatcaactttcttgcagt

SEQ ID NO: 18293 - DNA, 1501 bp, Oryza sativa
agcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggagtatgtgcaatgtatcagtctttagaattgaaacaagattggcacccggccaacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccacacaacattactaacccggatcacccagcccgtggggatcagccacgtcgggagacctccaagctttcatgacaaggcatttccaaagccaacacaggtttaccatatgccgacgagaggggtcccagaccaacaacaggttaggtcccagaccatactgtgccaggaagcccaggggtcctccccgacaccaccccggcgaatccacatgtctctcggcatcaaggcccccctgataagctagttactcagccaggggtgtcccattccacccatgtggtcatacttgtcttatgttcggatgaaattccaaggaaacggtccttaagtgcgagagcgggaaaaccgtacacccggtacgttccccggtccgcggttttggaaattcatttagttcgcaagcactgacccaggtgtcgggttttccaagtcttttgtaaaacccaagttttacccaagttgttactcagattttaagtttgaaggcgaccgtcggtactcgcacagagtgcacgattcccgaggcgcaactgggtggttacaagggaacatggtataacaattaacaaaggaaggatcatatgcaacaaactaggtaggtccgccaatttgccttgcagacgggacaaacagattaagtgcgatcctatcaatgcataatatttttcaagcaacttaattaaatttcaaatataggctcaagatgttcaaaggtggcttgccttgctcgagatctggagcttgatcctcgaaatcctcgcgctgcgggtcttcgggctccgaaactacacgcgaaacgggacaactcaacaaacggcgaaaaaataaagccctattaatgtcctctaagcatgccattagatagatctcgagatttgaggaattttggaagttgaacggagtcaaacggatttacggttgggaagatattgaatttctaagattattggatttttggtctaaaggaaaaggatttaattaaatccttttggaaaagaaaagaattgaaaagaaaagagggagggattatagacttttcctcgggcggctaaggcgcggcccaagggaaa

SEQ ID NO: 18294 - DNA, 1501 bp, Oryza sativa
ttagtatctcttgatacctaggtactatcaggtaccaaattttacattaaattttttggtaccccatggtacctcctcaaggaatgtaaaattgctccaacaagatatacagctcaatacactgcttttgacatcaaaacaaatgaattatagatgtaatagaacggtagagggataagccttttcttagaagtttaacaagtagagtatagtgaaaagagaaaagggcattaagaaaatatttcaggacctagtgtatggattgcatgtatgagttatcctgcgttgccctgaggccattccacatcaaaataaacacatagagttcacagtccataacctatcagacaaagcgatagccatattcatgtatgaaatatggctgcaccattgggcatagtagaattttagttgacctcaatgccttgtgcaaatgtatttacaaaagtctattggttcagatagacagagcgcatgcacatagcatgagtgtagctcgaatacaaacctcacatttattgtaagagcaaaagaacagatgagttcctacaaattttgcaattacttaagcttcagctagggaacaatggaaatcagcacagcagagaaaccagtcctttaattttgtttgcataagggttgttgaaagaagcaatgtgtatgtagcaaaaatcccattcagctctaattacatgaatcaccaatagcaacatataatcaagtacaaatcatgtataacaatgccataaatttaataactttgcagcaaatcaaataaatactcagaacaggatataacgtagcttagcgaactatttggattatactataacacatggttgctgaaatacatctccttttctcttcccattaggaggggacaggccccattttttacttccattaaaacagaacaaaccatcttgaaccactcataagaagatcaacatgacaagatgctcaatgcttcagcaacttaactaaaaggacatactggaactaaatatgcaccgatagtaaagatcaagtgttgcgattaaaaagaagcacatcacacacaaccaaagaggcaaagaccaatatcagtctttaaacataaggaactagatgtagctggacagcacagcgaaaagcttacaatttgcattttaagcagcatactgaagagaaaatggtatctacgacaatatttgggggcctagtgtgtggatcgcttgatacaagtgattatatgtctcccagggtctatttttcatcacaggaatgcgctttacataacctaccacacaacgcaactgctgggattttagggattatgggaacagtcagcataactaaattagcaaggaactcaaagtcaaagcacatcaacgatgctgtcctccaaacccaagtgcccccccaacacctaccacaagcgaccccgaccagatcctgcccgaggacgggcggcgcaggatcgcgcagcgaggggttggccggagaagacgaatccccgcga

SEQ ID NO: 18295 - DNA, 1501 bp, Oryza sativa
gccgttggctcgtctcccctcgtctcgtgcaaccacccggtgtgctcgctttcgcctgtatcgccgtggttcgctccgccgcccgccgctgtcgtccgccgtccgttccggccggcgtcgtcgtctacctcccgccggcccgcgtggctgccacttaggcgccatgtcggcgccacctcggccgcgaccggatcggctgacccggccagccgctccctccgttccccccccgtgcgcatggtccgcggtgagccgtgaggctgcgcgtgggcccgccgcaccgcatcttccgcgaaccgcgcgcgtgcaccgcgtccctcccccaaaccctagcgcgcgccgcgtgcgcgttccgcacggtgaaccgtgtcaccgacaagcgggtcccacccgggaccacgcgggatggacccggcccaccggctctctctcccctccccgcccgcgcgcgcgctttgggccgccttcttgggccggccggcccatttagctcggccgagccgccccttttctctcgggccgcgccctagccgcccgagggaagtctacttcccctccctcttccttttctttttcaaaaaggatttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcaaggcaagccacctttgaacatcttgagcctatatctgaacttaattatgttgcttgaaaaaaatattatgcattgataggatcgcacttaatttgcttgtcccgtctgcaaggcagattggcgaacctacctaatttgttgcatctgatccttcctttgttaattgttataccatgttcccttgtaaccatctagttgcgcctcgatattcgtgcactctatgcgagtatcgacggtcgccttcaaacttaaaatctgagtaacttcttgggtaaaacttgggttttacaaaagacttggaaaacccgacacctgggtcggtgcttgcgaactaaatgaatttccaaaaccacggaccggggaacgtaccgggtgtacggtttcccgctcttgcacttaaggaccgtttccttggaatttcatccgaacataagacaagtacgaccacatgggtggaatgggacacccctggctgagtaactagtttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaa

SEQ ID NO: 18296 - DNA, 279 bp, Oryza sativa
ggagcccgtcgggccacccccgggggagatgggccgagcgagattcggcccatcgacctcgggggaggcaaaatagacttttgcggagaaatttgatttggatggatttggattcggaattgaactcgacgatagatcggggattgagatcttgagatggcacggacactagaccacaagcaaggaaataaatttcgcaattagggtttttaagagataatttttccactaggcgccacgacagaacgggcgctacaatgagcaaaggcggctgcgccg

SEQ ID NO: 18297 - DNA, 287 bp, Oryza sativa
aatgtgatttctttctcacttttttttttgttctgttcgaggagatccagtaccatgccgtatttttttgttacaacacgtcccgcgaccaggtagatgagttaggaccacttttgttgttattacagtatgtgctatgaccattttagatgagttaggaccactttatgttctaggaggtccggggtccagtaccatgccgtccatatatagcgcatttgagttgcacatctccagcaaccaactccctcccaaccgatcgatctctctcttctacttcatccagg

SEQ ID NO: 18298 - DNA, 1501 bp, Oryza sativa
tgtacatatctcttattttcaatattgtgaaaagagagaggtggttatatgtggtactgattctccacctatatgcatgaatgatatacagcccgttaaatatgtcaaaaaaaatccatcagattttatgcaaaaggaagaaaaagctgataaaaagttgcaactaagcttagcacaaacattccccttcaaactatttgaagatttaagggtcccttgaaacttcttggatctaccattacaaactatcggtagagccaacacaaacaaaataaagatttttctcgctaccaacatctattcaacttttcaaaatctactattccctccgttaaaaaaatacaaaccaaggaggagatatctctcctaatataatgaatttggattgtacttatatgtctataggagggacaacatccccttccattaggtttttccgaggcggagggagtacagagaacatcatggactgaggccctctttgtttaggtttataaaccaacttataagtcaaaaagtctaaacctaaacaaacaagcaactttttcgtttggctttgttgaagccataagccactctaacactgttaagccaaaagctaggtttttttttttttttgcttatgtgagatagatgcatgactccaccattaaacttaaaacattaaatccaccagcttataaatcacataagccaataagctgatttaaaagtctaagccaataaacctaagatcaaacaaagaatacctggaaatgggccatccttatactgtccggccccacattaccgcatcacatgtcagtgagacaaagcccaaggccaaggtacccaaccttcttcctcccgcgatggcagataaacccctcacggcctcaccggcttcctcctcttcagactccaatccaccaaacccaccccaaaacccctcccaaacccgcaaacttcacctcaaattccccccatttttgaacaaatttcctcataatcccgtcgaattcgacctcacctccccatccatggagccgcagctcgccgcactcttgcaacccccgccttctccactccccccatgccttcctccccaaggccacctccacctccacctccacctcctcgtcgtcgtcgtcggcggcggcggggggagaagccctcaagcctcgcccgcgtctcccgccaccgcagcagcagcagcccggcgtctcccaccaccaccacacgcggcggcggagggagctgggcgccgccgcgctcgcctccctctgcgcggggatcgaggcgctggccgccgaggggcggcacgacgaggcgcgcgacgcgttccgcggggcgcgcgcgggcgccccgttcacgccgctgccggcgtccacgtacgacgcgctggtggcctccgccgccgcgctgcgggagcccgggttcgccgcggcggtgctgtggcacgtcgagagctccgggttcgagcccggccagcgcgcgtggaaccgcgtgctccggatgcagc

SEQ ID NO: 18299 - DNA, 1501 bp, Oryza sativa
aaccactgtaattcaaacgaattggactgggttgcgtagttaacagacactcacagctcaagcaagaactggcattggctcagggacaccgggatgtctccgatgagagcaagaccagcaagatctagtgtgacaagcatctcaattcctccgagctcggcagggattgaaccggcaatgcctgcatttcctgcgagcctgagcactgaaagcgacctcaatttcccaatgcttggtggtatgtctccagcaagagcattcgtccccaaatccagaaccctcaggctgcggcaattggccacactctccggcaccggcccagtgagccggttccctgaggcgtcgaagtaggagaacttggtgccgcacgttgcaatgttggggatttcaccatcgaaggcgttggacgagacgttgaagtaggtgatgtttaccaggccaagaaggccgaaaggtgccggtccggcgaaatggttgctcccgacgtcgagcaggtcaatgctccggcaagcgttgagctttccggcaatggcgccggagagcgagttgcttcggacggagatgtagctaatttccggcggcgcgcagagctgatccgggagctcgccggagaggcggttgtaggagaagtcaaacccggcgaggcgcgagcagttggtaatggcggtcgggactggccccgtgagggcgttgtgcgcgagggagacgtaccggaggcggaggcatgggtcgaacagcgaggcggggatctcgccggagaacgcattgtaggagaggtcgagcaggcggagccacgggaacgcgccgaggaacggcgggatctcgccggagagcgcgttgcggctgaggttgagcttgtggagcgtggggccgagcgcgctgaagctggaggggatgccgccggagaggccgttgccgaagagcgagacggactcgagcgacgccagccgcgccagcgacggggtgagcttcccggcgatgcccgcgccgtggacgcgcaggcgctgcacggcgcgggacgacgggtcgcacgtcaccccggcgaagtccacgcaggggtcccctcccgccgtccacgacgcgagcgcgccgttcgggtcggtcacggcggccttgaactccagcagtatccccctctccgccgccgtcgccgcgtccaccacccccacccaatgcagcaccacacccaccaccagaacggccgccgccgccgccagcgagcgcgtctgcctcatcgcgacagctggaggagcaggcgcagtgcgagtgcgagcgcatgcattacccccgccgcggtggcgacggcaccggcgctctacttctactgctgtgactactgactactactcccctcgtactgagagagagagacaaggcgcgccgagtaaaagagtggcgagtaggtggcggtgggtggcgtgcgttaatgtgcgggtggtgctgccgcgcggccatgagccctttcttccttgacgtcggttggccagaaaccacgttcttc

SEQ ID NO: 18300 - DNA, 1501 bp, Oryza sativa
ctactactatggtgctaccaccgtgctgcggctgtacgcacagatctacagtaatagcaaagctactagtactgctactactagtattcattcaagcgtgagtggcaaacagatcagcatattgctgcgtgggcttcttgtatcatccgccggcgcaactgcgcgagcggacgatttaactactagctagatgtgccatctgccatgccatgccattgatgggaccaacataagatgcagtaggcatggtcgcatggagaaagtttgttggggtttggagttcagcgtgcctttctgtcggcaatgattcgtcggaacgtatcatcatggaccgacgtgcttgctaattaccccgatgatgcgttccagtgccatggctttcgactctcaaagcctgaactgcaaggtctctgtcaagatttggttaccaacctccacaaaagcattgccatggatgaaaacgatgccatcaccgggtccttaattacctcaaatagtaccagatccttgaaaaattgaaatgaacagaaacggcacgatcaaacttggcggaaatgaaggaaagaaacgtgctacctcatctactctactctacatgtctgtttcagaatagaaaggtctaatctgttatagtgctttgctacgatacccaagtactccctccgcccctaagttcaaatttacactaggggtaccaagtcctaacatctaaatcgatcccggcaaccaaatcgagccatcaaattgttcatgaattcgatgggcatgaagtaatgatctagcaatgtggcatttgaggtctgaagtactccaagttgaacttaattattcttctgttacccaatgtgtacaaacatatcacgtacaagaccacaagacaaacattatagcttacactctcatcgtctacttgttagcttatcagtcataagactcacaacaataaaaagtttaatttcaaaagaagttaaaccatctttttaaggagtaaagaggggttgtggcatcttccccctctctccccagtggtgacctcagatgacaaggagaacacctcaacggtgacctcagatgacaaggagaacataagctaggccatgatagtcgaggtggtagcatcaagtgatcaaggaaatcgaggcttgttcccgccattactgcttgtttccatcctcgttgcctccgccttagtcgttggatcaagaacgagctttagcagtagcactggaaagctccagccgataggaatgagctcaacggcaatagaggtaactatagctgatgatagcaataattgggtggcacggacacaggtcaatacacatatgtagatagaggcgacaagctcccaagtggtaagctctttacctctcttatcatcagctttcctcctcaccccagcctgaaatgctggtgataaagtaacatcttaccagcagcaacgcaaacgccttttcttatatagttgctttccactctcaaaacaccatgtcctctatgg

SEQ ID NO: 18301 - DNA, 1171 bp, Oryza sativa
actcgtgattcaatctgtacttgcatgagaagcccatggtgatctttgtacgtcacgaggttggacagaaatgatgggtcacatccacgagagcctaaatgcacgtgctttattatagatataaaaaacatgtactcccttcgtcccatattataaaggattttaggtggatgtgacatatcctaagactataaatctgaacggagtctatccagattcataggactagatgtgttcaatccacctaaaatcccttataatatgggacggaaggagtatcataatactatctttgttgtaaaatataagaagtttttagcttagatatagatattaaaaaagtatgtgaaaaatttaataccgaagtaaaaaaaatagtttatctatactccttttaaaaaagtagaaagtattatatcaaataaataaaaatatattttcatgaaatatgttacctatcttggaaatattcacttattaattttatatgtggacatctatttaaatttggttgtttttaatataaaaaattaagagataatttgtaaaatttataatggggtaggtagagtagtactccctccgtctcaagaaaagtcaaaccctgggtttccgtatccaactttcactgttcgttgtatatgaattttttttataattcgtatttttattgttgttagatgataaaacatgattaatattttatgcgtgacttgttttttttaatttttttcataattttttcaaataaaacggacggtcaaacgttgggcacgaaaacccgggtttgtcttttttttgggacggagggagtagattcaatactaccgtcagcgcagcatacactactatacatgcaacaccagactcgcgagatatttacagactcacaccctcacaaatacacccctaacacatgctcaaatagatgaaaactagtgacacatctatgatcttactaaattcatgtagaaagcttacctatataagggtaatagttgtaggcaccaggtgagtgaagtcatgcacccacaccattgatgcttttaaaacaaattaagggcatgtttggtatagccccagctccatccctactagagctggagcctacctaaacagtttgagctctacctaaaataagatcggagctgagtagagcgctctcacaaaa

SEQ ID NO: 18302 - DNA, 220 bp, Oryza sativa
agcagctagttgatctgcttaccaagtccttgggaaggcagcgtttccaggagctgagcgagcttgttggtgtgatcaacacaaaaggccaaagttgaacttcacaagatttagggggagatttgttacaaataaacttgtgtcgatctgctttgtgtttttggttctggtagtttttccctcccctgtttttctgttgattctgttagagtcacgcaca

SEQ ID NO: 18303 - DNA, 177 bp, Oryza sativa
cgagctcggtaccccacgggcgcggcgcggcgatttggtcggggaggcggcgcggggcgctgcggatcgagctccgggtcgacggatttggccgcgtggaacgggagctcgactcgatttttgcggaggcgcgcggtcgccggaggcgggagagggagagggagagagagggacggc

SEQ ID NO: 18304 - DNA, 240 bp, Oryza sativa
agcgttgtcatgtttaggttaacccagaagatgtttaaaaaaaagtgttcggttttgttgtcgtgttttttttaccaagtatagtaaatatttacccaaaaagaattaccatccctgcaaaaagaaaaacaaaaaacatgaaaagcatccctcaccatcccaatcttttcagttttcacccatccgagttagtagtagtaattttcagcatgagctccctgtgagccctcctcttacagt

SEQ ID NO: 18305 - DNA, 1501 bp, Oryza sativa
caagctcgtcgccggcggcggcggcaagccccccgccgccgcctgaatctgatcttcttcttcttcttcttcttgctctgaaaccatcgccacttctgtttgatgaagaagagacgtcagtctagctagctcgagtagcacatttgtcatcagagagaagttgattctttgcgcttctagtcatcgatcggtgtgtatttgcgtgtaatttcgaacaattttgtcacttaggttgctcgattgattgctactactagtactagtttacttatgtacttttgctgccgttttttttttgttcggtacaattttaaattttagatgatggggttttcataaagcaaagtaatgtctgcctggccaaattataatttggttattgtctggcttccgctactcgtttttctcctccagattttgtccatctttggccgagtttagtttcaaactttttcttcaaacttccaactttttcatcacatcaaaacttttctaaacacactaactttcaatttttccatcacatcgtttcaattttaaccaaattttcaattttagtgtgaacacaccctttgtattcttgttcggttggttgcttaacatggaaatgacatgaagtccctttttgggctgctttcctaacatggtaagtaccaggttgtacttcattcatttattcattattcatggcgagtgtaacacacggcactgtttggattcgatccttaccttgttcaaacagcatttacagagaacaacaattagttcttgtattccgagatctactaggtgtaccctgtatcttaaaaaggtctagggaatgaatcagcaagtatgaagaacattagacattacttgacgagctatataatgtgtcaacattggacattaagtatggccttgtgtagttccaaaaatttttttttgccaaaaaagtcatatcgaatctttgacacatgcatggagcattaaatatagataaaaaaaactaattgtacagtttgcatggaaatcgtgagacgaatcttttgagcctaattagtccatgattagtcataagtgctacagtaacccacatgtgctaatgatggattaataggcttaataaatttgtctcgcggtttccaggcgagttatgaaattagttttttcattcgtgtccaaaaacccttccaacatccgatcaaacgtccgatgtgacaccaaaaaattttcttttcgcaaactaaacacaccatatgtagtactacacatatactatacagacacacatttctcacatgcaggttcagtgcaaatttgttcgcatcttcctaggaaaggcacctaaaatgagaggtttgacggttttgggacaaaaatttctttgaccacatggtggtttcgagtcaactttgacgtctaaacaaaagtggccccagacaaatgccaaatcctcaatagttttgagtcagattgtcacctgcgtagaataatgaccaaaattacagcgtcttgtttt

SEQ ID NO: 18306 - DNA, 209 bp, Oryza sativa
tgctctttcgactctcgcgaaccttccattcccatagagcttagattttcaccctgagtccccggcctaaccggcaaaggggggcctgcgcggtctcccggtgaggagccccacgctccgtcatctggcgcgccaggtaggggctcagtgtgtgttttctgagctcttgtgctcttcggtgtgcgccaagcttttcctgttcagcctga

SEQ ID NO: 18307 - DNA, 1501 bp, Oryza sativa
gcaccacttgccggctgggcgctccctgatgggagcgccggcctttttctttttgtcgctcgtaggcctccccttttgggtggcccgcgaagcgccctcgacggcgaggacatgaccctcgtcgtcggaatggactgacctcttcttcctcctcctgtcacgtcgccctgtctgagcggcggatccgggggcggccgaagctgccacaccggaaccggaggagttccaagtccaggcctcctccttgtgagccactcggtccgcgagctgaaaaagctccgcggtagtctggggctccttggaggcgatcttttcgagcatgcggttgtgccgcacgccccccctgaacgcgtagattaccgcgtgtgcagggatgcatggtatggtgttgcggatttgacagaaccgctgaatgtacgagcgaagtgactcatcatcccttcgctgtactgcgtgtaagtccgcttcttcacctgggcgcggatatgtgccctgaaagttcatggtgaactgttgacacaaatcctcccaggagtggactgacgcgggtggcaagttcattagccaaccccgcgcctgccccttcagggccatgggaaagaaattcgccatgaccctgtcgtcacccccagcggcctcaatcccggtcgtgtagacctggagaaactcggtggggttgacgctgccatcatatttttcggcgatggtgggccggaaccttgggggccaacggacattccgaagactcgccacaaaggctctacagccgacaccaccaaccgggggcacggagggctgattcccacgtccgtgttgaggtgacactctggacgaggaagcgccctccgttgcgtgggcagcacttcggtcattacgccggcgctcgatgctggtgcgggcgtccggccccccacgcagatcttctcgggtcgtaggagtcgacgaaggagtggcggccgaatggcgaacagcggctgccgctcgtcgtgcccttcgtcttgacgacgcggagccggtggtagcagcaccagaggccttggtggcggaggatcgcccaccagcatctaggcgctgccgtgccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggagacgacgctccccatctcgccgttcttctccatcgcccgcgataggtgaagtcgcggatctttcgaccctctcgagcgcctccccccgcttaggactttggcgtggagggggcggcggagtacgagctcgacggcgtaggttcggctccccgtcgtcgccactcacactcggagagaggtcgtgcgcctttgcttgctcggccatcaggctgaacaggaaaagcttggcgcacaccgaagagcacaagagctcagaaaacacacactgagcccctacctgg

SEQ ID NO: 18308 - DNA, 1501 bp, Oryza sativa
ttggaccggaacggaggctatgtttagattccaatttttttctttaaacttttaacttttctgtcatatcgaacttttctacatacataaattttcaacttttccgttacatcgttccaattttagcgtggaactaaacacagccggagtgtcggagtcaccaattaaccacgtgaagcccataataatttggccacgttagggatcgcaatatacatgttagggtgaatcagggctgcggtccaatatcgcgtgaacagtcgagggttccattttccccaaattctagtggcacgcaggctatatcgtaaattgtaatggtatttatctaaaatgattaacccagacaaaaacatttagttgggctagaatggatctagttgcaaactacgtggaccccataaggaataagttcacttgaggtccattaactttacactgaatttaatttttatccttgaaccgaaaaaccagatataacaggtccctaacttacaaaaccagtgcaaacgagtttcctcggcagtattgtcctcgattttagctgacgcggcgcctacgtggctcttttgactaggtcttcgttccacatgacgctaatgtggcagtatgacctaaataaaaaaataaaaagtgggcccacatgttagttacatcataagattaaaaaatggtgggacccacatgtcaataatacaacgttatcttccacctcccccacactctcccctctgttccccgagagggagaagaagaggagtgcctcgatcgcatccccaccctattagctaggtttctgttccgcctctgcctttgcctctacttctcctcctcctcaccgtcgccgccgcagaatcgatggagtggcaggcgcagctgacaaggagaaggacaacagccggcaatcgacagggagcagcgcgactggcggtaggcaggagctatgtgacggctgtgacgtccgagctcaaccgccgctgggaggtctaggagcctctgctcccacatcgccgctgcgggcctcctccgtttttggacttggacttggaagagctcgtcggcctctcagccctcctcgctgcctcctcgtcccccttgccggcctcccaacctcctccctctctgtgcgtgcttgccggcttccctgccgcctcctctcagcgcgctctcactggcatcctcatcccccagccagtctgcgccattgctccctctctgcgagtgctgagaagatagagagggtgagctggagaaagtgggatccactgacatgtgggtcccactatttattttatccttttgtttgactgacatgtgggtcccatatattttggtttaatttttaaaattttactcctagtgccacgtgggtgccacgtcagccaaaaccgatgacaatataatactgttaagggaccttgttcgcactggttttgtacgttaggggggccattgtatctggtttttgggctcaaggatgaaaatcgaattcggtataaag

SEQ ID NO: 18309 - DNA, 1180 bp, Oryza sativa
cttcccccgatcgatttcttcccccatctcgccgccatttccgatcaggagcggcgcgatcgagatccgcgcgttttcgctgagccgagcaagcacggattcgcccacccgctgccccgtctcccgccgcattcgtacgtttcttggattcgtttttttttcttttctttttcttgtttgaaacaattgccatgactagttctctgttcatgttcggttcttggatttatttttcagtgttattgcatcggttctttttttttcttctgatttttctgttgtgggttcgtgctccttcggtgtaggatcgttgtcagtctgtctgaaggagttctttcttctcgagtttcttgagctcatgtgaggattccagggttgcgtatttccgatttgcgagtgaaagatatggcatctttgcattcgcgttgacgattttagtgtttgtggagacaaccagcgtcaggcctgtagtttgtagttcttccactatgatgatgcggtccatgactccatgaggattctgtgagtagtatgtaatgtgttccggagcctggttttaggttgccattttggagttcgtactatcaataagttccagtttttggtgttattgttctaaaactgcttgaaagacagtaatatggttccttgagagatatctgtgtgtctgattattttttttttcatcgcatcaaaagggaattctgatatgcattcagatatgtttctagtgataataatgccagattagttcaccagtaatatctgacttagttcctgtccaattagtagtgttcttttgtgcaagttggtcctagtttcgtgtattatcagtgttgtcggttgtcaccatactttgtgaatggtctgatcttctgatgtgacatgagttgggatggcaaagtttgaccaaagattgttttgacaaagcactaagcagtaagctgcttccatctactactactagtaattccatatctgtggtttgcatatacatatcaatcttgctgttgacccaaatacccaccacctaacgcatggagacacatgctcacacgttcaaagacttttggcaaattctgaattgtgtacttcttggcaggacaggcatagctgttagagcttccatgaggtggatgcaatatctcaattgctaagatctgcggcgaaatggggagga

SEQ ID NO: 18310 - DNA, 1501 bp, Oryza sativa
aatccaaattcattatattaggagagatatctcctccttggtttgtatttttttaacggagggaatagtagattttgaaaagttgaatagatgttggtagcgagaaaaatctttattttgtttgtgttggctctaccgatagtttgtaatggtagatccaagaagtttcaagggacccttaaatcttcaaatagtttgaaggggaatgtttgtgctaagcttagttgcaactttttatcagctttttcttccttttgcataaaatctgatggattttttttgacatatttaacgggctgtatatcattcatgcatataggtggagaatcagtaccacatataaccacctctctcttttcacaatattgaaaataagagatatgtacatacctataatatagaatcgcaacatgatgactatttcgcttgcgacttgtgacagatttttcgtccatagaattttgcatcaagattatgttcttacagggcacttacactaagttccagtacactacacttagctacaacttttttttctctagatttaccattttgacatatttatcgttttattttgttttatttaaaataggttggatccattgatttaaagttctataagatttaaagttctaatctgatcgaatgatcagtaggtagttccattttaaataacatgttgatggaaacgccaagaccatagccaactcgatgaaattcaatccaactcatacatgctacctcagggcttacgttcatgccaccgggctagagtcatgcttagttgactcagatgcgtatatatgtaggtgataggtgacatgcacccaaagttaattgatgtaatacttaactatataatcatgcatgcatgctaatttaattagtcacctgacctaattaaaaaaccctattatagtcacatcacttaccgcaagatatatgtagggcagtcccatccataatgatcacttgcaattccaaattagccgataaaatctttttttaattagaaacaagtaggttatagttaatattaaataagaaaagatattatgacctttttacatgctcattccgtctgtttttctctgtgcataaacgcacaaagatttaattggcattattgtagagcaccttgaattagagatggcagagatagcaatagggacccgtgacccgacacctctaatcatgctcttgtacccatgggtctactgacgggcgaaaactcttactcatttagtatgtgggtatggatccgttctttacccacccgtatcactagcccgtgggcgaaaaaatccatagattaaacctaaaactatgagtaacataaaactcatttcacctcttaagcatttgttctagtccagtatttgatttcttgattatgttatgtgtataatttttttactcgtatttgaacattaatgttaatagcattgttgctagagaaaataatgatagtttatatgtctaatatggctaattacagtac

SEQ ID NO: 18311 - DNA, 1501 bp, Oryza sativa
tctgctctgtgctgccttcatcttcttttattgacatttggacttaggttcagcattggagttgagggtggtaggttctagatctaaagagagattggagtgataatgatgatttagagagaagtcggagaggagtttctgctaacgaaagccatgtgtgatgaattggcaatgagtttggttggagactaggcgagagatgccaattggttagaggtgacgacaaatcaatggagataaccactaaagacggggaagaatagcacaactaaaccaatttccccaaagaaaataaagagctccaccaatagaaaacatgtggttggaaggggaacataagggtggtgggaagtggcaaagggaggccgatgggagcttcctgccattagaccaatgttagtaagcagcaaggtgaagggccacggtcagcgatggcggctatgaggtgggaggtggaggttgatagggtttgggaaggagagagacggatattatatatatatatatatatatatatatatatatatatatatatcattttgcaaggattagagacggtggatttgacatccaatggctagaaatttgatggctcctcttctaaaaacagaaagggatttgtttccttttgccactcattataaatgtattatcacttttgccactgaaaatttgcagttctctttgaccatcctccttagtatgtatttctatttttttttatcactgtgtaatgttgttgaccaatgaccatcaagtttgcaactaaaaggttgttacgcccttgtagatgtttcacgaaaaatattgaactctaaacaagaaccataaaaaatattaagaaaactaattatggccacttagaatatattaattttaataaagaacaaaatgaaaattatattattttttttaaaaaatccaccatgggaatgttccacccaaaatatctatactagagaattatgtgcattgctatttatttttttatactatagaattacaaaagggtccttaggaacatacaatattacaaacaaacccttgtaaaatgctatgggctaatccgagacataccgattttcccaacgaggagatgttagaaactagggtcaaaattattgcaaagcaaattacacgtatggaacacccacttctatataaacgatttttctatataaggatacctataggttacagacgggctataactgatcgcatctgcaaaaatcaacttgtgttttcgcatccagctccttaaaagacccgtatacggaaatacatttctgcaagtggacacctattttctcattcgggcctattaagaggtccacctgcgaaaagtccagcctacctccctctaccttaaaaattctacccactccctcattctctctccttatcctctccattcttatccactccagcctctccactcctcccacatcctctccttcattcttatcctcctctcctaagccacggtggtaggctcgagagt

SEQ ID NO: 18312 - DNA, 1501 bp, Oryza sativa
cattccacaacagcaatttcacaaagcagtagtcaaacaaaactacgctaggaatcacctcacattcgcccatgactgtgggcacggctgttcgaacagtttaataacctctgcagagggggtacactttacccacatgatattactagccttggtcacctagcccgtgtggatcagacacgtttggtgacttggggctttcacgacaaggcatttcaaaagccgacacaggttcaccatatgccaacgagaggggtcccagaccgacaataggttaggtcccagaccatactgtgccaggaagcccgggggttctccccggcaccaccccgttgaatccacatgtctcttggcatcatggctcccccgattagctaattactcagctaggggtgtcctattccacccatgtggttgtacttatcttatgtttggatgaaattccaaggaaacggtccttaagtgcaagagcgggaaaccgtactcctggaacgtcctccggtccgcggttttggaaattcatttagtttgcaagcaccgacccaggtgtcgggttttccaattcttttgtaaaaccccaagttttacccatcgttggatattttaaatttgaagggaagtgttccgatgctcgagcccgaaggcccatgcatcgaagcacaacagtcgacaaaggaggtctaagtgttcaataattcaaggagggtaattgcagcaattaggattggggccggcaggctatctcgcaagccgcggccgaaatacttgtgttaaacctattcatgcaatatttgcggaaaagaaatacttagatttaaattataggtgcaagatgatcaaaggtgactttcctagctcaaggtcttcacggagcttcacgaatcttcgagaaaacctgcgatcgacgaaaatccggtaaccgcaactatacgcaaacaatcaaaaacctaaacaaaagaccaaaagaaagatcctatttagactaaataatagtgccattaaatagatctcaattttacggaaatactagaagtggaacaaagtcaatcggacgaatggatcgagaaatatgaatttggaagcttaactggaatttctggacaaggaaatgatttattggatttttctagaacacgagaaatggtttatggaataatattctcaagaatattattgatggtcgctgacatgcgggaccaaaggaaatgattcatggaatttttggaataaggaattgatttatgaaaaaggaaaaaggatttattaatccctttggataagaaaaggaaggagggataggaatcagactttcctgagcggcttggcgcggcccgagaggatttgcgtggctcggccgagcttattgggccggcacgggctacagggaggcggcccaagagaggggcgcggggagagagaggggaaggggagccgggtagaccgggctcacctcgcggggtcccgagcgggcccgcttgtcggtgaggcggtgcacgtggaa

SEQ ID NO: 18313 - DNA, 1501 bp, Oryza sativa
tttcaggctaacccccctgttcagggcaatcacatttgtacatattggctcaggagaaaccactcttttctggaaagacaaatggaacaattcttgtctacaaaataagttctccattttattctcatatgcaaaaaatgaagacatatcagtacaagacttcttatcaatccatgagttcaaacataattttcacataccattatcaaatcaagcaatgcagcagtggcacatcctagagaataatcttctaaacattgacctcaccaatgaacctgataaatggaaatacctatggaactctgatcaataccaataaaaaaaggtctataacatgttctttggacacatcacaacaaacaaaccattgatactgatatggcatagcaaatgtactatgaaattaaaagtgttcctttggctgatgttactggacagtctcaacacaagagaaatgattcaaaagaaaattttcaacattaagagtggtgacaagtgtgttatgtgtcatactacgctcaatgaagacatgtttcatttattcttctcctgcccttttgcacaacaatgctggcaacacattggaattcaatggaatctgacaggagaatttataaatataatcactgtcatggttacggatatggcataccttctatcctacggcttatggaatatacggatatggcataccttcgtatgtatgatacatcttcatatatgataaggaaatcaataagagattatggaaataatcctcacgggtaagtgaaaagcagagtcctactcgaagaggattaggattgtactatatcgtgctgggttcggtatctccgagttctacttagagataaagttaactcatggtataaatacacaccccctgggaggggtcctatggcatcgaatcatagcgccaataccaccaccatagcctacaattcggaggacgtgaagcctactcgccgggagatctcgtcgaaaccatctcgacaagggtctcgctggtaatctcgagatcgactgttctctattgtaatccttggttttccatatcaatctcatataaagtggattagagctattaccttacgaggagccttagccagtataatgtttgtcttcttgtttgcttgatgtcgtattgtgtagatcctcgtaccaacgtacccaataccctatgtatccggtctacgtgtatcccccgtcgataatcacaactgcctataacaatttccatcacaaattcttcattaaattgcttgcaattggatcttggcacatttcgagcagaagaaatgattacgtcttcaacaatatttcggtcagttttgataaatggaaggacagctttaagactgaatttggcttgcatatgcacatggcaaaagaagtagacaaacccctatggtaatcatggatagatagcattctgtaatttcgtttctttttctttttctttctttctgtttcttttctttcgtcctgtacgtaaacccct

SEQ ID NO: 18314 - DNA, 1501 bp, Oryza sativa
tctactgcttttgctctctcatggatgtgcagccatggccgccattgccaagaatgccaagcaaacctttacttgtgcttgtgataattactccatgtgtatatactactagcaatgtgggtatcagatcatcacctctggagattatgcagggctgatgtgatgtgatatgcatctctttgtcttgttagagatgaatcagatgatgcttaagctagcttaataacgcgattaccgcgcttccgtcgagcgaattctcagcgcgattcggcgcgatcgattaagagtgtaacttctgatgatttgcacaagaacacagttatgatgcaggttgatgttgtatttgatattaggcagtgactcggttacgctctctacttgctgatgagctggggattcagaacttgcatcaactgttcttgcttgctgctgatttgcagtagacctgattgttgtacatgcactgcaacctccttcagctttattatcttcatgaagtagaatttgcaaggttcttgctctctagccttagttctgatacaacctgaaaatgctttgcttgccctttcctgattggatttaaacttatcatcgatctagttcatatacctaatctttggctactcagaggcaactaacctcactcatactgtcatacacactgtcaatcatgcatgcctctcctttctgaatattgtagtagtagcttgcagcctgcagaaagggcttaattttttatgatattatcaatggcaacttggcaatgacagccacttgttgctctttttttccccctaaactaatgggtaatggcagtggaactgtggaagtactaacagctgagtcctctccgaaccgcaggagatagttgcccgcctttgaaccaaactctagggaacgctcaattgcctgacggtttacctgatatagaaagagggagtgtgtaacatacaatttttttggatagccagtgtgtactttgtagcatggtataagattagtttatgagatagtgtatggctgttgattctcctgccttttcgggactgattcactgccggctacttgcctgcctgctgcatggagcgttggagctgatgatgctgcaaaatggcgacgcagaggcatttgttttatccattgcgttggcgtggcagccgctcggtcaccatctgacggacagaaacttatcatgttggttcttgtatattattgtatggtatgacaaattactagtagtacctttctgtcattctgtgtgccgtatccaggggcggaccggggctagagtcccatggaagttttgggaggaagtagaacgtacgagtatgaagcaatgacgtttcggtttgcttaactccggggggaattataattcgttttcgcagatgatttaggtgaaagaaatcacggtcaatgaatctctaaagaaaatttacatggaactgttgtaggttttggccctgtttggatcggagggctaataattagccctccaaat

SEQ ID NO: 18315 - DNA, 1501 bp, Oryza sativa
caaaggatggaataatatagtctcatttgcataaatggcatttaatgaatactttagaatttaataaaactgtaaagtatttaattaaacaatattaatccaacgctatacaacacacccgttgcataggcccaaccattatgaacaaccaatcccggttgcacagttctaactccaaaccaggaatataccattccaaaccaggagctaaacaaattattttcatcatcatttattatggtgtgaaatatgagactaatcacgaaagacattgttagacctgcccataaccgcgggcacgactattcgaatagttttactctggctagaggtgtaccactgtacctacaagacacaacctcaacatcatgtcaaccatgcgtcgcgatacttaacaagtacccgaatagagattgtgacaatacccttcgcataacacaattcaaagcagtgcaccgtttctggatcataatcacccccttacaaacaaggcatggactccccagcgacccccgtgggcttatctccgccacttcacagtctggtgctctacaatgaaccatactatacaaaaagtaaagtcgttgcccacgctggcttgtggttggcacggttaatgtttcataaccgaaaatcgtgaaccggtccttaactgtcatgagcacgaccatcaaaaccatgtgctcacaacccaccattatcaagttttagttggcatcttaattaatcaacctatcatgattaaccatcatgagctatcattaagccatcattaagtaatagtgaattattaatcatcccattcatatgagctagtgtctctaagtatggctaagcatcctaattactttagctaaaaccatataatgttctagctaatcaaattattaaccaggtgacaaagaataggtaatcaataacaaagggctataacaaaggcaataggttattcccacccaatgacattcaaaaataaatgcaatagttgaatagaaacaatagctttaaatggaatcaacatgctcaaagggttgtttgggatctgtgtaacttgccttgctggccttggaactcttcaaaatcttctcctgcaaattcggactctccaggaacgtcggaatctaggcataaaagagcaaaatcaccaaaacagcatataaacaatcatgaacagtacatgtggatatttttaacatgtagatctcaattttagaaaaatttagagacttgaaccaactaaattcgagctaagatgaattagttatgaatttttaaagattaaatcggattaaatcatttatatagattttaattgaattatgacgcaataaagaattttttttgaaaaagaaaaatgatttattgcgtcagcgggctcgggtttacggtggatcgggtgcacggggacggtctacggaacggacggtcgagatctaatcttatccaaaacgaacggccgagatcgaatcgatctaccgcgggtctacgggtgacgcggcgc

SEQ ID NO: 18316 - DNA, 237 bp, Oryza sativa
tgggatcgggatggccagatgggggaggcagctggagcaaggaacggtagcggtcggaacgagggataggggcggtgggttgggcggagccaagctagaggcttgggctcggggtggcgaagaagggggagctcgcttaagaaggaagctagtattgatggagctcgagatctccgcagattgggcgctagaagttaggcaccatcttcttgccattgtcttcatcctggaaataga

SEQ ID NO: 18317 - DNA, 507 bp, Oryza sativa
aactccatttcatgcttgtgtatatttttgaccagaattgcgtcgagtggaatttttttctcctaacttagagtctgagcttttttctctattctaccatcgactttgatgccaccgtaggagagggagatcacttcccctgactaccatggagttcgacgcctcaaattcccaattccctatggcagcttccatggaacttggtatcagttgcagccatggtggcaccgatggccatggtatttgcaatggccatcgtgggggagattggatcatataccctcacttcagattggaaattaaggatttaccttcccatgccaatgacgtggggtaaccatggtcaattacatgggggtcaggagggtaaatcctcaatttcagtctaagcggagggtatatgatcaaattttacccagggtggtggcggcatagtgtagctcagcgtcagtggtctttggacactatatcactaagtaagcgggcatggttcagattcagtagcca

SEQ ID NO: 18318 - DNA, 1024 bp, Oryza sativa
acacatatatatatatatatatcaataatacttacgctcggacgatcggcgcgggggaaccggatcgggcgctccccctccccccctccccccacgtgctacctactgggcccatcacttctccctcctttttttctataaaagatgttttcacctagtgtatttagaatgtttcactttttataaatttaatgttgcagtgaattaaaatattgttttgcaaaagaaaaacccacatattttggaaactctatattaagggaatttggtttattacttgttccacaaaaaatgtttcacctagtgtactcataatgtttcactatgtctaaatctaatgttgcagtgaactagacattccattgtaaaaaaaaacacatattttggaaacccctattaagggaatttggtttattttccattctaccgaaaaatgtttcacctaatgtactcataatgtttcactatgtatagatctaatattgtagtgaactgaaacattctttctttcgctatttactgaaacattgtttttatataagatgaaacaacacccgatttaaacaaatgaaacattttcgatctacttagtgaaacaattccgatatacctggtggaacatcgtgcaacatttaaaaataattcaataataagcttttttttcatcggaatatatccatgtgtggtcttgttttgaagatttaattgcaatgaatttaatggtgcaatcggataatgatttggataagtaatttaggagaaaaatcagtttaaagtagttttccacgtaaatcgggtgctgacatcaatgcccgattttgttccaatcggatcggttgcctgagccgtaggctcctcctcccatctctctctctctatatgtgtgtgtatatatatatatatatattacagtagttaatgttaatacctaaacatttaaaaaagtttcatactcattcgaattgggtatatactcaatttcaattatggtgcccgggcaccatggaacaccaaacaaatttaa

SEQ ID NO: 18319 - DNA, 1501 bp, Oryza sativa
aatgtgcttgccttacttttttcttgtgcttatcatgtttgcatcctggcagatttgaagtctgtcaaatgtggtccatgggagcactcctcccttttttttttttttttttttttggcttcactggctcaaacactggactgacaaaatttctcagcttacaagacaacacagtataactttttgttgttcacaaaaatagattagaaaattcgtttaaggcttagtatctacttcagatttgcaagtcttttttttttcatcttagaacatttggttctgatccaactgtaactgaagtatactaaactaacataagtccaagcaggtctgcatgtgtagcagctgcataactaggaaatcatataatgggtgccatttctgtagttttttttttagattgttgtgaaagttgctgtcacaaataccactcaccatgttcatatactgttctttttttctcgcgcatattttgtactacaaatgctaatcaggtggtgcttgttgtaatgatgttcttttttatcaagtatacttcatgctaccatgatgagtttataacacttttttcttgtcagtaacagcattttgatgaactttttggtaattattcagtcagtttggggcttagcactgcctagagccctccacacaattaattgtatcaactttggcatacgtataagtgttatttacctaccaacatggctaactattcttagtggaagtgagaatgatactgtaagaagtaacttgggttagaaatggatgcatctttgatgctacacttattatgcttagttgtctatagtcctacacataatgcataacttgggctgctcatatttttaactataagatagaaggaatagcataacttgggctgctcatatttttaactataagatagaaggaataaaacattacaaactaataaagaagtttggtaaataatacatccctgacgctgacagctgtagggataccgaatgtctttttttattaatcaacttcatgaaaccttttgcccctggtgaaagtagacttcatgttggaaggcttgtaatattgtccatttctctctctcatcaaacatgtaaccgtcaaacttccactgttgcatggcttattgtgtgcgctttgatgatatttccgtagttattatcacacatatattactaataattaaatattgagtaagacatttgtatttccatagtctattagatggaacgactttttggtgtttcttgttctgtggccagttggccacttccatttttgtatgaatactatatctatttcttcagtatgctagggctgcaatgcaaatccatttgcacgaggattatgacaactatctagcttctggtcaactggatagccatatctactcacatgtctcagaggtataaacaacaatttttctaataaatgctgataataaattacttcagagtttcataaatacatgttaattatgctgtaaattgcctgcagg

SEQ ID NO: 18320 - DNA, 1501 bp, Oryza sativa
tcgccggcccgcgtggccgctgcgtaggcgccacaccggtgccaactcggctagaccgagtcaaaccggccagcctcgcttccccctacgtgcgcgcgcagaccacgatgagccatgcggctgcacgtgggcccatcgcgcctcgctccacccggcgcacgcgcccaaaccacgtccaccaaaccctatcgctgcccttcccgtgagcccttccctcagtgaacccagtcaccgacaagcgggccccacccgggaccccgcgaggtgcacccgatccaccggtcggcctccccctgccgcgcgcccctaatgggccgaccacccgcgcccgcgctggccaatggcctgaccgcgctgcgcatgaccccttgggccgcgcctaagccgccgagtaagtctaaatgacatccctccttccttttcttttccaaaggatttgataaatccttttcctttagacagaaaatccaaataatcttaggaaatccatatctccccaaccgctcgtccgattgactccgttcaacttccagtattcacataaaattgagatctatttaatggcactactaattagtctaaataggatctttcttttggtcttttgtttaggttttcgattgtttgcgtatagttgcggttatcggattttcgtcgatcgcgggttttctcgaagattcgtgaagctttgtgaagaccttgagcaaggcaagtcacccttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtctctccacccttgtggtacctcggtattcgtgctctctgagcgcgtataccaaataacccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcacatataaggaccgattcctgtgggaaactcatcgaacataatcaaagtgcaaccacaaggtggaatgggacaccctggctaagtaactagtcggttcagggaaacctcgcatgccaatagttgggaacgccagggcggggtcggttggagccaaaccaggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacag

SEQ ID NO: 18321 - DNA, 1501 bp, Oryza sativa
ttcagctacaaagatgtatgcaacaattgcaacatggacaaataacctccaccttaacatgacatgtaattatcagtgtaatcaacgtttggtagaaagggatctccaacgtttggtgtaatcaatgaagatttcagcgccgatgatgttttctacctaatcaagctaggagggcgttgctcagcggaagttaggggatcacatataagtaaaagttacatatatacggtgtttcaaaaacttaaaatttcttcctggatagcctccccaatgcttaagacgaggtccctgatgtaaatatctgtgaacccgctttgtttcacctaaacccaagaagaatggtgtttttttctcctctctcaatgaaatactagtgctcctgttggttttaaagagagaggctagagagtgtgttaagaagttgctatattctagaacaaaaatttcacgctagaagttactatatttgaaatggagagtaaaattatagtatgcacaggttaactagagagtgccccaatcggcttcgccatgcttattttctagtactactaatatatattacgatagctggagagttcgagcacatgatctagttactatagcttagatgcaagcgttgatggctaaatctgacattttttttatcaaactagagagaaatgtccgtgcattacaacgggtgaagtcatgcggtctagtttgtatgacatctaccataagtttggtccatagagtgaattgacccttgatttccataacagcaagactaatgcctttcattaaaagagaaaaaaaatcatggctgttgatgtgagatttatgtatgtacttattctctttcagttgcccgacgtgaatatgtgattatcatatgtgcgatgtacacacactactcacagtggatgcctggatggtggtggtcgaactatcaggggcgttatgcatatgcgtagctcggggttctattttctcttgctggcatggagacaggcgcacgatagactcattatcgtatgtgtgatatgagatggacacacgcgtggcggcgcgggagtgatccaatcctatctcgcaccgcaccggtagcgatagatgaaacagacaagcagacataaacatttcgattttttaatagataatgatatttttctaaatttttaaataaaggtaaagattagtagggaaaaagtgaaaatttggtaaaagaaatactttgaattccacgtataactgcacaccatgtgttattgtctctgtataacctgcacacgtagcaaatggtgggccgtgcaaatgacttcgtgggctgtgtctagggatagcaatttgacctgtttgcccgtttacctgtggataaaaaccctaatagagttgggtttgttctctatttagtactcataggtttcttattgggttaaaacttgtaacaaacgggcacacgggcccgcttcgcccatttacccgcgaacatcaactgacatgtggccctcaatcaact

SEQ ID NO: 18322 - DNA, 1501 bp, Oryza sativa
tcagtacacgtggagcctgtctgtctagttcgatggttcatgttgttgcgataggagaaaaattggttgttccttcgcgaaggggttgatgtgtgtaatcacatttgcaatgaatgaaatcgttggcctgcaaaaattcctcaatagtttatacacccctttgccacaggtgatgcaaatttgccccaatcttgttcctcttagctcatctccggccacaagcatgtgtagtgttccataggtctgatcgctatcgcgtgccactagcttcagctgtctgttggtggagactggagctttgggtgtgtttgctgacaaactgagctggggtgcggtggtggctggaaggagaggatagtgtgtgccggcagccggaggtagaggaaagcgtgtgccggctgctggaggtagaggaaagtgtgtgcggtgcgccagcagagggagctaggtgctagatgaagatggggagcagcggttgccggcagtagaggagagagattaacacataacgaagatgaggaaaaatttgacatttcacatggcattgtggcaaatgagttgattcccactaaattatgtcggatttttacatgccaatgaactttgtggcaaatgtgatctgcctcaacttcatagcaaacgagtatttttctctgggatgaattcatttggctgaaacggctactctggcactactttgtactgcctggatgatggtagcacaaacttttttctttattacattggggggttatgcctagggaagctggtcttgtgctcattgatccaagtggttgttggtttctttaagacctattaagttctttctcagcaattcagcattgaatgcctttatgatgcttaattctttaatgctttcctccaaatgtgatatttcttgcaggtgtaggcattttaagtgctagcgcaactgtgtccatcgtagtagttttacctagtgaaataagcaaaatatccaagttgatgtggttcatgtggaaatggagtgtaaatagatttcttagttaaaagtcatgcttgtttggcatggttttgccacttgtgttgaccatgctcagttggtttatccaaccaaagcattctgttgtactctggtagttccatactatgcattgtggcaatctgtttcatttaggttatcttttgttcacaaaattttggctatttttctgctttaccagagattcctaagtttgttggtttagtttttgtactcttagttataccacttgtttatacaccctaatttctcgggttgatctaccttctgattagatatcatttttgtgtcactgcaagtacaagatgctatcgaattagagttactcggctatttgtattatggcatcaagtccaatttcgattgattttgaatgatatctgcttcataggtgaagaaaatctgtccttgttcaaaagtttttcaatttgggtgtcctacctatatatgatccagttgtaaaaaggctgactaagggca

SEQ ID NO: 18323 - DNA, 1501 bp, Oryza sativa
  unsure (1)..(1501): unsure at all n locations
ttgaatctaggtgaagtgagagtgtgagagtacataattggcgccatccatggcggcattaagccagctggtactggtcgccgtcgtctcattggttgccttgctcccactgggcatggcggcgacgacgtatgatcccatcggcagcttctgctcggagacgtggatgaactacggcgatnncnncagnagagaggnngtcanaacgattgcgcnccnncccctggnngtaagggacccnnncactaanncgcgcnccgncgccgnactcgccactcacaagagcggcaagaggctcnnaggtttttnnacggcctcgcgcagttgccgcggcgacgttctccggcggcgactgcgacgcctgcctcgcccaatccgccaaaaagggggccccccccaaaaaaggggaaaaaattttgggggggggttttcccccttncccccaaaaatcctggccaaactacccaccatccagaacttcccagaatttggtatctatggattctaattctacatgtcatctacacacatgagtgacactgtatcattctagtagatttcaggccggttgtttaatatatttctttcgtttatgtgtgcttgtggcatgtaggtacgagtactgcttcatgcggtactacagcagctacaacttcatcggggatgtggacacgagggaggacgcaagcgtgaccttgaggagatggccggacatggacaacccaaaggcgttccaaaaggtggtggggaaggcgatggtaaaagcaacaacacaggctgtctcggtgggtggcaacggtctgggcagggcgaaggagcagtacacgccgttcgtgagcgtctacgcgctggcccagtgcacacgagaccttgcaccgcctgcgtgtgctcagtgcctatcttcgacagtgtccaagtttgacaaggcttgtggcgctgcgcaggggtgccaaatcgactatagcagctgttgggcacgctacgaaatctaccccttctatttcccactcgaagccaacggccgtgccactattgatatgaacaagtacactaaagttaccatgcactgaataaatctagcatacatatgctacgcatatagtacggtaagcatgcgtacatacatcgcgtagcactttaatttcacgaatatgcactagctgcagtttgtttggaatgaataaagatgtgtactgagtatgttgtacacttaagtgaatcgaatatctctttatcattattttgccacaatatattaattggccaagttcgtcaaccattcataatgagcgccgcaatagtgtgaatgggaatatttggtcgagttaatttgatatagatgtgaacagtgacggacgtaggaattcatggccggatattcacactttaaaaaaatgttttatacaaaacacaaatgttgaggaggataatacatattaaattacaatagtgacataaatcatataggaataatatattataaaaatctcgagaatttgag

SEQ ID NO: 18324 - DNA, 1501 bp, Oryza sativa
accatatcgtctggcaggatatccgggtactggtgctggttggagttgtttgcgtaaaccattaggacatcatcgtaaaccgagcgcatgactgttaaaatgacattgatacccttctgtagagtttatgcacaatgcataaagccttaatgcgttgggagaggaaacacccttccaggcgtcggatgtggacgtgtggagtgctctccttacctgaccgcattgaagaatgtatgaaataagaaagaagaaaggaaacggcaaaacataatgattattgtatctttgtgtctttactacatttgtatttgtcctttttctctccttttctctttatttctctttttcttaaaaaaattggcataggtaaggataaaatcaaaatatcaattttaaccatgtatgcaaggcaagtatggtgcggcattctaagttatcgtttttagcgggtatatggattatattaagttacatgataaactttaaagtctttttgaataatataaaatatcaggaccaaatagaacctaaagtataagttgaaggaccttacaagcgattcaccccaaaacaaattagtacttggagggatagacacggatccctctgggtaaaaaggaagacaaaagaggatcctctacttaattctgacgtaggtcactgacagagtagatccacatgtcagtgactcaaagttggaaggaagtaagtcaatggatctcaatccgaggaaggcacacaatctcagtttgttctaacgtcatacaaatataactttggatacaagcatatctaacaccctaacctaaacgcttcaacttactacataatattgttcatataacttctgaggttgttttggacatgctgatttccgtatacagatacttaataaggttttggttaacaaagatgataaattttcacttcattaatccttgatcctcgattattgtcattgtatcgatcctccgttattggtgtaaaaaagagtctaagggagaatttgacatatatcttgaatatatttattcctcggtccaaagataacttcatttctaacctgaacagtttattctaaaataagttcatttctagcctattataaatcttatttcttttataccttttattctaaaacactcgtaatactgtttttttgttgatgaaaaataagttcacttttatcctgttataagttttattccttcaatacctttacctatctatctactcatcaatactgttttaagttttactccttcaatgtcctttatctatctatccattcatcagaatggaatgctatttttatgttgataaggagactttggtcttttctctcgaccttagtttgaacacccaagactaaaaatagagttattttcggatagtgggagtgtcacgtcactaaattcatctattgtacatgtaaaattagataaaaccgaataaaataattagataaaagttacttttagcggttatacgaacagtacta

SEQ ID NO: 18325 - DNA, 1501 bp, Oryza sativa; identical to SEQ ID NO: 18278

SEQ ID NO: 18326 - DNA, 1501 bp, Oryza sativa
ccacacctcatcagttattctgcgttatccctcaaaaagtttgggggttcaaccgaaacagggttagatctccctctgcctagctccacctactttcaagttgttaattttgatttccgtttttagcagatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcattaatctaatttaactttttttctttatcaggttataaattttctaagacatttgtgccacttggcatgaatctaatttaacattctttctttatcaggttataaattgaaaccattgaatgtactttgtcttcccgtctctaaaacattgtgatatatctataatattttaatatttttaagtttaaaaataatttagactaataatatagatatttaaattaggtaattaataaattcaaatcaactatagtttagaataaaaaaacaaaataatatatgccaagtacaatctaataacaatagaatgttagaaacaatatgaattcaatatttttataaattttaagtacgattcatacataaaattaaagaaaaatataaatttatatataagtgagaacataataaaatgcaagttaaaattattaaaggaaaaatattattaataaacaatgatgttgatgtatttctaaatattttcacgtattatttattaagtgtcaatgattgaaatggatgatttaccatgtaacagattaattattaaaattatattgttttcatccgttacaatgcacgggcattttactagtctatataattgatcgctctatcaataaaccttaatatcgacaagtaaccacaacgttaagccattgatcgacaacctaaaagctacaactgaccataaatttcactggcttagatgagatgtaaacacataaataaaccataaaaaacgagaattcggagatgatggcaccccaagtccccaactccaaaccattttccggacaaaaaaaaaacattcaactctaaaccacagactcatgagaccatgtaactcaagcaaatctgactaacaaagataactcgaaatcaaatcgagaaataaatgcagatttgctaaaaagacgtgtgtgaaccggtcccaaattctcacaaatctgatccatgaaaatctgcagccgttatgaacttccaaatttggttccaaactctgaacttttgctcgccctactaacccccctcacaaatcgcccaaaatccgaacgacgccgccgccggaatccgccaccgccgccgacggaagcaagggcaggtcaggccgtcgtcgggagggggggagaggagaggcgcatggcgaagctgg

SEQ ID NO: 18327 - DNA, 1501 bp, Oryza sativa
gcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaagatgggccccactagtaggaaccataaatcatctcaaaaagagtaagtggtattcttatatagcacacattttttaaggatatatacatgtttcccacaaatgtttcaaacacatatagtgatatatttaaatccgacaacatttgaattgaagtgtggcaccgaatgaagccaaaccaccccgatatccacagcgcaaccgctccatcactgcctctgcctctgcctctgcctttgcctctcccgctgttgccaactccagagttgccaaggaaaggccatcttcatcaactgctggtgaaggtgaaccacaggaaacggtgctaaagcttccaagcatcccaacacttcctgcacggatggcaaagttgg

SEQ ID NO: 18328 - DNA, 946 bp, Oryza sativa
tgctctcgaaacagtatgttaaattcttggatggagggagcacaatataaaatatattataccccataatttgctgcgaaaacatggataaatgtgttttaaatactttagaatgatggatgctcatatgttgaaatatttcaaaatgatgtggaatagtaatttaacatgcttgcatattgagctcgagaatataataaataaatgataaactagatgatggcccacactttgatgtgaaatttatggataaaagtatattaaatattataaaaataatggatgattatatgttaaaatattttagaatgatactttgacatacttacattgagctatagaatgtaataatttataggtgatgtgacaagtttgcctgagatttaagatataatttcttcctcttcctgtttccccctccactatctccttctctctccatagagatccaacggggctcgagcccccctccctcccctccctctaaggccacgctggatctgtccctgcttatgagtaacaatttgattcaatactacaattagagtgccactattttagccatacataaccatattctttgagaacttaaattttttttatagctgacttcacagaggtgtgcctcatctagccctatcaagtagttgccaaatgaggagtcaagtagttgccacacagggagagaaataatgtctttggtggtgacttcgactctaactcatgaactataaaaaaaaataaagtaatgaaaatagtttacatgtaaaacttttatgtctatgttattagcagtaagttaatgttgaaaaatataccgcaatgaaaaaaaagtcaacattaagttctagaaataaaattttggttatgacacatatataagctaacaattcaagcagaagatgagactcgttcaaacaatctgcttacaacttaattatgacta

SEQ ID NO: 18329 - DNA, 1501 bp, Oryza sativa
ttaagtttgggccgaaaagagacttgcgtctcgattcgactttaagagatgtttttcaacagctcatttggtaatgtactgacctcccgggtcagatcattacttctcggctcccagagccattccacttgattaatcggctcccagagcctttttcattttctcggactcccagagtccagctgcccagcagcaaagcaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacctggtttggctccaaccgaccccgccctggcgttcccaactattggcatgcgaggtttccctgaaccgactagttacttagccagggtgtcccattccaccttgtggttgcactttgattatgttcgatgagtttcccacaggaatcggtccttatatgtgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggttatttggtatacgcgctcagagagcacgaataccgaggtaccacaagggtggagagacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacaaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttatgtgaatactggaagttgaacggagtcaatcggacgagcggttggggagatatggatttcctaagattatttggattttctgtctaaaggaaaaggatttatcaaatcctttggaaaagaaaaggaaggaggga

SEQ ID NO: 18330 - DNA, 1501 bp, Oryza sativa
gtagtggcagcagcagcatcagacgcctcctttgcgaccttctctttcagggacgccgccacctgatggtccgcgagcggcccgatgatgtcagtcagaggaagagcctacgcttaatcaagtcataaggtgatctcgaaggaaaaatgcgcgatgcttatcggatgcacttacgttgatagcatcatcacgttcggccgcccccttttcacaaaggggcgtggggatgttgctcgccattgtcagaccgctgatcatcacctggccaacacggcgctccacggcttcgctattcagacctgtgaatcgagaaccaaatttcaatgagtcaataagaacgcgaacataagcatgtcaggataaatgcgagaaagatacctcgaggagaaacccgggtcgcgtcctccggtccagaatagttataagcgggatgggcctgagcctggagcggctggattcgcctaccaacgaagtctgcaacgacttcataccctgacaagcctcgtactcggagatcatcgatgatgttgataaacgactgaaggggggctttgcggtccaagacgaaatcttgtccggttgttctttgggaacaacgaagacagggttcgaatctttgatctcaaggtagaaccacctattccgccatttgctgcgagaagatgggcactggaaggagatataacgcgacttcaggccatcccgaagtcggaacccgacgcaaccagctaccctgttggactccatccaacgcagttcatagtaagagcgaaagagatcaagaaaaggctctaccccaatgtaggcctcacaaagatgcgcaaagatgctaagaaaggcgatagaagttcaaaaccaggagaagaaactcggaaggcggaggaagaaaaccgtagagaacataatcttcgatcgtaaccatgtgacccaagatgggctagggattagtacctcctacttccctctccatggttccacggccaggaagggcaccgtcttcctgacgcttcttcagcgacgcactggtggaagatgatttgccgaggtccattgctgatcgaagatcgccggagaaagggcttaggttgatgaactggggtttcttgtgccggcgaagaaggcgaagatcgctcacaggtggaatgttttcaacacggttggcggacttcaaaatggatccccaaaatttctttaaataggcgcactaccgacggtgcgaattccaaggaacagagagagatgcccgccagaaatttctgggtccgttacgcgcggcggttttttggacttcagtttaaaattcgctcgtgaccgttgggcttcaaatggcgtgctcgactacggcctgtctctgcggtcctcgcaccgggaacgacaacagtttcgacacccgaagtcgtgaatggttacacgagctcattttaagcggaagtcgggggctactgtcagggttacgggttaggcataccctttacccttcgatatacgtcacatatcggta

SEQ ID NO: 18331 - DNA, 1501 bp, Oryza sativa
cttactactgcattgtgaaagtggtaaatagctagtgccaagtcataggcttattattaggatataagcaatttaagttgagtctcaccttgtttattttattgtggcaattctcatgttagacataggttgaactttttttttaaaagatgggcccaccttattttccactctacacatgcatatggattgaaatcctctaacgtaactttcctctgacgtggtgactaacatatggggtccgagagtgatgaagtgaatagtaacgtcacgatgaatggtaacatcaaaggatttgcttctcatgggcacatcgtggtctttccaacctgctaacgccacttgacacggttcaccttactgcctagttggatcgtaaacattgaggatgcccgaaaggggtgagataaagcagtaaaacgacaaagatattttcatcaaaattaattaaaaccagcagatacttgtgcagatctgaacacggcgatctctttctgactcttcatccttgtgacaggaacaagcagctaattaagctagcgtcgtactccacagtagtggtagttaacagccggtctgaacacataggcaagaattcaacgacccggcccagcaatagcagcttattgatgcaccgaattaagcaacaattatatatatctggatccaacaataattcatccgatcaactaattactaatattgcgggccatccgatcctgaccgttgaatcgggcgatccgatggtcaggattcagtccagggtgatgatgatgatgatgatcctgatcctgatcttcctcctcgatcgacatcttcccgacattgtcaacatctctttcgatcggtcgatctgtagctgctcctgctgttacgcttgctagctactccctccgtttctaaacgtttgacaccgttgatttttttaagtacatgtttaaccgttcgtcttatttaaaaaaattatgaaatatataaaactatatgtataaatgaaagtatatttaacaatgaatcaaatgataggaaaagaattaataattatttaattttttgaataagacgaatggtcaaacatgttttaaaagttaatggtgttaaatatttagaaacggatagagtatatatcatcaacccccagtaccattaatggaggaccactagctagctgggtcttacattgcatgcagcagcagcttgctaggccattcgatcgatcgatcgatcatatatatatatggatgagctacctacactgatatgatccaccacaattaatgtgctcgagacgacgcagcaacaaccgccgcgccattgatgactaattgagatcgatcgatagatagtataagagatcgaccacgagctctcgatcagcctagctatagctatagatagatatacaatctctctctctctctctctctctctctctctctctctgattgttctcttctgcttgcctcttccatggagtgggctcgaggtccagccatggcgg

SEQ ID NO: 18332 - DNA, 1501 bp, Oryza sativa
ttgtgtaagcagtaaacttcccacctagataatttatgaataataaagaaactttctacttacaaactttgcaaaggactttaagaaaaaaaacttctattataatacattttatagatgttttacattgaattgaaaaaacaagttagaaaggaaaaagaaatattctatgcactttctgtttactgggcctaaattggcaattgaaataggcccaatatgcaagcgcaggattcgtgcaagctgagtgtacggatgcatgtatatcatttaggagataaatcatcattagcgttagacaaaaacggtatggcgccaaattcgcacgaggtttggaattggatcgatgcacgtgttcgcaattagattctctttttttttttgcgggggcaattagattctcgatcggtgggctactgggttttgggctgtttggctgcagaaacaggagactatatacagtggattttgcctaagaatcaactagtatttgcaaattggcaaaatcattggatagtgtatttgcttttcatccaaccagattcagcgaaaacaaactcaatcaaactatacagtgtcctgcaacgctgcaaccgaatagtttttcagctttttcatcttcactcatcactaatatatatatatatatatgggctcttcagtgaagtgagagtataactcaactggttagatttcttatgctggaactaagctatctggattcaaattctcgatttgacgtgggtgctcgcacttacagctaattattctttcagtatagacgattaacccgtcgacaacaatagctagttttttagagcatgtgcgtgtgtatctttataagggtgagcgtgcgaactaattgtgagtgcttacatttatgttgtgtttctcaatatatatgggctgtttagttttggattgattgagcaatgtaatataagtaaattgaccacttaatcctaaatatatgcatggtttgtttggttgaagaagagtgaagagacatgataggtttatccaatccatcacctcatccctcaaaagtcaaaactagtgacagccagcccacaagaaatggtactagcaagcaagcaggcagccagcagccagctcagccagctagcttagctagtccgcgatatctgcaagagtgtcatccgtacgtgcaataatatagcttcgcgcccacagttctaatcactgcatgtctgcatgcaaacctttagaacagtagtagtcaaaaacaagtttgcaaacaattagaacaaggattttgaaacctgttcgcctgcagttaacatactgcaactctgcaagcacattgatcaatcgatcaatccctccttccccatccaatcctccctctatataaactccaaccattcgatcccaatcaaacacaagctaaagccatcctcctctactgaaatctctagctactactactgctactccagtagcaacaagaggctgaattgagagcaattggcgccatcca

SEQ ID NO: 18333 - DNA, 1501 bp, Oryza sativa
ctgctccccatcttcatctagcacctagctccctctgctggcgcaccgcacacactttcctctacctccagcagccggcacacgctttcctctacctccggctgccggcacacactatcctctccttccagccaccaccgcaccccagctcagtttgtcagcaaacacacccaaagctccagtctccaccaacagacagctgaagctagtggcacgcgatagcgatcagacctatggaacactacacatgcttgtggccggagatgagctaagaggaacaagattggggcaaatttgcatcacctgtggcaaaggggtgtataaactattgaggaatttttgcaggccaacgatttcattcattgcaaatgtgattacacacatcaaccccttcgcgaaggaacaaccaatttttctcctatcgcaacaacatgaaccatcgaactagacagacaggctccacgtgtactgaaataccccgaatcgtcagccagcagcgaccagggaacacgatggactcctaacggcgggatcctcgcaaaaaccctaggttagggccgcggcttgggcgccgcctcgtgaccaagcaagaaacgataattccccccaagtcgcggcgagggaaagccaactaactaatcgaagatccggagcgggctctgagcccatctacggcgattaaacttaccccgggtcggagagatatccccggcacggctagtcggcgacggggagacgaggacgacgaggagcaccgccgcggcgccgccggagcggggagagaaagaggagagaactgcgcggtggcacttttccacggagcccctcggatttcctctttatttaggagcgcccatcgagccgagacgagagtgcgtgctggccgcgtgggacactgcgctgtggggcccactagctgtttgccgctgacgggtggggccacgcagccagcgcgaatcgtaaagcacgcggaccccgtctcctttttcatacatatcctcctctcgctctcgccccgctcgcttccgaagcttctcgagccctcctcctccgccgccgccgccgccgcctccgcctcgccgccggcgcagagtcgcaggttagctccgtactccgctcccctccccgaaccaagccgacgccgctgctggaatcctagtactcctgcgcgagttctagcgtgctctctctctctcccgtcccgtgccgttgcgtcctcgcgctttagttctctcggttgagcgagtgcgcgagtgttctgcttggttctccggtagatttggtagcccgcgatcatatctcctaggttttttttttccttcggttgagcggggcagcaattgaattcgtggtcgtcagggtttctgagagctggagatgcagtgctatgcttggtttgttttgctgtttgcgtgttatcgttacgtggcttgacgctacggccattgttggatttgtgcgtgctaatttagctgacttgatgtttgtctgtcaggaacga

SEQ ID NO: 18334 - DNA, 594 bp, Oryza sativa
cccccccccccccccccccccgcggtccggcaaatattcaatttttttcaaatattgtgagaatttgatcataatttattcaaattcagtaaaaatgtattaatttttttaaaaaataatcgttagaaatatccgaaatttctattcaaaaccctgtggcaaaagtagtccctgaaaagcaggtcggcagcgagctagtccacgatatccgcgacgcaagtctgcaagagtaacattcgtgcccacacgctgccagtgcatggacgagcatggctcatggctgactcgacattagaaaccattagaatagtcaaaacaagtctgcaataaggattatgatactatgtcctgtactattccctgcatcgcaagcacatgatatcgatctctcttaattaatttcccatccaatccagtgcgcgcgcttgatcgatcgtcttaatttataagctccaaccactgctcccgattgaacccaagccagccacacacatctgctcacatctctagctactactccagtagctggcaagaaggtgaagtgagagtgtgagaagtaattggagctagcatccatggcgtcaccaagcagaa

SEQ ID NO: 18335 - DNA, 1501 bp, Oryza sativa
gtcgtaccgcatgaagcaatactcatacctacatgtacatatatacatcccgcataagtacataaacaactagaaaattaaacaaccaatgtgaaatctataatttatcacccatgtgtactctctggttccattattttgtcgctttggataataacacggtctcaaaaacatatgtttagctatgatttttattatagcatattatctccatcctaaaatataacaacttttacttataaatctaaacaaaacttatcccaacttatagctaaaaatatttatattttaaaacgaagtcagtacacacaaataagtaaaattttaatattattaaagtattttctaagactaatctatgtgttgcgttctagctagcattctcaaattaaactaaatattttgaaaagaatgacggtcaaagtttaaactgttttcaaatgttaagaattatgtaaccgaagagattacataacatgcagaattaggatccacagagtatacatgtgtaccatagcctggagtctgatgtatagttgcagtaggagaccatctgcttggcggcttgggcgaggcaggcgtcgcagtcgccgccggagacgtcgccgcggcactgcgcgaggccgtagaaggcgtcgtaccccctgccggccttggaggtggcgaatccgccgccggtgcgcgccttggcgacaaggtcggagacgacgaagttgatgctccgccgcctgacgacggcatcgctgccgttgagatcgccgtagttcatccccggctcccagcagaagctgccgatgggatacgtcgtcgtcgtcgccgccatggccagtgggagcaatgcagcggccaagaagactgtaagtagcagctggcttaatgccgccatggatggcgccaattgctctcaattcagcctcttgttgctactggagtagcagtagtagtagctagagatttcagtagaggaggatggctttagcttgtgtttgattgggatcgaatggttggagtttatatagagggaggattggatggggaaggagggattgatcgattgatcaatgtgcttgcagagttgcagtatgttaactgcaggcgaacaggtttcaaaatccttgttctaattgtttgcaaacttgtttttgactactactgttctaaaggtttgcatgcagacatgcagtgattagaactgtgggcgcgaagctatattattgcacgtacggatgacactcttgcagatatcgcggactagctaagctagctggctgagctggctgctggctgcctgcttgcttgctagtaccatttcttgtgggctggctgtcactagttttgacttttgagggatgaggtgatggattggataaacctatcatgtctcttcactcttcttcaaccaaacaaaccatgcatatatttaggattaagtggtcaatttacttatattacattgctcaatcaatccaaaactaaacagcccatatatattgagaaacac

SEQ ID NO: 18336 - DNA, 1501 bp, Oryza sativa
cgttattatcacctcattttgcgtaaaatacttaatcttcatcttcatcttcatcttcattttcaggagattcaaacaccacctttgtatcttaataaaaaaagtttggaccatttttatggaattggataactttttaagttacgtgcatgcggtttagatcagaatgaagagtcgccaattaggacacttccaatacaagtttcgttctactattaaattaggtactactccatatcagtaatttggatgatgtgtaaaaaataataatgaagtgagagatgaaatgggtttgtatcttagatgaaaccttctatacgctgtttccttatatgtattgcctataaaaccacaaacatgaaacaatgtgttatcatattagctattttagtcatcaattaaaattaccttgttgcattggggatggctctagtatagtacagttgtgaaaaaaaagaagtgggttactaaaataaaataagaggcttgtacgaacgacagagactagccaataataacttaaaaagtttttagtcgaaactgaaatgtatataataaatataatttagttgtatacaactcacatgcatttatatctcgagcggtaggggcaactgcgtacaaaagattattatattaaagtaagactaaaagaaaccatagttctcatttgacggtacaagcgtacgttgacacatagttgatctaatcgactaggtcagacctgatccttatgaacgtataacttagagaaaatcccctacgtacacatgaaagttcacctaatcccttctatacctctgaattttgctcaatcccttacatacccctaaattttagtttggatctcttccatgccctttccgctagttgacagttagttgaccgttaaattcttttgaaaaagtccattttgccctttcctatgaagaaacataataaattaatgaagtacattgttggaatgtaaaaatttactggatgagactattatatttatgagtctgtgatgcaccatattatttgtgacaaatttacttttacatatgatataaaaatttaatacttatttattagttattaaaagttcttttatgtagcatatgtgttttcatagtaatataacatatttgtttattactatcagaacacatatgctaaaaaaataaataagaattaactttttatgtcatatctaaaagtatatttatcgcaaataatatggtgcataactatctcataaacataatagtctcatataacacatttctatgctccaacaatatactatattaatttatatgcttctttataccaaagggcaaaatggactttttcataagaatttaacggtcaactaacggtcaactagcggaaagggcatggaagggatccaaactaaaattcaggggtatccaagggattgagcaaaattcaagggtatagaagagattaggtgaactttcaggggtacacaggggattttctccataacttaaga

SEQ ID NO: 18337 - DNA, 356 bp, Oryza sativa
attcgtctcgcgatttcccctctaactgtgcaattagttttatttaaatatatatttaatgctcaatgcatgtgtccaaagattcgatgtgatgctcttaggaaaattttttgggggaactaaaccaggccttaggtcgacgccatgtgttactaccataatccctcatgttccgcgtgcacgcttttcaaactgttaaacggtacgttttagcaaaaagtttctataggaaaattgcttaaaaaatcatattgatctattttttgaaaaaaatagcgaatacttaattaatcacgcgctaatggagtgcttcgttttccgtacgcgagatatgtgttgccaacctagctgccgaa

SEQ ID NO: 18338 - DNA, 1501 bp, Oryza sativa
cttcgggacagcagcaagttaccccagcattgacagcctgcagatcgaccacaagccggcgactgcggcgggacgccagttcggctcggcctcctctcctcctcctccgccgccgccgcctccgaaccatccccaacgtcatcccctccgagcacggccgcgccgccgaccacgcgggcttcctcgacgccgtcgaccctctcctgaatctctctctctctctctctctctctctctttctgaatcacccacatacgaatcaatttagagatttacccccattgttgcatctattaactgatgagttaggagatttactgaatctgatttctgcctgttcagtagataaggtattgatgaagcagcttggatgctaaggcagtgtttggcaaatgtctaagggaaataatttctcacccctctttaaatcttaaccattcattctccctcatacatttaatcctaactcttcattcatttcccaatcccaatctcacccctcatttcccattatccaaacacaccctaaagggttgaggcacacccatatattgcagtagtatatttttataatggaaatgtgttaaggggtaagtcaacatgtaccatacctttagataattttgtatcatttgcctgtacaatgcaaatcatggaagttttgctgtaatttttgtcattggtttttcatgaatttagggtgagttcagcaagttataaggttgatcagaattactgccacttatggcattaaactttaagtttgaatggcaaggggtgtgggctggcagcatgatttgaataattcctcctaaggccacaaaacaattggtcttcccagtttggttggttggtggtccgaggatgaaaatcaattagaattttgtgtatggagttttttctttgaattttgagtatttatcatttttcgttgttgatgagtgaatgttagtatcaagtattagtgatagcaagattaacaaaccgcgctaccagctcaacattgttcctcaatcactgtctgtgttgtcactgccttatcgacttggcaatggaaaacaatatatcaaaagtattttgtgttgtagatattttcttaatcattatagattatgaattactaggacttacatatatatatatatatatatatatatatatatatatatatatatatatatatatatatatatgtatgtatattctagacctaggtcatatttacacaatacacgtagataaatagattcttatacttataatatgctcaattcaatttatgttgagcacaacgtgccttgcacgtgcatattcactagttaatataaggaacgggtgggacccacgcggaacgaccacgcgtccagatcagatacacacagagcggatcggacggtccgagatttaaccaaattattaacaattattaattcacccgattaattagcgctaattgtaatcggattcggagtctaatctggcagcgcacgggtgggcgcgc

SEQ ID NO: 18339 - DNA, 1501 bp, Oryza sativa
gtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgcaagcttggtttattttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgctcctttttatgctcagattcctcatgatcgtcatgaagagaagtgccgagtcaaagtcaccttgaacagtaatagtgaagatgtcccctcagtgatgttcgaagctagaggaagaaactacaccatgcatgtcaggaggtggcaaggatcgccataggagagctccgcgatcgctatagtgatcagttggccgacactgagtatcgctaccatcctcgccaaccccagggaagtgaccgtggcagctacctagagactgaaggaattgagaatgatgctaccacaaggcatttggttgagatgctgtgggctgtggatgaaacccgtgcggagactgtattagcagctcaagatcgtgaagaccggaatcgtggaaagatttgcaagctagaggacaaggtggatcgtttggagaaggaattagccgcattgaagggagaagcaccaccgcagaaggccaggattcgtcttaccgcaaggaagagagctctttttgtccctcgctaccaattggcgccaaaggtccgtgtggtggaaaaagaagttaccccagttctagtagatcctccggtcatcaacgtaagtgatgatgaaggagaagaatcgaagcacactcattccaagattgagtggagagcaactcaagatgatgaagacgagccgaacgagccttcaatcaactccgatgcccggaagaactagaatgccatgtcaagccgttgtcttagatcgttgtgttagcttgtttgtttaagtttggttgtgtgggtcttgcgtgtaatttacatcagtggtgggatgtaagtgcatgcgtttgtttgcttctgagtgttaggaagttggtgagtttagtggtgtgagagtcttcagttttgtaataatgaaactcacttaagatcaataaaagttaaagtaattctctgtcctaa

SEQ ID NO: 18340 - DNA, 1501 bp, Oryza sativa
  unsure (1)..(1501): unsure at all n locations
atatattacatactccctccgtcctataaaaaactagtactggatgtgacacatcctcatcacattctaatactattaatctggatatacttttgtttagattcattgtattagaatatgtcacatcctgtactagattcgttttttcggaatagagggagtacactttattcattcacgaatcttgaaaagggattattattgcaaagaatgtctagtattgtagctggaaaaggtagaacattttccaaacacaatttggcgcacatatgcgcgccacatgtaagtttcaatattcccagtgagaatcaactgcccatagtcttaaaaaaaaccgcccacaacatgatcatctccttgcctgctttaccaatattcttagctgacctgaaaggttattatcttgtcttttgaagggtataagaaaattgtcttgcaaaattgactcagttataaaatccatgattaatatcgaactgaaaagttttcaggtattcacttcggaaaaaatatacctgaaaagttttcgcaaagggaataaaatacggtatcaaagtttagttcccctacccttacggactactcctttcgtttcaagttataagacgttttgactttggtcaaagtcaaactgcttttaagtttaacaaactttgtagaaaaaaataataaaatttgcaacccaagacaaattgattatgaaaatatattaattattgatttgatgaaactaatttagtattataaatattacaatatttgtctataaacttagtcaagcttaaaacagttngacttngaccanagtcaaaacgtcttttaaaacggtcaaaaacgtcttttaagacggagggagtattcattatcacgggcaaacagtacgatttttcctagtatttcttagaattattttttaaaatcaaaactttaactttaatttataataatatgttgttattcgttttaagcggcagtttcagccataatccataacaactttagaacacatagagtttgaggaaactccaaccatagtatataattttttgtcgatttcaaacaataccataaaatttcgatttcaagggtatcaattaatatcacatattgaaccaaaattatagcgcagtactacttttattgtcccattagaaagtcgtatggaacttatcacaaacatacatcgtaagctccacgttagttatagaatttcgagctccttcgaaacgcagaaattccacagaaatcagtccaattcccacgaaattcccgcaaaattcctccattccaaaggcggccttgatacgttcatttcgaaagggaaaagttccatgttctaaatcaagactacagctcacatgctttagggctttacatccatttaatttccctgtagttgcaaggccaaaagatcaagagaacacatcagattgactcagcaatccaaaaacaagcaatgatccaaacatatcttcactgtcacgatgcatctgtctgcatt

SEQ ID NO: 18341 - DNA, 1501 bp, Oryza sativa
gtggatctctagctatttagggttgttggtctagctagatagctatatctttctctctctctagtactggtgtgtgcatatatttgtatatgctctgagggagagggagaggatgatgatccctggccggaacatgtcgccggcgatgatcggccggcccaacggcggcggcggcggcggcggcgtcgcctacgcttcttcttcctcggcgctctccctcggccaggtatagtagtagtgtcagatgtgttggtgaaggattatttgtgttcaaatccgtttgatttgatttgtttggtacttagctcttataatgctttgctttcttgttaatttgtgatgatccttctgaattaatcctttgcatatatgtggtaaatcctagaaattaattactgcctttgctgtgctgatttcctgcacttaagtgttctccaccagtaagtgctaagtacctcttgttatttggtgtgtgcctgtcaggcaggctgtcacactgtcatctatcactaattaactcacttcctatgatgaatgtattcaattgtacataccatttacatatatggagttaggccagagagagtgtttagttttcagaaagcgaatgcatttaagtagggattaataaataccaaaagggggatccattcatatacatgagctacttgagctacatacctgatgagaaaaatgtatacatggagcatgcatattaatattggctttgtgtgtctctctgcacttgctgcacttgtaaaggagtagtgatgatgtgcaaaattaaacagcttcagtagtacatatgcaccctactctcttgtgcatagcattaacttgtgccatcctttatttctcaagctgtgttcctccctaatttaggtgctcctttttctcaatcctattttgcaaaacatttattgctttgctacccctggatgaaccggatttttgcacactgtttcctagtcagactcagcactagtaccgctgttgttaatttctcttggtcctatctcatttcaaatgctcaatttcaaacttccccggttttattttacttcagaagctaaacagtgaaattattaagcaattttccctagataatatatccagaattataactctcccttgcattagcttgtttattttgatgtgtgcaagcgcaggagagataatgtgtgtctccctagttagtttctttttaatctttagaaaataaactttacctatcagatttttagtacaagttaattagaacagcaagaagtcaccaatgtcatactccacaactagatatagatcaaaatcacttgtctgcatctccaatataatacatatataatgtaatccaaattatattcacacctagtcttacttaagctgaattacagatatatatgctcgatcatatcatgaaactgcacacagtgcatattttctagaactctagctatatatgaacaattatttgctactctttctgcaatattatccttga

SEQ ID NO: 18342 - DNA, 1501 bp, Oryza sativa
tatttgcatgcaattctaagaatggaaaagcacatacaagcaagggaaacagccaacaatcaccacaaatgaaggaaacagaaagatgacacaaaagagaaccacaagtccacaacagcaagttaattaggggttcttcacttgggatctacatggtttgctaggagcccttctttcagaaggatggtctacagactgtattacgtcaatgcatggaacatcgagaacttaaggaaacatgacaagcaagcaaggttgacatactctacacatcaagaaacaacaggaacaggatggcactgtagtatagaaaccaacctgagagactcagaatgtgaaaggtgtccaagcctcacaacacagcatcggatcttccagcttaaatcacaggaccataccgcatttgcttttcatctgaaaaaaagaacgaagtttgtcatcattcgccagtacgccacataataaatcgtgtttgattagtattaataataggcacaacccaggtatttatccattaatctcatgaagaaaaaaaaatgtgaaaagaaccctaaacccaacgcggctcccgtatagagaacatacacatcaagacagaaatttccaatccagacacgagaaactgtcctagcaacatgaagatctaactcgtacgcagctatacctaatctaaccagaaagcaactccacatagtcaactcgaagaatggagaatacagacccaacagattgcaatccatccttagacccagccataaaagatctcagctttggggatgcaatcccaaacccctccaaatcccctaatctaacaaaatcaaccggtgctaatctgtcgcagacccacacccgagagtcccaacgcacccaaatcccggccaaagcagccaccaaccaagctcgcgagcgagcaagcagccgcccaaatcacgcccaatcgcaagggttcacctacgggagggaggaaaccctaggcgcgggatccgtacgggaggggaaaggggaagagggtgggaggggctcacctcgacggagcggatgccggagaggccgcctgacttcgccgccgtccgccgccgccgccgccgccgcagccagcgaaaaccctaattgggagaggtggaggagcagcagcgagcagagcacgcttcgaataacggaatagcgcagcgaaagcactggaaaaagggggaaaatattttattattattattaattaattaataaagcgaagcgagtttgggtttgtaattgggttggagttggatccgattgtttgatgggctgggcctccagtactggatggtatggccctccatttcgcagaattttaacagaatgaaattggaattcatgaaattcacaagatcttgccgtaatacggagaactaattgggcgctcctttttttaatcttgcgattataattgtgggttcagagaaaattcaggatgaagtaattacaaatttgacgaattgatcacaatgaattgaatgaattg

SEQ ID NO: 18343 - DNA, 1501 bp, Oryza sativa
gagacgcccgtactgagctgtcaccatcagcggcatgcaaatcacccaaagaatatacctccaaataatgataagtgataacctaaaccctatgcttaagttactacttattactctacagccttgcaatcggtgcagagcatctgagtccccgagccatagctctcggcctagccagagcagacttatgacccagtaatcagacattataccagcatcaatggaaatcccagaaggtttaaccacacagattatactacttatgaataaactaagactgatactcatactctatgattggaataaagtaccgaacttgtacaaagaagaatattatattgataaatggaagtcttacaaagaagaaaggaaaagctatagaacctttaccgaactccccgaagcctccacggacttggaactattctaactctactctactaacactaatactaactttgtagagagcttttatccttgcttgagtgtgtattgaaagtgaaggaggtgaggtccttttatagcacccaatgacggttgtagagcatgggaattgtcggaaatgccccgcaaccgccatcaggagttcatccggagcgtccacgccaaaggggaattgcccaacaggcctggtttttggcctgctgctttctcctcggcctcccttttgtcctggccaaaatgcgactggattgggctcaacaaggggtcggccgaccccctatggctcttctagcccccagcttccttcaggagacttccatgtgggcccctgaatcagtgacatacattctaggcccatttgtgattattaaattggacttttgggccttctcgtgtaattgtagatcaccggcagacttttgactgattgatcgatatatttccacctcgttctcttcatttatgaatgcttctcctgcataaatgttagtagcaaagcatatagtggaagtaattattttatttgggaattatgcattgcgagcatagctagtcttcatatattggataatattgatggtcgaaacttgtcgataacgactgtcaataatcccccccaagcttgaacctttgctcgtccacaaggaggtcaggggtggaaccagctccgctccaactaccaaggaggcagcgacaacaataacgatacattcaacaaccagccttccttgaaagatcttgtttttattcaggctaaaactaccggtgctctaagcaagaaactagctgccaatgacaagatcttagaaaacataaatgttaagctagatggctttgcttccgctttccaaaaccagctgagatttaataaaatgctagaaactcagctgacgcaactagctactctagtccctgctaatgagactgggaggattccagggcaacccgaaccctccatagaaaatgttaaggcaatcatcatgaggggaggaaaatcgacttaggatccaccgtatcttaacactgcatgaactaggaggaacagcgaggatacatc

SEQ ID NO: 18344 - DNA, 1501 bp, Oryza sativa
accaaactctccctcttacccaatcccctactcctcgtacagcgccgccgcttctcccctccactggcgtctctcctctccaccgccactatcggagaggcgattctctagcagcagggaagtgcagacgtgtcccctgatgaagattcaaccaggggttggctacaatcgatgtgtggaaatcacctaggatggggcacgagttccccacaatccaaccaataccaagaattatacaggtttaggccacccggaggtgtaatatactactcctaattttttgtgtttgctatctggatctagaaaaatacaaactatactttttcaagctaaactcaagcatccctttcttagtggcatatccccttccttttatagtccaaggaggggctcagattaccatttttgcttttcctctatgttctctcttggttgtcttgccactgccagttggtttccttccaatcttcttgaaaaacctaccaaaaatatgtgattaagttgccccaggctctccgggcattggtttgggccagctccatgtagctcgtggtgggcctaccgatccccaacctacccaaaatagtgccacagctcctttttgtccagttggaaaagtcgtgtgtcgctgggcatgcgcgacgcatgtacagacgcccgttgtccctaatcactcagcgttagtgtcttttccatgtcttttaccccaggccacttggagtttccctcttaaacctatttcatttatggcagtaaacgtttgcccatagctggtagaggggcacgttcactactcaacaaagccttctggttgtgccccttgtcctagaaaaggtagtttagttatttttggacgagcttcttgaagatgtctttgatgaaaagttgtaaatgtgtatatcttatatgtctcaactctcctctcaaggaaagagatgcatctcacaagggtataggagggaccaagtcccagaccaagctgtgacccagtttcctttgcctacaattttaagatatagattttatatgtctcgacactcctctcaaagatgagcatgtaacctacaaggacataggggggaccggatcccaagctggactaggattcaagctccccttggtttgtttgcttgagacataaatcttgcacgtctcaacactcttcttgaggaaagaggtgaaacatacatgagcaaaggtggggccgggtcccaggcaggccgggatctaggcttccctcagccttaatcttaagatgtatatcttgtaagtttcaacactcctctcaaggagggacgtgttatctataagggcaagggagggcctaggtcctgatacaggcttcctggccttcctcagccttccatcttaagatgtagatcttgtacgtttctacgcttctaccaaggaggaatgtgtaacatacaagggcaaatgagggcccgggtcccgggacagggtgggaccctggcctccctcagtcttcaatcttaaaatgtag

SEQ ID NO: 18345 - DNA, 1501 bp, Oryza sativa
ctataactggtaataatttgtttagctcctggtttggagttagatctgtacagctgggtatggctgttcaggatggttgggcctgtgcagcataggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacattattattatgatggatttgtatattaaattgtcagtttgtgtacctcggctgattcctggacgaggattttatgcacaaataagttcggaaattactagtgaatttccgggcgtgacaccgttcgcctccgtcgtctccaaaccgtctccgccgcgcccgttcgccatcgtcgtccccacgcctcgtcgcgtgatggtaaggatccgtcctctcgctgccccgtcctcgtcctttcggtgtcgtcccgtgcccgttgtgtggttgtcgaccccggtacccgtgtactggtgtctgtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtactcggtctactggggtcctttaggttgacatgtggggtctgcatgtcaacagcgcagccttcctgtcttttccaggctagcgcttacacatgttttataattgcaaaacctaatcacaataatccgtaaatctccatgtaacaacattaaacttcggatgatcatatcttggtcatacgaaccctgaatcgacccattcaagtctcctaatgtttgttataacataaagaaccggggtgctttctttttatgtattggtattgcttctttataggcttgtagctttgcttgtgtgcttcgcgtagcttctgtcgttccgaaggttctcgaagcgtagtttgcggtcgttgccgaaggttcggaaggccgttctctctgagcaaggcaagtcacatcatccttgagcatattgaatcccagtttataaaattattttgatttaaattaatgcatcatcgctttatttaaattcccgcgttatcactgttttatttagccatgcctatttacctttgttatgaccttattattattgctattgttattatcaccttgcttaccctaggcaaataaacccccaactagtgggtactctataagtagcaccccgg

SEQ ID NO: 18346 - DNA, 931 bp, Oryza sativa
caagtggctgccgcgtggggcccggccgtcagccgcccgcgctctcgggtgcggctgacgtgtggggcccacggcgccggccggtgtgagcccgggtgcgcccggtccaccgtggaccgtgaggctgccgcgtgggccccactcccgtggacccggtccgcgcgcctctccccctcggctgacgcaataaaccctttttaaactaaaatttaaatgaagaaattcgcaaatattcatttaaagagcatataaacttcaaatggccataacttggccatttgaactcagaattagaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctctttgtggaagttgaagccgacgtttgggaaagcgagcaaggcaagtcacatcatccttgaacatattggatcccatttttataaaattattttgatttaaattattgcattatcgctttacttaaactcccgcgttatcactgttttatttagccatgcctatttacctttgttatgaccttattattattgttattgatattattaacttgttcaccctagattaaacaaaaccccaactagtggacactctactcatggtaccactagtatgaatttagttagatgcttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgattgtagcacctcggccatataaggaccggt

SEQ ID NO: 18347 - DNA, 1501 bp, Oryza sativa
ggcttgtcttgacgtatgttggcttgtattggcttgaggctttgtggcgtctatggtgggtgtcttccatgctgggcgttgattgtcctctcctcctagggggtcttgtatttatacccataggtgttcctttgtccaagttgagctagggaaaccaatatggatacaatccgagtagtccttgtcgtttccatgtagaactctggttatccttccttatccggaactcctatatccgcacgttgtttccgtataagacatggtatgtggtgggtactgccgagatttactcaactactattaggtatgtgctatccataaaccctgatagtagccccccacttttatgcaaatgaacgaattcatattctcaaccgtgcgcagaccttggagtatctgagagaggcggctttttctctcctctgtgagtttagagttaacgttagacttcctttatcagcctcgtgcgggcacctaaagggttttgtctgagtcaatctctgacgtcaaccaagaaagtacagaatatacgactatgtctcccatcttgctgtaatcgagaatttggattgaagtcaagaaatcttatctcggcgagtacaccatctcttcattccgtattccttgttgagatccaccaactgttctcgagtgatcgagaaggcacagagcttgcaacgaaaccttgtcaacatttgttgtgctcgccttagtcgatcttggtgtgtagaaccatagagacatggagtcttcgtcaatgtcgaatagaattttcctgaaatcaatactcagaaaagaatattagatagaaatagcccccgagcgaatgctcaaagggtgacatgttataatatgtatagaaaattgaaaatgaattgaattttacagaccaatgttttgtatatgagcgtctactcttttaccgacttcgatcagtcagtttgttgagttatacactctccctagcccctagccttgtcgtcggagaatcgttctcggaagataaggctcttggacctttgacctgcctcggttgaacaagcactgatcctagcccccagtcgtgaagttggaaaacccaatttctgattatacggcttggttaatacgcacggcgagaactcttacacaaccagctcttacatggtcttttgtctctacaggattcgacaaggccttatcggctctgggcgtccctagccgaagttcccttaggttcctcggaggccttgtcaagacagcgtaaagggacatgaggataggtttgaacgctaggtgtcatcgtggtaagggatctctgggtaaaacacttggcaacattgtgtacttgatatcaactttgttgaggtaaaggtagtggaagatctcgctacccttctggtcgaggaccaggtagtagtcgtactcgactacttgaagtggaaatagtgggagaatcgctacaccactggtcgaggaccagatagtagtcgtaactcgaccactagaagtaaatgtacga

SEQ ID NO: 18348 - DNA, 468 bp, Oryza sativa
tcctttgttatggcctgtttgcattgattactttattccttgataccttgggttattataacttgactagttgagctttatatattggttgagctagatattagatatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacttttcgtatagcatggttcattgcagagcaccagactgagaagtggcggagataagcccacgggggtcgctggggagtccatgcctctggtttttga

SEQ ID NO: 18349 - DNA, 1501 bp, Oryza sativa
tctgtgtggttaaaccttctgggatttccattgatgctggtataatgtctgattactgggtcataagtctgctctggctaggccgagagctatggctcggggactcagatgctctgcaccgattgcaaggctgtagagtaataagtagtaacttaagcatagggtttaggttatcacttatcattatttggaggtatattctttgggtgatttgcatgccgctgatggtgacagctcagtacgggcgtctcccccgcagtttatattcctacatacaatttcctggggttggatacaccgccgtatcctacttcgattggagggttatgacaggttgtcataagaaactcggcaacccggggtaactttgcgatgcatcgggagggcatagctattcttgggcttagttatgttgcattgttaaaggggttatactacatagtgtatactagttagaatatactaagatgttgtatactagaagtataggaatagaacttatctaaattactaccacttagctataattaggagaatgtaggagttagctaaatccttagctgtgtgtcactcaacccttaagcttaacttacccctgcatagaccttgatgtatacatgtaatatataaactattaacatagtactctcttatcatatcttcccttgggataaaataaatacgataccttggaatactcccgggtgaaatgctacaatggtatatccgtgcgcttgcagatcacatctgtaaccataatatacctaggttatttctagtgctattgctgggaattatatttccagcagtgtcgctaagaaataccaatgagtatttctagcgccgttgccggggaagataaaagattaagagtttactacatgttaataattttatatgttacctccgtatagttattgtcctttgttggcaaaccttgtttgttttctcttttatatgaaaacagggtagtacaggactggttctgatctgccgaccaatttcatatctggagtcactggtgaagtgaagccgaccccgtgtcgttcatcctcaaggttactctatcggcaaccagaccagccaattccgcgccaccagaattgcacgatacggctgagaagtgtggacaccctgagtattataccatccagtgtccaacgcgaccaccacatactattggagaagtgggatccatacatgcataaatagccactcgtcctcaatgtgtccatgatcgcggttgacaaccttctgttataataaccgaaatgtcgagtagtgagtgcaagacataaccgtaagatagcttgccagtccaccacgtcatatgcccgtcaaccactcgaaggtggcgaccaaaagcataccccagtgactcgctatccccaattatttcaagcgatcaaaacccgttactcatgcttagctagtccccaggaatacgactatcctcacactttcatcgcaagcaattaataaacatagcaagtaccataat

SEQ ID NO: 18350 - DNA, 1501 bp, Oryza sativa
aaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaaccaacaaaacagtacaacaacaagcataaacagtatatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcagaaggaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaaaagctaaagtggttcatttgcataaagcgggcatttataaacagagattgaaagatttaaacagttgtaaaaattaagcagtattagtcatccactgtccaacgctacaccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccctctagccaagcacaccacacctcaggtttcacccccgtccccggcgggcaacgggcagtcccctctcgtgcctaggtgaatccggaagccgcataggccgtcgcagggcccatccaaactccatcacgcccacccttgcctggatgcgtcgactagagaaaagctacactacaagcccagccgttgcccacgctggcttgtggtaagtacgataagttcttcc

SEQ ID NO: 18351 - DNA, 1501 bp, Oryza sativa
tttccttttcccgaacgctagtgtattaatccccatcccaggagaagccggggtacaccaaacaaacatgatacaaaaggcacatctttattatatcgataatatttacattattacaaaggcacttcaggcctgacaaacaaaaataaacagcagcggactagcgggcctacggctccatcttcacaggcgctcaactgaggtataagccaggactccacctaggacttcttctccaaagcttctcttactggaggggggagagatagagcaagaatgagtacaaccaccgtactcagcaagtcacaccgggagatgcatgattaatgcaagggggtacaaggagtaataatataggggttaagtttcgcagtaaacagcatttaaaagtcacttagttgcccaaagctattttataaagactatcctagagctacacagtattattaatcaacgccgtggacccgcacgaacctgccttaacccaaggcctacgatgattcagaccgaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaatagatttactctgatcagaggtgtacatctttacccacaagacacatctttactccacattctatggccttggaacccgtcataaacatgtgacataacccttcacccatcctagccgtgaacaaaagtaccgacccaaccctgcctacggccagtatcccgggacaggcaggccaggattgagcccctagcaacaggatctagaccgggtgcgccacacacataggggtgagaccacccgcgtactagtccagtgccatggcatctcgactaacaggcaccgacccgtgtagccttcatttgcctagacatctcgattaccaagccgcagctcgtgtagccttcatttgcctcagagatatccatcgtcgcaacgacttcatccatctctatccgtgttcttttgttcaggactagactgagcaccgagttaagccttacccattagacatgtggttagtacggtagtgctttgcaacagaggcccgagcttaatccttatattggccggggtgctacttatagagtacccactagttgggggtttatttgcctagggtaagcaaggtgataataacaatagcaataataataaggtcataacaaaggtaaataggcatggctaaataaaacagtgataacgcgggaatttaaataaagcgatgatgcattaatttaaatcaaaataattttataaactgggattcaatatgctcaaggatgatgtgacttgccttgctcagagagaacggccttccgaaccttcggcaacgaccgcaaactacgcttcgagaaccttcggaacgacagaagctacgcgaagcacacaagcaaagctacaa

SEQ ID NO: 18352 - DNA, 1501 bp, Oryza sativa
tccatataactgactatagattctaaataagatcaaataatttgttatgttacaagcaaaagcattgtaaaaggtacggggcatttcctgccaagaacatcatatgcacatttacggtattggcaatatgatcaaacaggttgtaacaagaagaatgccttaaaataaagatgtgtccattagcagcacaatgataatataggtagatagcatatatattgatgccaggacgtatatagcacaatacaagtatataataatcgcacctatatgatagtattctacctctggaaatgtacagtttagctggcaaacttacaaaatgcactaaccaggccaaaatagcgatgcacttaattaatcactttagcgacttggttgcggccttgtgtttctgagtaaagtcacaaactgcacgcagcactgaagaaaggtaataaaatgggatagttataaacatcagtaataaagtggtttggttaaataaactattttcacactgaggaaactaaaaacggcatacctctcttttttcccttcattatatagaacaacatgatcctatgactaactaagctattttttaaaggcacatcagcatttttataagttgagttctaaacaaaaaccttaagaataataaagataatgattggctgttcataggatgacagatgaattacaatgtagcacgcttaggagagcatgacatagtgcctacaatggactgttactgactgagatttatgtgatccttagttactctcctattatgggaatagatagctcagctattaatcttaaattctctagcatcctttaattatagagatatgcttactattagccagctctgatatgcgtgcacatttccgcttagaggtgttgggttccaaagccagcttcctggatgagagcaaaggctttaacagttgtcaaatgtagcaatatcattagtatatcatgatatctgttagtacaattgtcagtatgtaaaaaggaaatgcttacaacttgtactacagctcattgttgtttgcactgtcagcctcatctatatcgaaaggaaatacatcagatcctaaactacattagttattatatttacattggagaatggagaataactccagtgtagatcaattattatttgaccgaacaaaaaggtggttgacaaatagaaaacatgtctagttagacttagtatccagggcaatgggtgtttaaaatgtactgcaaaatatatatgtcttgttagtttatgtttaaaaaatttccccaatgtacacaaatggcagcaacagctgtacctacaggaattcaaccaaacaactccaactcattttcgagaaatacaactaactaaaaacttgaatcattatattattcagccatggtatacttaatgtaaattacaaaattctgaacgattataattccttcaggttaaaatgcatcgatgtcatgataattcaacatggttagagataataccaagtgt

SEQ ID NO: 18353 - DNA, 357 bp, Oryza sativa
agacacatactcaatttaaacaggttttaaaaaattgtatgtacctaattttgggccataaaaaattaaattaggcatatgtccaatataaacgagcataacaatttaaatgggtatatacttagcttaaacgagtatggaaaataagcagggttttttggcgttcatacccaatatttgggtatatgttcatgaatacgtttacacataaattgggcacatacctaaatttttcatgtatttacatgcaaattgggttcatacccaaattcactatttttttttctgagaattcactatggccccatatacccatcgaccacactgtaggtacctacgtaatgcagaccaaactca

SEQ ID NO: 18354 - DNA, 1501 bp, Oryza sativa
tttcctcgattgtgcaaatgaaatcccgttgccaaatgcggggtatcatttgtacaactgccatgaactaaccattcccctgcagactatagaagaatctcgtgcaggtggaacatacagggagacgcgcaacatgacaaggaacgaatgagaaagttcatcatcctcaacacccgtgcagatgtatgaggcaggttgggcaccgactggggatgcacccggatggacccaagctccacgccacagcatcggagtctcaacctgggcgagtgccagtgaggacctgtggtgtgcgtctcatgacatccaatggggggacaaccaacctctcagatcaagtggtgtgcctccagctccaagtgaatggcgctcaagttcctctcgttgggacttaggtgaaatcactaggagaatggacacccttgatgtgcagacgggggagatccagtacaagctcacagaacacatagctcaaatgcaagaatggcaacaatctgctgatgctcagttcacgtagctcaaatgtatgtatactatgtatattagaagtataggaatatattttggttctcttttctttccacttagcctagataatatattatgggaatgagtagtaatgcttgtgtgtcactctacccttacccttagattatcttaacccctacttagaatttgattatcacaagtaatatataaattattagttaatgttctctctacatgatattcccacgggataaaataaatacgatacccttggaatactctcgggtgaaatgctacaatggtatatccgtgcgcttgcggacaaactctgtaaccataatataccagaagtatttctgcgtcattgctgggaattatatttctagtaatgtcgttaagaaatacaaacacttgaggtgtgtgagtgaagtgagaaggtgaggggtttatatagcctcccaatgacggttgtgatggttggaatggttggaaataccctgcaaccgtcattgggagccaatctaaaccatccagaagaagccctgcatccaacggcggcgaggaaggttcggctgaacccactggttcggccgaaccaggggccggcccatctagcccataatttggctggtggcctcctgggcttctccactccatagacttgtgaattttggcccaattcatcgtgtcaattctgagttcttggcccattcatgcataagtctgattctcgacatcgtccgattgatttatcgtctgagttgatatcgattctccttcactttatagttattctctgcaaaaggttagtaaacctaatactaatggaatattattattctaacatatttatgcattgtaagaatcactagtgatgggcggagcagtttttatttttctctgggccgaaatggacagtgatgggcttccctttgtgggcttatcactgtgcctacccttgtgacacgtggcggcttacgattgggtggggaggcgaaccggcgcctgggtg

SEQ ID NO: 18355 - DNA, 1501 bp, Oryza sativa
aggacaagatggccgggcaacagcttcgttggtcggacttttttcttgtaagttgccgaagtgcctgtagcgtacttgcgcatgtgttccagtgctttgactctcaccccctccaggagttcgagcgacacctcgcacccttcttcgcccccagagaacatcacctttggtgaattagcccctagctctgttggggtcattgcttcgtcgccatagagaagcatgaacgggctgaacttggttggccttgtggggtgtaacatcctgaaaattcccaataataaaaatcactaaaatttcaaactttttaaaactttttgatcatgctggttgttacgatcgctattgcttgccaaaccataaataatcacaaagaaagtaaaggaaagatctacatttaagcaatagatataatttacgagaatatgttatttattattaaccctagaaatattagtacacatgaaataatgatcacagcaatggccccatctataatagagtatctcactagaatatataattaatatgtgaaacaccttatcaagctcctcataacatgaaaatcactcatataaaataatggtcatataaataaattaagctttatatataaataagattatgtgagttttaattaaacaattagattaatatcgtaccgagtctcaatttactctttacagaataaatggattaagtctatccgtttaaactatattgctatacaaataaattcgaccaatctaccattgtattattaagaacacatcgctatattaaattgaatattaccccaaaagtcttcaaagatatataagttcactttagggccaataatttaaattaatctaaaaagaatttatttgtgtgataaataaataaatatgggtggtaataatttttgataaattttcatgaggatttagtgcttaaatttagttaacatttatctaagtaaaattagagcttataggattaaaattgtacaggagataggctaagagatgattaataggaaaggacactgttcattgcacatgaggtgtttgatggagttcctagccaccctagccctctttcctccccgctgccacgtgccaactcgcgcccggcgccgccgcgtcatgtcacgtcgccatcgccgcaccatctccaacccgccccgtgctgtcgccgtcgccgtcggatgcgccgcgccgagccccgcgccgctcgtgtcaccgtgggcgtcacccgtgccgcgccgagccccgcgccactcgtgtcgccatcgccgtcacatcagtgcctcgcgccccgtgagccgatgcagccgtcgcgtcgcgcatgcgtccccgtcgttgccgcgccatcgcgtcgccgcgtatcgccatggccgccttgagtcccatgacgcagtgcgccatcacgtcgctctcgagccccgtgcgccgccatcatgttgtcctcgagccccgtgcgccgtccgtcgcgttgaccattaagccacccttcccac

SEQ ID NO: 18356 - DNA, 1501 bp, Oryza sativa
caaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatccaagcttcaaga

SEQ ID NO: 18357 - DNA, 1501 bp, Oryza sativa
acggcgccaggtacccaatccggtttgcgtatcccgagtccactagatagtacttccctgcagcggtaatcacctgtaagttacacgttatggaagttagacattgcaaaattacaacaggtagctgtgtacctggaggtggatgagggaaaacatgactgtatgtactcattgcattgtggaacaccctcatgtcatgcactgaacccggccacccaacaagcaaaaaagtgaatatcatgtcaaagtcacaacatgccatcacattctgagttgtaatgtggtgtcggcacatgtgctgaaccaacagatctttcgaaacctgaacaggaatgtgggttccatctattgccccaatgcagtcgttgaaataaggatagaacctagggttccttagtcttccatgcaaagttgtgaactgtgggtcgcgtggtttaattatgtcagcagctagcttcaaaaggcttgccaaaactttgtgaaacatgttgtgcactgttcctagagagcactcaaatctgtcctcagcttgcctaaccaactgtggagccccacacatccaaaggaacattcctaacacctcaatacttgtagattttgtgctagacttgagttcatatttgtcgaccaacagatcatgaagactatagaacatatcaggggtcattctaaacatgttgtaacaccgcttcctatctgcaagcttatgctctacccattccaaaccactcatagttgtgctatgatctctataatcagagcggttgcagtacttgtcaatgtgagtagcgataaaatacgcaccgtacaggaacgtggtgtccgcagaatcgtccatgaagtattccaccagaattatttccaaatctttgtcggaaacttcttcgcttgtatccgcaggatcaggccgcacgtcctcctgtaaaaatttacaacaacaacggtaactttcatacatagtcataagtaagaaatgaatttggaacgacagacatactacaacttacatttaattgccaacattacgcatgacatagttcgaaacacaacagtagcccacattacttgaaggacaatgctaacggacatagcaccactaacacagaaagcacctcacagcccaaaagacacaactaaggctgatacattaacatgtaaagcaagcatgagaaggtctagttgtcgacccgtgcgaggtgctcaaggagggtctttcttccttcaggattggacagctcaaagacattgattgcatctcgatccttcagcagcttgaacatggcaacccacaagggcggtgtcgcctctgtgaccctgcactccctacagagtgccatgatgcgctcggccttttgccgcgcgcgagcgtcatcatcatccctcctctggtctaaacggccaaatagggtgtcaattgatgtcgctttgtccttctgaagattgttgcgcacctgcatttctttcaccacggcgcggacggctgggctcttcaacttcttgc

SEQ ID NO: 18358 - DNA, 1501 bp, Oryza sativa
gacgtcgatgatgacgtcatcaccggcggcggctcgacacctcgtgctcgccggcgaacgacggcgcagcggcgcaaatagaccacacctatgggtagagggcgacgcggcgaactcagcgagggctcggacgacgacggacggcaactgacggcgacggcggagaggtcgaggcggcggaggcgttcaggtcgacgatgacggcgatgctccggcggtcttcggcggaaatggaggacgggacggggatggtgacgacatggcgaacccgacggcggccttcccgagcgacggcgacgacaagagcggcggcggcgcacgactggacatgcggcggtgacggcgatgcacgggctgacgcggaggcggtgctacaagcgacggcggcctaaggcgaaggtggtggcgaaccgaggaggtctcgggggtccttatataggggctagggggcggcggctagacccacggcgtccggcggcggcgatggaaggtttagggttagaggagagaaatcaaatccgaatcgagctcaaatctgatgatttccaaacaaaattagatgaagtttctataggggaaaagatagaggagatcaaggggatcatttcccctctaccaatttgatcagatcgggaaagatgcaaccgaatttggaaggggcggcggcggcttgcgcgcggctagggcgcggctggcggcggaaggaggaagacgaccctggcggcggcggcggctaaagttttgcacggaaattcccggatgcacttataatgggatggagggagtagttgcgaacaacccatttagaaggggagtgcttcttatacttgctctcccatagtacgtactcgacgataccccgcgctttgctgcgggatatatgttagatattggagaaatgataaaatgatttggattgaaatattatgaaaatgatttgagaaagataatttagcatgtgtatgtttagttttagaataaaataaattgtagacatgattactatatacttgcattgtggagctttgtgtgcatgcttaatgggttgacgtggtatgcttgcatgtaggttttaggagtgctaataaatactatgcttgcatgttgagctttagatgtttagtgggtattagctttatagaaacaagagatacctgtttctggatgaaaataatgtgcaccttaagatacattcagttctctattttgtgtccatgtttctataagtttctctattttgtaaccaaatctgtttctctatgtactcaacatgttaacatgtattccagcgaactttcagcgtattctgtagaggctttcagttgcatgatttggttaccatgaaatatgtctttattttttactaaaaccaagattaaggctgtgtttagataggcccaaagtgccaaataaatcggtgaaaggggtgtactcgggactttggatctaaacagggtgggaggtggaattcggccatttcgcacattaatggcccaaacag

SEQ ID NO: 18359 - DNA, 1501 bp, Oryza sativa
atctacagaggtcagattaaaagcacatctaacaacgaagcctcagatttggcaggataatgattagacaataacaaatccagcaataaagccatttgggaagacgtcaaagtatgtcaagtgggataagttggttctcttgggaagcataattcaaaggcaaagttatcgacccttgcatcaaatagcagaagtagctattacccggagaccgggaaagctaatatgaggcagttggtggcaagttagaagtgaatgacaagcatgatattcttatgatgacaaacatggtatcctagtaatgacaagctagtgtcgacgcatgacatgaagtggtaacttgtatgaggttgactccgaagatatgaatcatgagaagttctggaacggaagcatcattaaactaccgcaacctagtctgagtcagctaaaaggtgcaccctggttcaagtcaggtgaagagaagattccacccgcaacaggaggtcaagccaagcagttccgagtggtgaagttttgctgaaagtttgtgaagacggagcggaagaagtcagacaagaagagaagaccgcccaacctatcttcttgctagcctcctcgaatctcggggacgagattcttgtaaggggggtggatttgtcacgtcctgataaattcatcccgaaataaaaattattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaactctaaaaagttccctttccctccccctctcccccttgggccggctcggcccatctccctcccctctccctcctctccccgcgacccacttggcctctccccgcgcgcgcgccactgacgggcgggcccgcccgccgccctcgctgacgggtggggcccacccgtcatcccctacctcccgccgctcccgccgcctcgcccgtgccctagcgccgccgccgccgcgaatcccgccgcttacgtccgtcccgcgtgcaatcaagaggggggaaatattccccgtgattccctccctctttccccccccccccatttttccctccctctctccctcggattcgtttggaaactcctcccctaacctcgccggcgcatcaatggcggccggatcttccgcgcccgtttccccctcatccggccgctctctccccctcccaaccctatataaacactccccgtgcctccctccgccgtttccgccactcgccgcactctctctccgccggaatcgagctcgcgccgtcgctctctctctccgccgtcgccgccgagctccggtccgccgctgtcctcgccccggaccatctcccgcctcggcgccgcctccttcggc

SEQ ID NO: 18360 - DNA, 1501 bp, Oryza sativa
gcctttccccgagtgggtgtgcctaagaactgttggggtctggacaatcttaagttattgggcctcggccgaccccacctgagccggattgctatcatttggtatcagagctgggcccttgtttaagggggtgggattgatgaggacatcctccactattacccgctggcaaagacacaaaagtcaggcggtgaccgtgtgagcctttgaataatcccaccttgcttagcttgggaggaggaagccaccttaaaggggagaactacccttcccctattggactagtcttttagggagattgggcctttccccgagtgggtgtgactaagaactgttggggtccgggcaaccttaagttattgggcctcggccaaccccacctgggccggattgttatcatttctccctcagtcccaaatgtaccaaattttaaaggatgacatatgtattaaagcatgagcattgcaagctcctctttggccattcataatgctcttgcgtgatgtgtggactcgtctagccacgtagggcactggctgctgtggaggagagagtaggtgaggtccatggctctagtttggttctttgtgtcttgtttgagctacgagagccttgtcctgcaaagcgtcaggcgcagggcccactcagtgagtagacgaggaagagaggagaagcgacggagttgtacaagggagaaggggaagcggctgcgctatgcattgtggttgtcgccattgagggccgtcggggttgccatcgctgagggccaccaggagcagatcaactgccaagtcccctgcccatgaagatacaacgatgatgctacctctgcaagcatttcagtcgctgtagtcgttcaactatgctcgaagttgccattgaactcgttgcattggcacaagcagatctgaagcagcagcaagttcggatcgccacgaccaccgatgtagccaaggccacctcgaccatcggtgcggcctcctagaggagtgctacacatctgtaggcaccgtggttcctcttcttgttggtggtagcatcggcggtggccggtgagaggatgacgatgccggtgtccttgtggagcatgagcccttgggccacaccgtcgatgtcgcggccgtggacaaagaggagcacgagctcggtctgtgccatcggagctcgatttggccccgtcaaagctcggttcgtggaaagggagaggagagggaggttgttgccatcatggcctcctgtcgcccttgctgccttcgtctgctgagccgccgccgctaggttctagggaggagatgcaccgggggaaggggagaagggaacaatggctgttggtgaaatggtaactagggtacccctttccctatggatctagcactcttttcatattaattaagatgaaaaagcttacttagaccatcataaagctaaggcgcataataacggggcttgggacccactgtaagggtgagtcctagggcccctatctcgcgttacaagatgg

SEQ ID NO: 18361 - DNA, 1501 bp, Oryza sativa
agaaaaagaaggtaatgagttcagaataaatgtgggagcaaagggcaggccagtttttaggctcctccctagcatgtaaaacgaagctcgtatttgcatgattaattaagtgttaacttttttaaaaaaaacatggattaatatgattttttaaaataactttcatatactcgctccatctatttttgatagtcatatttccaaatctgaaaattttatttttaataggcatattttaatccaataacttatcctcttaatgattttctcgaatttaatgtgtgactctccattcttccacacatgattggctacatgggtattgagaaatataaatattaatgaattgcttctttacgaggaatgactagtagcatgtttaaatggatgataagtagaattacttatccttggtctgtgtgttaagatgaaatatgactatcaaaagtagatggagggagtagaaatttttttataaatcacaccatttagcagttcgaaaagcgtgcttgcggaaaacgagagagctgagttgggaaaatagggggaagaacacagccttccatgtgaattagtgcaccgtttagtctttttactcgatcgaaggctgtttagcattgtgtatagcagctagctttcctgggcaacaagacgcgaataatacgcaagtcttccatgttgcttaggttaataagttggaaatggaaaggaaggaaatcgagttggtgcagatctgcgatgcatggggaggcatcaggagatgattttctagcgggagcagtacacttggtataaggcctaaacctgtctaaatcatttgtccctacaatctatccacttttagaccttatacactaccccttttattactgcagatatagaccattgacactagtttccctctcatcttttagaaaaagccgctccacggtagtaaagtctcaacttctgtattggccggacaaggtatctccacagtagtaaactctaacattttgttagtgtttgttcaaatatgtgtataaaattgattacagtttagaatttggagttgtactggatatcgaaatagggtaagagtcagactctacccgaggatcactcttaaatagagagcagacctgttgtaactgcatgacgacaatggcaacttcacataagcgagaggtagcgactaccatcggtatctggtcgagggtcattgtaactctgataagctataatatgctggatgagagaggagcacctgtaatcagtacccagaagatgtagacttcagctgaaattcgttatcacatatcgtgcctcggtaacgtcatctgttttggatctcctatggcgtttctgccacgtttggttttcgatggtaatttcgggcttgctctataataagtagtattagagcctacaggagatccatggtagaggcgcgatggagatgcttgacatcccgccgcttgcggtttatatctagcaagggacatgtgagcaaggtggagca

SEQ ID NO: 18362 - DNA, 1501 bp, Oryza sativa
caaatagcgaaagaatgtttcaattcttaaaaaatatgaaaaacattaagatcactagataaaataatttggttcaacgtatgcagcaaacaatttaaagccattgcaacacttaaaccacgtatacatcaacaaatcacatgtccattaagatgaaattatgaaatagtaccaaaatccactgcaacatttcatccatacatagtgaaacatcacgagtacactacctgaaatattgttggtggaaaaaaataaaacaaatccccttgatagtgcgtttccgttatatcgggtggttgttgcaacggagcgcgagtggtggggacatatggtgggggcgacacgcacgtgtgggaggcgaggcagaggcacgagtgggaggcgcccgattttttgcactgttcgggcgcccgattttgagcattttcgaaactttcagcctcggaattttgttttaacaaattggtccaaaaatatttacttttggcctaatggtatttaaatttcaaaaatcctgatttttttccccaagtaggaatgtggaaaaaggaactgcaagaacacatagtctgtgtctggttatctatgtgactaacttaaggccctgtttgattcagcttaggattattataatccaaattattcggagtaagctgaaacaaacagacagcttactataatatggtaatccactttaaaagtgcttttttaattattaggtggctaacaactaacaaacaactaataatccacagaaacaaacagctaacaacttattctatgtcggcttattataattcagttaatagtaatctgacttaataatctagattatagtaattaatcttaagccgaaacaaacatgactagttgagggattcaagttgtgctttgagtcgtagcttggcttagcaagtgttgcaaaatcattccccacatcaaaatttaccatttttacaagtaaaagactagctccaacaatatccctaaagatctcgcaaaattttgcagctctcatattggcatctctcgcaacatcatctatctatctatctattatatactaaaaatccattaatcttactaaaaacgctatgaagcacccacgtggctttctaaaaatgctctcaagccgccacgtggcactctaataaattagagaaaatcctacaaattctgagaaaaaaaacaaaacatctagcccttaattttaacttaaattagaggacccgatatttcgggtcattagattaaatctattaaaatcattcattctaatatggatctaatgcaaatggatggagaggaaggtacgatgtactattcgtaaacagagaaaaaaccaaaaaagatccttcctatccgatgcatatggatggagaggaatgtacgtatgtactacctaaaacacaaaaaaaaaacaaattacatgttacgttcgtatgaacttcacgtacgatcgtaagatcggaaattataaagataaagccaaaaaaaccag

SEQ ID NO: 18363 - DNA, 1501 bp, Oryza sativa
ccaactagtggacactctactcatggtaccactagtatgattataggtagatgcttcgcttttaattaggtaacattaggcggttttacaactctagactttgggaatgttcatatcacctggacactgtggaattgttggagtattgtggaattggattcacaccgccccctctattcaaaatccccaaaaatggttttaggctgggcccggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggtctgggttggcttgggacgagctgggacccagggtcgggttgccagttcggtctgaatcatcgtaggccttgggttaaggcaggttcgtgtgggttcacggccttgataaagaatattgtttagttctagaatcgtgtttacaaaatagccctgagcaactaaatatctttaaatgctgtttactgcaaccctaacccctttatggtataacccctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacattatcgaactttggttctcgattcacaggtctgagcggcgaagccgtgagacatcgtgtcggccaggtgatgatcagtggcccgacgacggcgagcaatgtccccgttcccctttgcgagaagggggcggccaaacgcaacgctgccatcaatgtaa

SEQ ID NO: 18364 - DNA, 1501 bp, Oryza sativa
atgtaacagaatacacatccaatacatggatattcaaatggctggatcaaaaaacttgtttaagtaattagaaagaagcttcccagtttacgccaaaaaaaaatacttgactcggtaaaaattacagtctggtttctacaacagagtaattcgctagtcttaacgctggatcggagtttccagaaatataagagtctggctgctgtatgtaatccacacactcaccatactttgattaatatattaatccaacggaatcgacaatttcaaggcacccaatatcatcaaactaactaacattagattgttacttctacatcagaagaatcaaacatcaagtttttgtgctttaaacaataaaacacactggaactattgaaagtttagtgaagaatcgaagtgaaaaatgggctagagaacaatatgatgaatttccactgttatatgacttcctaaaagatatacggactgcatgtttctaaagaggaaaagaatcatctaccactaccactacaacaggcacatccgcaaagaaaacacaatgctgtcatgcactcatgctctgaactattacaacatagacatcagagatatatgccaatacaactaaaacatgcaaccaattccttctcacgggtagggcacaattatttccttgaagcaatatgattatatgaaagatgcaaagcatgtgctcctaccattcactaaaagcaacaagaccaattttcaccactcttccacatttttttctcctatatttccattataaatcgggaatcagttcaacaaggagcacaagaaatgatcaacctcaacaagaacccttaattaactggtgccagtgccaccatacctaaaagaaccataaatcccttgcggacgttgataaaaataacctatcacacccagttcctccaatccacaaatcccaatacctgatttatcaatcacacaaatttccgttatgttcacccaccaatctaaagactttgaggcctcaaataacaaaaccacattagtccccaaatcattccacctccgcagattgctggaaacctaatcgacaacacttaacaactgctttgccaaggccatttcttctacaagattaagaacccctttacctctttgatcccaaaaaaggaaaagtaaaatggccgatttcaaggacggattcatccagaaaacggcgtcgatcgatcccccattgcaaaactggatcagcggcatcaccaacgaaaaagcatcattatcatcacagccctcaaattcccccttgcccaaccccaaaaccccaaaacgaaaaatggctcgtaggattttgtagggaacgaagaggagtagcaagacgatggcggtggttaccccagcgagtaggacagggcgcggagaaactgacggagaggtcgaccggctggccggagaaaggatgaggcgagccgccggcggcggcggcggcggcggcgatgatggtcgaggagacgccgaggatgggagg

SEQ ID NO: 18365 - DNA, 1501 bp, Oryza sativa
tttgatgtggggaatgattttgcaacacttgctaagccaagctacgactcaaagcacaacttgaatccctcaactagtcatgtttgtttcggcttaagattaattactataatctagattattaagtcagattactattaactgaattataataagccgacatagaataagttgttagctgtttgtttctgtggattattagttgtttgttagttgttagccacctaataattaaaaaagcacttttaaagtggattaccatattatagtaagctgtctgtttgtttcagcttactccgaataatttggattataataatcctaagctgaatcaaacagggccttaagttagtcacatagataaccagacacagactatgtgttcttgcagttcctttttccacattcctacttggggaaaaaaatcaggatttttgaaatttaaataccattaggccaaaagtaaatatttttggaccaatttgttaaaacaaaattccgaggctgaaagtttcgaaaatgctcaaaatcgggcgcccgaacagtgcaaaaaatcgggcgcctcccactcgtgcctctgcctcgcctcccacacgtgcgtgtcgcccccaccatatgtccccaccactcgcgctccgttgcaacaaccacccgatataacggaaacgcactatcaaggggatttgttttatttttttccaccaacaatatttcaggtagtgtactcgtgatgtttcactatgtatggatgaaatgttgcagtggattttggtactatttcataatttcatcttaatggacatgtgatttgttgatgtatacgtggtttaagtgttgcaatggctttaaattgtttgctgcatacgttgaaccaaattattttatctagtgatcttaatgtttttcatattttttaagaattgaaacattctttcgctatttgctgaaacattgtttttatatagggtgaaacaacgcccaattttttttggaaaccgttgtttcatacatcttctattatatactaaaagtccatttgtcagggttacgggttaggtatatcctttacccttcgatatacgtcgcatatcggtatggcatacctacgcgtatatggatactctctgcatacactaaggaaatcctttacggagtttatagaaggaaagaatcctactcggacaagactgggtcgtcagtgtatcatgtagggtctgatgtctccgagttctacttggaaaccgcctgacctgcgatataaaagggaccccccggggaggacctaaggcatcgaatctcagagccagcacaacccccacagcctacgaagtcggagcctgcaggagccaaaccgccggagatctagtcgaaccaactcgattacgatcttgccggatccatcgagttccatcgttccttttgtaacctgtgttttccatcatataatcccacatcaactggatttgggctattacttattaaggggcctgaaccagtataa

SEQ ID NO: 18366 - DNA, 1501 bp, Oryza sativa
gtgccactgcaccatcttcacgtcttgtgtgtggccttgctgcaccgagacacactcgtattcgtttcctggctgcatctcccatatccacaccgacttgtcccggctgcacgtcgcgagcagcgacccggacgcgctccacgacacgctcttcacctcattctcatggccctgcacacacccccacaacagaagtagtaaattcaacacgcacaaccaaacgatcacaatgcaccacaacaacaaacagtcttaaccccatatctgaaactcccgagagccattttcaacctccaaggtggcgacgcactcgaagtcgccgccggagtactcccatatcgcggtggtggagtcgaagctcgcggtggccagcagcttcccgtcgggggaccatgcgcacgacctcaccgtgcggttgtgcgtgtcctccagcacatcctacccaaaccgaaccccaagtcaatcaacacgcgttgcagctgcagcagcatcagctcgaacgaggaggggatcgggcgtgatagttaccgagcactgccatgcgccgtcggcggcgcgcttccagatccggacggccttgtcgccgccgcaggaggcgaggacggggccggcgccggcgccgggggaagggttccacgcgagggaccacacgcggtcggtgtgccccgtcaggcggtgggcctcgcgcagcaccgccgccgcgccgccgtccatggccatggcccccgactccgactccgactccgccgcccccgcgcaccggcgatcgctgttgccctagggtttttggcggagggccgcgatggctcgccggagtggtggtggggtgggaggggagagggcgaagaggaggtgaggtgggaggcggcggcggccggcgacggcgaggtgggggaggtgagaggtagggggaggagtcaaccgcgcgtggtgggcacgtgtgcgagcgtgacggtgataggctataggtgctcgggaggacggatccaaaccgttggttttgaggaagggcgattcccccaaccgtcggatggccgccaattggtcatccaattagtaatattttactaagcatttttatcaaaatcgccttaaaaggggatgatttgaggagcgtttacaaaaatgcctttaaatgtcattccacttgtagtgcaatgtatttcccttttcttcctcttttgtgaacttttcctctctacgtctataaacaaattagcaaaccccatccttagtccaagatttcatctcataccacttcatcaaatctagtgacggaaataatcattccctctctagtcccgcatgtcttggaaaattcagtcctacgagacgtacacacatcattttgctaaaatgattacttcaatgcgagagcggcaccgatgcgaggcgatgcaaatgttgagcctaacatagtccatttcaattcatacccttttggtcctatatttaaaggtatgcatgtctcaactccctttgatttagctataatcattat

SEQ ID NO: 18367 - DNA, 1501 bp, Oryza sativa
ctagcaaccgggctattggcggtgcggatccaggtacggcggccgcagccaagttcttagtgatagcggatgtggcgcccaaataatcgttagatctgttgatgccaaccaagctttgttccctccccaacctccagtgtgctagccgctagatcaggacactaggggtctgtttggttgatgacctgagttatgtgcctgagttctacctggccaggcatgttgaaaatttgttgtttggttgatgatccaagcctgagtaaaatatattaaacataaaaagtacacttgtgtgagttaggatgattaaaagtgttggtagtagtcacatcaatgaataatctatgaagaagaagcaggcatgcaccgtgcctgcatcaggcgtccattttcggtggcctgagtcaggcaagtcttcagggagacaaccaaacaaagttgtgtgttgctcaggcttgctacaggccaggcaaatctccatcagggtagcaaccaaacagaccctaggtcattggcctcttcttccctagtcgtcgttctactcgacaacggcgacgatggtgatgggggtcctcccgatagcgtgagatgaggtgcactctctttcccactttctcttcggattgttgccgactggaccacacttttgcttcttttcttcccaaaccaccgtagctcatgtaaggtaactctgacacagatgtagcccctcccaaatctccactgtcgcatccaaacctagttggcggctagaaccacaggcctaaaaccacgctttgagcatggccttaggagggctaatgaccagatcttagatggtgaagctcggctgataactagaactaggattgtggaggttgagacaagctaggctgcacgaggcggtgtagtttgtgtgagcaacgaggtggtgcaatcgcttgaatgcatgggaaaaacggagctcacacccctttgtaagggtttcttgatgagcggtaagataattgaatttatatagctacttgtggaattctaaagcctaaaacaccaattctcatacactattacatctattttgttctatatttgatgggttgttgtctaccaaataaatgaggtagaatggagaatccatatatgatgcaatattatgattataattatttgttttccaatgaacacgcgtttcatgcataaataaaaagttaagcaagagagacaagatgttcccccaagttctgttatccctgttctattggacttctgcctttcttatttttttaaaaaggaaaaagctagggcccatctattataacagataatagaggctacagtccttatattatactagtgtagtatatatggataagcaatatgaatccaaacgacattaatgggcctcacctctaatggaccaatttatgttaaagtttccgcactaaataagccatgttaagtattgttaacacctgtttttaacaatttggtaattaatgcatatacattaattaattcttgt

SEQ ID NO: 18368 - DNA, 876 bp, Oryza sativa
ggcgccgccatctccgtcgtcgccgttctctctctcacttcacgcgggtggagggcgagagacggtggggggagaagagaagagaaaaggcgctggccatggcgcggcgggcgcgaaggtcgccggcgatggtgacgccatccacgcggtcgcgcgagagagagaagagaagagaagctagggttttcggcggccggctgggagaggggggtttttgatcctccgatctcggcgcccggccgtccgatcgaaaccctagctgatcggacggtcgacgccggccgggccgaaatcggcccaagagggcgcgcgcgggggggcggctttcctggcccaggcccaggttgcggcttggggaagggggcgcccgcccgtgccaaaaggccacgggccgaccggaaaaagtctgtttgaggtccctcggggccgaaaacaaagaaaagagaacagtagcattttttccaatttattttgtcgatttttcatgcaaatttcaatagaattttgaatagatttttgcatgttttacctctgtttaaatttgaaccaacgggagaattttcacagagagagaattacagagattttgctactgttcatatgatttttatatagttttccgctgcaaatagatgtaattgatgaaaattagtgtttctaaaattaaatttcgaaccaacgggagaatttaattttaggaacattaattatgtgctatgatgttgtaattttctgaccaacgttgttaattgcattattatagttatggttataagtgttatgtctaatttctgcccaacggtgatgtaggcttaatgcataatattttaatgttaattttgttctcaccgcacatgattatttcaggtggctact

SEQ ID NO: 18369 - DNA, 1501 bp, Oryza sativa
tcggtgggtgcgtgcaggaggaatcgacttttgggcgaggggagcacgtgtgggaggaggaaaacatattttctgttggtagttttatggaggtcacactttttagtttgtacaatcaatttagccttgatttatggagggcacgatagttttagccttaatttaggttaaagaacggagatagtaaaaatattagccccagaacctaaattttttacctactccgtatttaacagaaggaaggtaaacattatgtcacccacaaacactcggccactagaatcctcgaggtccctacggccatcacgtgacatcacgatgatcaaggtcatcgaggtccctacggccatcacgtgacatcacgatgatcaaggtcatcatgtcaccatactcatcgaatttcctcacgctcgtcttctttcctcgctctacacccaaatcccaaccaccctcacaacacctcccgcttcatgctggctaaagtccccaaaaagatgagaacaacatgcatcgcgcccacgattaatcctagtgtcactagtagcgatcttgccaagattgcgctctcgtaggtgtcgttttggtgagagacccatggcactgttggcaacaacacccatcaaggccgcctccattgagcattgcaacctctagtagatgagagggttagccctgatttcactttcggtcgttccattttttaaagaataatgattatagctaaatcaaagggagttgagacatgcatacctttaaatataggaccaaaagggtatgaattgaaatggactatgttaggctcaacatttgcatcgcctcgcatcggtgccgctctcgcattgaagtaatcattttagcaaaatgatgtgtgtacgtctcgtaggactgaattttccaagacatgcgggactagagagggaatgattatttccgtcactagatttgatgaagtggtatgagatgaaatcttggactaaggatggggtttgctaatttgtttatagacgtagagaggaaaagttcacaaaagaggaagaaaagggaaatacattgcactacaagtggaatgacatttaaaggcatttttgtaaacgctcctcaaatcatccccttttaaggcgattttgataaaaatgcttagtaaaatattactaattggatgaccaattggcggccatccgacggttgggggaatcgcccttcctcaaaaccaacggtttggatccgtcctcccgagcacctatagcctatcaccgtcacgctcgcacacgtgcccaccacgcgcggttgactcctccccctacctctcacctcccccacctcgccgtcgccggccgccgccgcctcccacctcacctcctcttcgccctctcccctcccaccccaccaccactccggcgagccatcgcggccctccgccaaaaaccctagggcaacagcgatcgccggtgcgcgggggcggcggagtcggagtcggagtcgggggccatggccatggacg

SEQ ID NO: 18370 - DNA, 1501 bp, Oryza sativa
tttaaaaaattttaaaaacgtaagtcacgagtatagcactatttatgttttatcatcttataacaacaaagatattaattataaaaaaattcaaataaaacggacgatcaaagttggacgcggaaactcatggttgcactcaaaatgggatggagagagtatttttctttgctccccagcaaatcctttgcttcatgcacaagcaaaggagaaggatgtttagggttgtgtttggcactcccttttccccatatctactttctcatttttcatgtgcacacttcctaaactactaaacaatgcattttaaaaaaattatacctaaagaattcggaacaaaatagatgtagtacttaattatgtactaacgaatcaattcatgctagggagaaaggttccgaatccttttacccgaacgtaggaactttaaccaagcagcccttggtacagtggcagtaatatgttacgggaccacctatacatttgtcgacaaattttctactaaaaatttgacagatgtaattatagtacaatcgtagtgtaattacaatataacttgtatgtaattacattgtaacttgcatgtaactacagtgtaacttgtatgtaagtttcacgtaattttgaatcgttagatctattacaagatttgttctatggaggaagaaaaaaatcacatcacacacatatatgaaagaatttgttcccgcgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgatatgttacaacacatatgcaatagatagatggactgtattatattgcaagtcttcacgaagcctatttaaacaacaagaattaattaatgtatatgcattaattaccaaattgttaaaaacaggtgttaacaatacttaacatggcttatttagtgcggaaactttaacataaattggtccattagaggtgaggcccattaatgtcgtttggattcatattgcttatccatatatactacactagtataatataaggactgtagcctctattatctgttataatagatgggccctagctttttcctttttaaaaaaataagaaaggcagaagtccaatagaacagggataacagaacttgggggaacatcttgtctctcttgcttaactttttatttatgcatgaaacgcgtgttcattggaaaacaaataattataatcataatattgcatcatatatggattctccattctacctcatttatttggtagacaacaacccatcaaatatagaacaaaatagatgtaatagtgtatgagaattggtgttttaggctttagaattccacaagtagctatataaattcaattatcttaccgctcatcaagaa

SEQ ID NO: 18371 - DNA, 1501 bp, Oryza sativa
ttttgaatttgtagttgattagaatttaatatgataaataacaaatattatctcaactactataaagaaaagattaaaggaaagggaagagaaggcgaggagggccagttgcgtgcatgcagtatgaagtgatatttttttaagggttaattggatcatgccactacaaaatatgccattttagaaaaatatcattactattcacaatattggctacgtgccattggaatttgaaaaaattagaaccataccactccatcacgttttccgtcaaaaatctccgctaaccccaactgcacgagggacctagctgttagtttcatcttcacttccctcccctctcttctctttccccttcctctctctccaccactgtcgtcgaccaccaccgtcactgctgctgtcatcggccacctccgtgaaggcctcaggagccactaccgtcgccactatcgtcggccctatctgcggcgggagacttaggagccgttgctgccactgccgtctgtggcaggaggctcgggagcagccgtcctcaacgccatccacgcggaagggctcaggagccccggccgccgtcactatcctcgaccccatccgcgacgggagggctcggaacctgcagccgccgccgccgccactatccttgatgccatccgcgtgggagggctcgggagccgccgccgccgtttctgtcatcgatcgcatccgcgatgggaggtctcgagtgccgccgctgccgccatccttgacgccatccgcaaaatcgtgaatagtagtggcatttttctaaaatggcatatttattgtggcacagaatataagtgattttagttgaataggatatcatagtactacgaatctaaatccatgtccatgcatccataaaaaaattttatattttgggacaggggaatatgtattttctaattaacttcttattattttaatcttattaattggttttatgtgttttatattgtctagtgtaagctacgtgttgttaatcatatggtttaaaaatctatctgtttttccattaaaatgtgtgttgagtggccaatagctggtccaaagcaatgtatttcttttacttattaaatacagttaattttttgttctttcttcgtttcgtacttattgatatctcctattgctagatcaaactagacttatgtagcacatctactataggttgcaaaattcaggtcacgctagtttgtgaaaggaaaccagggacgatccatgtctgatcgtacatggatctaattagttagttttggggatttggccgagcctatggctgaaacattttctgagtgcttacacctttttctccaaaagtttctcatttgcattaagagacctacatacatagcaaagtacgattgaaaccacaaaaaatagttgattgatccaaataaataaatatttacaagaaaatttattttcattccaaaattgatgaaactttcaagttctaaacactcctatatgcaac

SEQ ID NO: 18372 - DNA, 1501 bp, Oryza sativa
actctctcccctacttcctcaaacaatcgtccacttctttctagcggaacaaagagaaccattaggagtaaactattattatcatcatgatatttactatgagtaacagaagacctgaattttctctggatggtcaatacttagaaattagagaaatcatcaaaacacggaccaaaattatccatgcatgttccaaaattccatcaaaacacagataagatgttacttgaagagaaagaaggcaggagtttgatgcaaccatcttctcctgtagctttggaggcggaggcttgatgtggatcaaggttggcagcggtgcatggactatatggaataagagtgttattagtaaatgtaaaggtgcagcaatccttgtgccggcgaaatgaagatttggtttctgaaaaaaggttgactattagggcccaaggccatagaaaagtttgatttttggatctaactaagcaaccagcctttcaaatccaatttgtggggtagatttgcacaaaacctatcaatcattttcggaaaacctttttctaacatcttttccaatgaattagatttgcacagcacacacaaaaggattgatagaatttgaaaatcaatgtgtcattaggacaaaaaaaaattccctggagcaaattctatggttgctccctaagcaataacttttattttgatcaaccagcaattcatgtatttttatcccaacaaattaaaacatcaatgttggatgtagtaaatcaatgatcttaatgttaaaacttattaaccagaggttagctcatgattcatgaatatttatttcagaactcgccaaagtttgcaccatgccaaagtatagtgacattctagactttaggtatgtattggtcacaggaaatgtgaatattctgaagattattaccagtcgaagaccatgcaaaagcctaagatgcaatccaaaggtcaaacctgagataaaaaaaaggaaaaaaaatttagagcaccacatcattctgaaattgaagtccaccaaatactgaagcagcaccattcagggggtaggccagcatgacatccatgccaacgatacttgtgagatgaccgacaaagaaatgctcgacttcttcgcacaaagtgtgatgattagtgattaggccaaagatacttgtgaaaaattaattccttcatgaagtccagaaggaaaacttcgatgtgatatattctcttgtactaagaggggccaagatggtaagccagtcaacagtctcaccccaattagaacactttatattagaaactataaatgttaaaagggaaaagggattatgtgcttgatttggttacatgatacctctccaccaattttgttagccaagcacaggccaacagctcctccatttttcttcccttatatctaaaagctattcaaatgattcaggatacaaataagctattattagtaaataataaagtaaaattcacaagtagttttcagataagtaaaattctgatg

SEQ ID NO: 18373 - DNA, 207 bp, Oryza sativa
cgatgggccgagagaaatccggcccatcgaccccaggggagccaaaatagacttttgcgaaggaatttgatttggaaggatttggattcggaaacgagctcgacgatagatcggggattgagatattgagatggcacggacactggacgacaatcaaagaaacaaatttcgcaattagggtttttaagagataactttcccgctagg

SEQ ID NO: 18374 - DNA, 1501 bp, Oryza sativa
tctcttccactcgatgatccgtcgcaacgggcgcgatggttcccaaccttcgcgtctacggttgccaccccttcattgatcaataaagaacatccgattcattcgctcaattctctcttactcgttctcaatcgattctattcactttcaacagtaggtatgctcagatggattcttaacacgtgttttgatgagggctcagcttgaccccttttttttttctaggcttgaaataacccaagacctaaatgtgccatttgagcattgtaagctctagactacgtactacatcgcaaaacttaattacaatataagttgtaaaactgatttaactatttatttttaaaatgtgccgtcgtaaatatagctaaaaaaaataattctagccatgcaactggctagaatggggacatagataatacgtcatatatatgttttgtgtcataatgccgtgctaaaacatgtttttatttttcactcattttttgggtgttgtcgtttttttaggtgtggctgtatacatccctgggatgtaatggcaaggttttatttaaatccattatttaaaaaaaaggtttttaggtccggtctttcttttaaaacgagccaactctccttgatatatcccgtgtaactcccctcatcagagttttaatttttattaaaggtccttatgatgtgcatctaaaagaacaacgatttgaatgtattttcttttgaaacaaggagtcccatcttcatgacaaaaacaatgaaaccggagtacaaggacccaagaaagaaaaagaagtacagaaactctgcacaaaaagaaacaagtatagaaaacttagcatgattactactttatgctccaaaaggatctaaacaagctaagctaaatatagttttaaacaagaaccattaacaaaaacaccatgccaggccaaaattcaatcccataaaaaaaatggaagactaattgtctgtatggaaggagctaactctgaatgttgctgccaacacaatcattactagttttagttttgtgcctaaagttgatcttacaaaccatttgagcttcctggagaagttgttacaaccatttgaagagtagatgttctactgattcgaggcactgaacaaaacatgctcctcttggatcctttccacactttggggatcaggttttctttagtgagaatacaattctgcagcatcaaccatatgagcaccttaatcttcagaggcaagtttgtgttccacaaatacttgtgtgtgaacgctgcctgagtgatttgatcaaattcaaagcctacctatgcatatttgcctaaacagcacaagttagtgttctacatgacttgttccattctgaatagctctggtccttagtaattattggctgaatagctgaatgatttgtgataatatttcatgggtacaaacaaataaattaactatgataaagttggaaaatggatttaaaatagtataacaagaaattcgcacatatatattt

SEQ ID NO: 18375 - DNA, 234 bp, Oryza sativa
tttaaagatacttctatgctcagagcataatagtgatttacactgatcttaaagcggttcggcaattctggaaccttttgtattgtgtgcgtaggttgttcggttttttgctttcatacgagtaacgtgagccctgaaggggcggaggacgcattgccaccgcgcgcgcgcgagaggccgggcagaggcagagacctcacgcgctacgcgttgcatctcattctcgcgcgcagg

SEQ ID NO: 18376 - DNA, 783 bp, Oryza sativa
caactgtttagactttcagaagtctgaattggaatcagaagatcgaagaagttagtaccataatcaaataggccactatcatagcctaatcaatgctattaccgtgcaccgatcaccgaagatttgctaagaactagtggtagcaaactggttggtcatcactctgactctcccgttgatgtacacaagccatgtgtaggtgatcaacagcagcgcaatatccagcattttttttctgaagcagtggcactagcacaagatactgtgctactagtagtacttcctccgtcccagtaaaattgacgttttaaggttagtagctaagattagctgttgtgcaaaattaccaaattgtatccatgatttgattcagctgtcatttccagcatttatacatgcactccgaatattctagaggatatttccagcagtaatgaagtaaccacaactcactaccacgtgttacggggagtacataaattggcgccttggccacacgtttgataaaggggcaaagccatcattaatatattcaaaaatttgaatcaacaattaaacttgctttggcgtccaggagtgcctcttctctgtatagcgacacattttttgagacaagcctggggcgttgaaacgtcaattttactgggacggaggaagtagaaagtaacaccaaattaacgggacagagatcctctgcagtattacagataatctccactgagtcagtggacacgttccagcaacatcacaaatgtattcagaggcaaatctgattcttccaga

SEQ ID NO: 18377 - DNA, 1501 bp, Oryza sativa
agcagcccagtcatttccttggttttttttggaaaattccaagagtctctatccgacgaagtagcattgcaatggcaatgtactcgctctgttttttaacatatgatgacttacttttatcattgaaaacaatttgagcatgatttatattctacatattttaaagttttgaatagcgtgagcaattgaacgtatgtctacaagttaacaaggtcgtgtatttgagagagcgttacatgagccatacgtaaacatatgattatggtatttaattattcgtattattaaaaaataatcattatttatttttgttttattacgacttactttactttagacatgacgtatacttttatatacttaagaaaattgaatgagataaatgatataacgtatgtctaaaagataatgatgtcatatgttaaaacaaacggaaggagaattatgcgagtcataaaaggtctcaattacatatgatgaggacaaattcaggggtagcgtcattgcccgtgaccatcagtgcagccgttggcaaaaagaactgcaaccagcaatccagcatgcagattgcagagtggttgcttcttggctatgattacgtggccgatttttcaaacgtgagattagcgtgtactaagtggagttgcccatggagataacgatgggttagtagtctccgtcttcgtcctcttccttcttgtttaataatccctgcattaactgatcaacacaaccgagatgtttgacaaagagagaagaatacaagggaatgcagtgaaccaagagttttacccattcctcctgtatccagtttagtcgttgcagaaaaatctcccccttttttttttctttatctgaagatttgctcctggttcttcaactactaccaagaatcgagctcctgttgcttcctctagcctctgtctagtctgaagcctgaacccttgcatgctccagtttctgcactgtgtgagcagaattatttctgaagtctgaacagcagccaagcaaaaggtatgcgctttcaattgctttcgaggtgatgaagtatcttcagttccctatctgtttctgaaactgaggttgttctttgcctgatcttggcagaaggcatctgacagtaagatatgaacacctgtgtttcaggtgaatttggctgatgattctgcccctgtgttctgatttattcaagacactagcaactgaatcatcaggtgttggtcgcgaatatcccagtgatggattcatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaagg

SEQ ID NO: 18378 - DNA, 500 bp, Oryza sativa
ttacaggcccagtttttttctccaatactgttggttttactgggccgaaaaagccataaaatcttagtgagtggtgtgctgggacgtggctgggcaggactagccctctgttaagagaaaaaatgtaataaaatgcaagcaactatgatcgttttttgctgtgcaaagctgatgattcacccatgatcgattgctcgatccgtttaagatgctactccctccgtttcatattataaatcttaatttttttcttagttaatttttttaaggtttaataaaattaatagaaaaaaatagcaacgtcaaattagtttcattaaatcaaacattaaatatattttaatattttgtttcgttttgtaataaaaatattattatatttttctacaaactcagttaaactcaaagaagtttgacgaataaaaaggttatgaatgtcaggagtaatataaaacggatagagtagtaaaaatattctacagttccatcgacaatttaca

SEQ ID NO: 18379 - DNA, 1501 bp, Oryza sativa
tcccgcgatggccgacgccccatagggagctcgccgcgtggcctcttccggatagccttatcttggttctcctggatttggagctcgctgacatggcgcgcctacgtggcacagcatgcctatactgaatagatcgcacaaaacacacacattgagtcgcatcgaatgcagatgaatcttgtcttcttcttttttacacaaaaaaagagcgtgagagttctttttgaaaactcggcaaaacacccatatatctgcacactcatctttgtaaaacacatacgtgtgcaccttatctctacgagcatttcagaatgactaggccggtttatgtcgagacaaagctaccacggacaccttgcatcgcctgcactaccattaaaaaaataattagtcataaatacgagcatccatattaaatataacttaaatttatctatccaattaagttaggcgcacttcgaaaagcgtagaaattttttttaatgatggttggcaagtttcactacaagaacctaaccggttaggtcgcacacacttcaaaaagtgtagaaattttgtgtggagatgcatgaaaaattatatcatggtgtaatttgggttgagcatctatcaccgaccatcactagtgatgccaatgatctgatcaatgcttggggatgtactcaccgtcatcaatccaacagtactcccctgtatcgtagagagacaacatacggcgatccagatctcgtagaatttttttattatcgtcctggacgctgtcccctacggcgtcagtatatttcagcgtactgtaccatacgtcgcatcaaagatcgtccctgtcttctcaaccgaaaatatcagcagcccaaatactgctattcgggcctggcccaagaacacccctacctcgcagcctctcatcaaaatgggcctaatgccagaagcccaaggcccaaacccacttccactacatgggccgtcgccgcacttgcgcgacggggaggcgcacccgcaccatccacggcgactttaggccgagatccacccactgctgcgcccgcgcgggccggcggctcagatcacaccgggggcgaactgctgcgatcaccgacgcgggggaaccaccgccacaccaccaccccggggcgaagccactaagcctctctctttctctctctctctggccgccgccacgaccgaacgcgacgcgacggggcccagcccacgcccaactccccctacatctcccccccgccgcggcggcgggggcgcggtgaagcttcctccccgctccgctccgccgcgctgctttgctctgcctctgcagccgccgccgccgttcccggcccttcgatcggggcggggggccagatccccccgcgcgtcggccgagtgggagtggggcgcgcgggacggaggtgcggatctgattggtctacgcgcgagatctagccgggtgctgctgttcctgctggtggttgcggggatcggagcggaggcgggggaggaggaggga

SEQ ID NO: 18380 - DNA, 1501 bp, Oryza sativa
gcgcggcgaccttggggcggaccaccagcgccgcgcgcacggcggccctgaccacggcgtagacggcgagcgcgcgcgccagcctcaggttggccgcggcgacgtcggcggcgcggcacgcggcgtgccccgcgacgagcctgcgcgcgtcggacgcggcgagcgcgaccgtggcgagcagcgcgcccgccgcgaacgcgagcagcacgagcgccgtggcggcgaggagcgcgccggagaagaggcagccgtagaggagcgcgacgaggaggaggtccagctgctgcaccgccgcctgcatggggaacaagctggtgatgatcgccggcgccggcgccagcgaccagagctcgccgcgcgcaccgaggtagaggaggccggggcacatggttattataaggagaggaatcatgtcatgcgtcgcggccacggcgcgacgcgattccctcttgggtttttcttttctttttttgtttttttttggagaggttttcttccagccctctcgttgcctgtactgaacgcttggtatgcttgagcaaggtggctatataggtgccagtacgaggcaaaagggtaacggaaaagggtggtgctagaacagttcatggaaaatgcatgccatgcattctggtttaaacatggaagatgagtagtttttgatagggatgacaactgggtgcatacaggattgagaggaagtctatctcttctatattgtagccatctttataagcgtgatattattattgtcttttaagtagagtctacatggcgttttgtgatgctactgaaataaaaagtagctagcgttaccataagtgacggtacgaaagagaggcgtgacaaccgagaagtggcgagtgcggttaagttggcaagcggccacctacttttgttttttgtcatcatattgaaaagggttaatattatagctgttggcttgttgtagccatggaacaatgtgaaaagaatgacaagtggacggcgaaatggtagtggatgcatagttagacttacgacaaacctacaacctattttctatatacggatgaaagaagtgtcatttttatacctgatacacctattattcccgctaaatttcataaaaatgagccaaacttaaattccttatttgtgagttctttatattattcctttttatatcgcataaattgtgaagacacggtatctatgaatgaggtttgacaaatgctatcaatgtttacaaactactccatgtccttcctaaaattgtgcttcacggtttatgctaaaatagttttgctcctaccagaagagcttgtggagcttgtgacgattgacttgggccatgatcaccggccacgcagagcacatatgcaccaccttgatcacaaccctcgaggcctctccatgactccatccatccacttatccacagtggcttagcataggagtgtaagtggctaacctgcgaactcacttgtagattagaataagcgggttcaattatttattt

SEQ ID NO: 18381 - DNA, 272 bp, Oryza sativa
tggaccctgtctgcaaccacgggagggtctccgatgtgagtgctaagcaccgtcagacagttacgatgatccacacaggcttgctaacatgtataaacaaattcttcgatgactgggatattaacccggatggatggacatgtacgtaccacacaaagattagcccgaggtgccaaaagtgggtagcttctgccaatgccacacatacacaagaaagaaaagaaaatgaaatttcatcccataacaaatttgagtcatcttcctgctgcaga

SEQ ID NO: 18382 - DNA, 438 bp, Oryza sativa
cccatcccacctcaatcccttctaccaaacaaaaaactataaccatcccataccacaaaccaaacagacaactggaactatcccatcctaaaaaactgggataggtctaacccatcccactttgtccccaaaccaaacacacgcttattagtttgggagggacggagggagtagtcacaggctgcctcgggctcaagcattgcaacgggacgggatctgctgaacgtgattctttcttttctctctttttcagaatctctttaggtttggtctcttttttttatatacaatggatttttttcagcggtttttcagtgggaagggaaaaaatacgattgtgctttactaagacggtagagatcaaagctaagcgtattactgcgtagtactccattttgaagcgaaaaaatgttgttgagtcagttgtttcttcatcaa

SEQ ID NO: 18383 - DNA, 1501 bp, Oryza sativa
atctatttatttctgaaggctcattttgattaattaatctccaaatagactactagtgagtagtaggtctgcacaaatgttgctctgatgcctgcttacttccgttcctgtcccctttcttcacttgtgagggacgagtcaatgctgcaaatgaaaagaagaaaaaaagagaagcatatggttatactgtcaaatttaactactgaattaaagagttactcagaaaactcattcattcagtgatgcacttcccaaagagtcctaacatgccggaagccatacaaaaggcttttgctacatgctactagtaaacaacttgctgctatacctttattcagtgcaagctattatcaatagaaaacactggcttatctagacgcctagaatatttttttagataaaggagatttcttgggaattatcctggtcacaagacaacttcctaagttctcgtcagatacttgcagcataaacatactagcaaaaggctaaacgacccagcatgacacttggtacaactactccaagtatctcgcaatgtgacttggcagctcagcgctgttcccttccatagtcaggagcttgtagaaaagatccctgcgcaaggcagcaaccctaccctgcgacagacaaatgatggggaatcacggttattattcaggttaatcgaattggtggaaagaaaaagaggaaatgtatcaatgcaatgtgctcaccgaatctagaacattgctcagcttgccatcatagaactcgcgcgcatagtataatgtgtgaaaaacagagttccatctgcagcaggaagatgactcaaatttgttatgggatgaaatttcattttcttttctttcttgtgtatgtgtggcattggcagaagctacccacttttggcacctcgggctaatctttgtgtggtacgtacatgtccatccatccgggttaatatcccagtcatcgaagaatttgtttatacatgttagcaagcctgtgtggatcatcgtaactgtctgacggtgcttagcactcacatcggagacctcccggtgttgcaagacagggtccaaaatgtgcatttgcctcttctcccatgtcccaaatgtagcatgcccatgtatcactagctaattgaaccggggaaatgagctgtattttcgaaataaaatggttcactagtcagtatatgtgatgatcaaaggagattggataaagaaacacaatatataatccgtaccagttggcagttctgtattttgtagccgctaatatgttgatcaaacatgtcactgactgctttcatggaactgaagtttcgttcaaacatcaaagctttctaaaaccaaaatcaaggggaaaagacaccaagctttggtcattgttttaaccatgatttcttatatacatgtacatgtatacatatgtatatacatgtacatgtacatatgtatatacgtatatatatatatatatatacgtatatatatatatatatatatatatagga

SEQ ID NO: 18384 - DNA, 1501 bp, Oryza sativa
tttgctcttgttcgtgctagatagaaacacgtggtatactcgaaggttgtagtgattaccttgttccttgttatcctcctgaataacacctgagacttggttgtcttgcaaattcagaactagcatcgctatctgactcatcacaaaatttcataaaagctattgttgtactcgtgccctatgtcaatgtttagtttcaatgcaattttaagtacaatacgttcagagaacatgagctcatgtttgatcacaataattcgagtccaataagataagccagtatattccgttgataatagcattgtacgaagtactgaataaatgtccagtagcaagttgtttgactgatgagtagcgtgtagaacaagctgctgtatggcttcctgcatgttaggactatttgggaggtatacattataaatttcaaattttggcagttgaatgatctgctaatttttttttttcatttgcagtattgactcatccctcacaagggaagaaagggaacagaaacggaagcaagcgagtgtcagagcaacatttgtgcaagacctgctgctcactactttatttggagattaataaatcaagatgagcctaagtagtcgatagatgcatgggtaaatcctggtgcatatttgcatagataagtgcccggtcaaattgctgaaggtaatatccatggcagataggcacgcttctgcggcaccaggcgtcgtttcctcccgtaaggtgcagagttgatgtgggcccgggggcatcttaagtgttattgtagccggtctgtaatctgtatctccagttccataacaatccgcgatcagcatacgatacacgtagcagatcgcggttgtgtttgtagcgcttctatgtttagaagcattggtttcttgtaccaacgtaataattatgttacgggacagcagaatggtatgcagtttgtctacttctgtgagagtataataaaccaagtttacaactggttggttttggaagattatgctgtaagatgaagcatctgtaacgtgttgtacgtgatggtatcacttgtaccgtgccactgcatgacgctgtaacagtcttatggaatggatcgatacatgggggatggggggtgtttagacgagggtgtaaagttttggcgtgcatatcgagtattatatagagtattgcatgaggtgttcggacactaataaaaaaactaattatagaattcgaattcgtcggtaaatagcgacatgaatttattaggcctaaattatttattattagcaaatgtttattgtagcaccatattattaaatcatggagcaattggatttaaaagattcgtctagtaaattagtcgcaatctgtgcaattaattattttttagtctatttaatacggctataattctgtcggtatttgtgtttttaggctgtgtttagttcagcgcaaagtttgaattttggttgaaattggtgatgatgtgattgaaaagttatgtgtttatgacagg

SEQ ID NO: 18385 - DNA, 1501 bp, Oryza sativa
ggttggtagtctgattcacattgctttggagtaaaaaactaaaaatgcctaggtgtagatgttgttgtacctattgcacgaaattttgatggtacaaaatgttcattctgaaatggactgggaagttgtacccgtaatccgtaattgttgacaagtcaagatagttttgggttagaggtagggttgcaagcgggcttgtccgcgaacccacttatagataaaattagtgggtaacccgcgagttaaattagtgggtaacccgcgggttacctaataatttgacctaaaaatgagtatatattgacccacttgcatatttagatgcggttatcatctagtatttgacctataagtaaattcgtgggtcggtccgtttgcatccttagttagagggtttaatttaggagtgggttaaagaatggtagtaggcttatcagtgcttttgcacccaactccggtcatggccccgtagattaaagttaggaaaaaaatcattaatgtatgttaattgggttttaataattattagaagattgaaaaataaatttatttcgtattttgaagcaacttttatatagaaaattctttcaagaaacgcagcatttgacacatttaaccgtttaaaaattataatgactgaactgagttactgctagtaactcctactccctccgttctaaaaagacactctctccgctccaaaaaagactcaattcttggatttccgtgtcaaacgtttgatcgttcgtcttatatgattttttttatgattagtaattttattgttgttagatgataaaacatactttatggatgacttatctttttaaatttttttataattttttcaaataagacggacggtcaaacgttatatacggaaacaggctgtgtttagttcacactgaaattggtttggttaaaattacgatgatgtgataaaaaagttggaagtttgtgtgcgtaggaaagttttgatgtgatgaaaaagttagaagtttggaaaaaaaaattggaactaacgttaggaattgagtttttttttttaagactagggactagggagtactgagagaagaatggacgtatactcgtccggtcgtcccgatgtgccatggctaccaacacgcgtcgctggagcgacaccaccacgctgttgccgacacacgaactccaccccacggcccacgctagcccgaccatgcgccgacctcacgcggtcaagcggagcccggctcaccccgtcctcggccgttcgccgtctcggccacggtccggtctcacgggctcacggtgacggatgcgattttatgccaacgaattttactcccacgcccgtacgctgtgggcatttggcgcgaacgccgccggcgccgcggcgtggccccaccaatccaccatacggtgggcggcgacaaaggcgacgcggcgtgtttccgtttcacggcggggtaagagtaaaaccgcccaaaaacaccgggaggcagcggcagccaccggc

SEQ ID NO: 18386 - DNA, 949 bp, Oryza sativa
gcaaagtggtgtggactgaatttttgtgctctaatagcagcacccaagctatgcttagctaaactattgtctattccatttggacttacaaaaatgttgggcaaattattattctatactaatgatgaatacataagccaatgggaatgtaagaggatgactatagcacaaacctctagttacataacttttgtatttttcctcctaggatttccagctccttttaggatatttagttaatggtgaaaaaggtgtattgtaaagtgcataatttacatgtggatttgatttttctaaactaaagcatatttgctaattcttccatttatacacgggtttttaaatgagcaccaaagttgggcaaatggttaggtccatggagatggagatcacacatgttggtttgaagatttttatatgaaatgaggggtgggaggatggatgtagtgtaaagcactaaagcatcaccaccttcttcaattgaaaattcaatgtaacaatacatgcatatatatttgactacagggcacatgatatatttcgcaattcagcacattttgcaagtaaaacaggccattctagaacaacacaaacacatccacctatggttagtgcaagaattcatgatgtgataagtttcagaatgagcttaagtttaggaacatgctaccatctgtctagattcatagtactaggatgtgtcacatcccgttctaggtttgatttttgtgggacggagggagtacttgattgcttggcttgcttgctctagataatttttcaagtagaactttgttctgtagatattgatgcatagacagccaaccgggataaactgcatagctaatatttaacatgaattttcccacttcctcttgcaattgtcttcttaaaaaaaaaaccaaactacttatcataactcataactagcactatctttcttgccagg

SEQ ID NO: 18387 - DNA, 361 bp, Oryza sativa
tttgagtctgtaggaaaaaagtaatgttttccaaatattggagtatgtggcttcagaccgccgacaatcttatttggtccacaaattaggccaacatagaagcacaggtttggcttgtttttcctccaaacaagaaaagcatagaggaaggcaaactggcaacttgttttctgccgaacagaatattcattagagtcgtgcctagccagctgccaactgcagaaaagcatagaaatcaaatcttttttaggacggagggcgaggtcattatcagaacaagggttcaaattttcaactaaagcatcggattcagatatcgggcacaattgcccgggaggcctaggactgaaccggcccaagc

SEQ ID NO: 18388 - DNA, 260 bp, Oryza sativa
ccataataaaatggcaaagagaaccatgatttagcttcaacaagaagcgaatggggttaactgcaaattacacgcaacgaaaaccctgcatcgagggcacccagccgccgtttgtttactcctcctccgcctccctttttcttcttttttttttctttttcctcctctatccacctcgatcgccatcaccaactctcgatttgcgaggtgaggacgagctcgccccgggcttgattagctcaagccctgaaccccccaga

SEQ ID NO: 18389 - DNA, 359 bp, Oryza sativa
ctattctgttgctatgtactgatactactagtatccagacattcgataccatatagtaatgccaatgtacttagattcctcctaatcctagtgccaataatgtggctacaaattaactctctcaatcatggagtaggagcacacaataaccaaaaatttaatgtcagcttcagctgccttagtcatgtttaatgatatggtgacactgtcttgactttgttgctaaggcactgacttttttcgctaatcaaaagattagccacggacaagatgcttagttagttagattagatattgagttggtgagattagttaccgggatgatattgagaggcttctggataacctgatcctacaga

SEQ ID NO: 18390 - DNA, 255 bp, Oryza sativa
accccatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaat

SEQ ID NO: 18391 - DNA, 253 bp, Oryza sativa
aagaggagggaatggagtggggtgaaaaagggggggattgggctggagtctttatagggaagaggggaagaaagagaggggaaggaggaggaagggtgaaacgacggcggcccgtcggcgcggggcgcaaggcggcgggctcgcggcgcgaggcgacgagacggcacgcggcgcggcagcggcgatgggacgcgcgcggcgacgggacgttgatggcgacggcgacagcggtggcgcgcggctcggggcggga

SEQ ID NO: 18392 - DNA, 486 bp, Oryza sativa
tatttaaaactccctccataaatttttattgtgagtatttgttttgggtagcaataccaagaagagtgtcgaatttgattaattaaggctgtgttcgaatgttgatgttggaaactaatctctagcacacgcaaaacgaaacaactcattatggcacccacaatggttatctataggctctctataagagatctatgtcagcatattttcctacatggaagatattaaatgaagagagagagcaaagctatctactaatttagagatagtctatagagaaaaacgagacaatgcatgagagagctatagatacccatgtagacatactattgaggcggtttattattaatctagtctattgctgagatgtatatgttttatagatagcaccttactttaccattgcaggtgctcttagcatatgatttattaataaatactcattagcaactcattagtttcaaaatactggtttaagtacctaca

SEQ ID NO: 18393 - DNA, 277 bp, Oryza sativa
agagaaaaagaacagtccagtttggaaagagaagggtgcatgtggtatccccttgaagtataaaaggaggaccttgcccatagagagggggttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacaga

SEQ ID NO: 18394 - DNA, 351 bp, Oryza sativa
caaattcatatacgttgttctagttattttaaactaaatacttttaaaattattgatagtcaagttataaaagtttgattacaaccttatccaaaacgtcaagaattataaaaccgggtgaagtaattatagaacttgagtagttttgcgagcggttttggtcctacatgacagtttaatcaacaattttcttttaagaaaatatgggacccacctttcagattctatctactgatctgtatctttttcccctctcacctctatctctatctctctatccctggctgaggagtcgcgacggctacaagcctactcttgcgcatgctagcggaggcccagtaggagcggcga

SEQ ID NO: 18395 - DNA, 1501 bp, Oryza sativa
catcttacccatttatctttcttgcaacaggaacctgttccggaaaacttcccttttgaaatccttgacgaagaagggatgagtgtggttattctgaaaagggactacaaagatgagaagattgaggtcattgtcagcatgccaaatttagaagggggccctgagtttgacgacgaagaagccgagggtgagggcaagaatgctagcaaggatgatgaagatgaagaggaagacgagagcgctggagatagcagcgtgtctctaaaggtgacagtctccaagggctctgggcccaaacttgagttcacctgcacagcctttcgtgaggagatcaccatcgacgacatgttaatagtggagaatgcagccacagaaggagatgagaaattcccttacgagggccctgaattcacgtaagaacaccggtttcaatctccatttctcaatccttcttgagcaccatctctactcataatcctcatcgaatcgcttctttctactacagcgagctaccggtgaatgtgcagaagggcctattcaagtacctggagcaaagagggatcactctgccgaccaccaactacatgcacgattacatggtgaccaagcaaaccaaggagtacgtcgggtggatgaccaagctgaaggacttcgtccggcaatgagaaattgccgagcaatttggcaggatttttggtagcttagccttttagcatacctgcatatgtaacaaggattactagaattatgcgaagcaatgcaacaaccggggaaactgccttccctgcaatgtgcgatttctgatgcccagtagtcaatctgaggctattggcacttatgatatcagtgcttattttactagccttttaccgtttcttggtgctgcttatctgaattttgtgtggaattgtgaattgtgatggctgaaatgatattctatgtgaaaagaaattactcgatggatgtctgttcaaaacttaaaccgctactaggaatgcttaaacatgtgaatagaggtagtaatatagtctgataatgacaatgatgattagataatgagcaaagcaagggggtaaagagaaaatccgtaaaagaacaattgaatttattaactatctatactaatggacaacaattcttgattgaatttaattaacggataacgatatttggtagataatcgatttttttttcttcttctccaagaagcaaacaaacatgattgataacagaatggtcctttccatttttttttccatattaaaacaacataaattgtcgtcctcatctccaattctccacagctcgtaaacccccaaaaccctgactaaaaccttcgtcatccgccgctgcaccgtcgccatggctctcttcgccgccgctcgccgcgccgccacatccaccctccccctgctccgcccgctggccgccgcggcggcgcggccgcagccccgctcgatgccgttctcgtcgtcggcccccttgacgaagcccgccttcg

SEQ ID NO: 18396 - DNA, 516 bp, Oryza sativa
caaacatgaagctacattttgaatgaggcctcgtttgaatggaaatttgaaaagaatttccggcccatataagtgggtgggccaggacttcagcccatccaaatgtggcgttgtagcctccgtgtactagcacggagtaattgccgcccaccgcccgcgtctgctcagctggtttaaatttgaatccggcgagcaaaccaataactcttccctcttcagtcttcgctcagactcctcgccatttgagccatcttccgttgagacgtgtaagctcgaatctttcatcttcccatctgatttcgccaagttgtttctacaaagatttgcttgcgatttcttttgtcttggcagattcgaatccgggaacggaggttggaggttactgagaaccagttcgacgaggaggcgcgcgcagcctgttcggcggaatgctcgggaggaacgccatgctcgggccgccgcgccgtggcgagggggagacgtcccggcgtggagagggaagcgaaggcgacggca

SEQ ID NO: 18397 - DNA, 480 bp, Oryza sativa
ctaatcaccatttcaacatgctgaagaaacagtttttcttttaccactcacctggtctctgggtgtccagttagcacatctgatacttctgcactgcagtatcaattaacaatagctactagtggaggcattctgggtttcccatcatctgtcttaggcattcaatatactattaaaaccctcaagtttgcagctttgggaaagtattgttcttatcttttgaaatagcttgctgttttttgttgtcacaataatttatcttttgacattagttaagattcccatagaaattcccatctgtacaattttgttcaagaaaatacactttgtaggagtaggtgataatctgctcacaatatatcactaagttattgtttttattctcaatgtattgaatatcacttgtatgcatgatgtgaagttgattcagtatttcaattaccatagttcattgctgaaaaatcacttttgtgcccaata

SEQ ID NO: 18398 - DNA, 1501 bp, Oryza sativa
acccaacgggcctttcacctcatttgaagaaaacatagcgatttttatcttggttggatcagttcctatttatttttgattccgtgagattatatttgattacgcatcttctatgacttgatttcttttaatcttattcttggattcgatttcagttaccataaacatgtttctaggtccgatttatttacaagataggattattttgagggaatttgggttgcatctgtttgtttttgtgttcatgctttcaagtgacttttgaggtgagacggcattgagacacgtgcggagcatttgagacaggtgtgaagggcaacaacgtgccaacgtgagggaagcggaggctcacaccgtgacggaggaaagcggactatcacggacgaaggcgtaatgtgaagatcagaaacatatgaattttttaattagttaagactagaaaaaaatacccgtgcattgcaacgggtgaaggttattttattcttattatattatacggtttagttaagatgaaattcactttgggaattcgctttaatatataactttttagaaaatcgtgaactacaattaagagtccgatcgtctcaagttagcgtgcgagttttttttataagagatttcttatacgactccttttgtattttcaaaagcgaacgaacttaaaaaccgactcatacacagatgacgtaccaaagtactagcaaaaaatatttttaatttttataatagtagagattagataaagatatttgtaaatttctactctacgggcctatttggttctctaccctacctatttattggtagtgccaaaatctaggcaaattttggcactgccaattttttggtagggaaaagttaattagactacttttggtttaataccaatatggagccaaattttaatagtatggtgaagaatattctagaatatgtccaaattgagtatgggcactatcaattgtttggcttcaaaccaaactagcatatttactatttaaattaccaaaattttggtagggcacagttttggcttcaatccaaaacggtcctacattcggtctcaaaactgacataagtggcgacgtctgggcgtaatttgaatggaaatttgaactaatatggcccatatacttacatggatgggccagaatttcagcccaacccaaacgagacgttgctggcctccgttcagcatggagtagttgccgcctccttatgctcggtttgttgtttaaactttaaatttgaattctgcggaaaccaagaacaccatttcagccatcttcttccttcgagagacgtaagctcgaataattcatcttcctcttttgatttcaccttcacatgcaagttgtttcctcaaagatttcctcgcaattatttgtcttgataggttgaaatcgaagaatggaggttggaggttactgagacctagttcgacgaggaggtgaaggcaacctgttcgacggaatgcgccgggggaaagccgctctct

SEQ ID NO: 18399 - DNA, 955 bp, Oryza sativa
tcacaacctttcaaatgttagaagtttggaactcttagctggtgctggagaggtatagtcttttcattatgttgtatatgtattttgttttcttcaatatccagcccttttgaacataatgatatttttctgactttttccaaagaaaccttttccctttcaccagatatctggttatccagtgagaacatgtgatacatttttttgctgcagtatcaattgattaaacctacttacttactcatagcattctatgattttccatcatccgttgtgaggcatttgattggcaactaaatctcttgagattgcagctttgagagagcaatgctcttagtcgttcaaaaaaagagagagcaatcctcttagttttggtgtgattgcttgttactttttgttgtcgtgatagtgtatcttttgacatcagttaagattcccacagacaatttcgatctgtgtatttttgttcaaggaaatacactttatgatatactccctccgtcccataaaaattgcatttgtagctccaaggctttgtcccacaaaaattgtatttctagtcatatggggcccaaccaattgattcatctatataagttttcttccatcccacgtaatttgggctgctaatgcttgcaattttattaagtatgctaattatatgggttaattctctcaaacttccttttaatcatttgtatatatggaatgtgtgtatgcagtgggttcattaaataaggttattgtggtcatttttcaatcatactattttgtcctaaattagctagaaatacaatttttatgggacggaggtagtagatgttaatccactgtcaatatatcaccatattattgttttcattcttgatgcacattgaatatcatttgtatgcacgatgtgaggttgattcaatcattatagttcactgatgaaaaagcacttttgtgtccaata

SEQ ID NO: 18400 - DNA, 1038 bp, Oryza sativa
gacggccggcggcgtgatggccaagctgatcccgcgcaacacggtggtgccgacgaagaagacgcaggtgttcaccacgtacaaggacaagcagacgacggtgaccatccaggtgttcgagggcgagcggagcatgacgagggacaaccggctgctcggcaggttcgacctcgccggcatcgcgccggcgccgaggggggcgccgcagatcgaggtgacgttcgaggtggacgcgaacggcatcctcagcgtgctggccgccgacaaggccaccggcaggtcggagaagatcaccatctccggcgacgaccgcaagatcagccaggaggagatcgaccggatggtgcgcgaggcggaggagttcgccgaggaggaccgccggcacagggagcaggtggacgcccggaacagcctggaggcgtacgtctacaacatcaagaacacgctcggcggcaagatggcggacgccatggagggcgaggagaaggacaaggtggaggaggcggtgagggaggcgtacgagtggctggacggcaacccggacgccggcaaggaggagtacgaggagaagctgagggagctggaggacgtgtgcaaccccgtcatgtcggcggtctaccagaggtccggcggcggcggcggcggcgcaccggaagatggcaacgtcgacgacgaggatgaccacgatgagctttagtttagtcgctgctaggtgctagctgctcctgtttcactaactatatatatagagtaattttactaggcaatcaattactccctccatttatttgccgttcacttttttttcatatgtttgaccattcgttttatttcaaatgtgtgttcgtatatgttaaattttttttttaccaaaacaactatacggccggagtttgcaaagttaaatgaaatctagaattgctcgcaatagtcatttacaatctcactatattcaaaggtgattgcatcactgccatagtcagaatgatccgagcaacatccatcgggtatctcttccttcaatttcatcacaatcct

SEQ ID NO: 18401 - DNA, 1501 bp, Oryza sativa
actacaattactctggaaagaagtatatatatttctttgaacgagcaactagccctcacattcttgtcttatttattctggacataaccatgccgtgattagcacaaaaagaacacacaggtaggttcaaattagaaattttaccagcttataatcatattacaaagagaataaaatacatcttgctcaaaatcactgttacaaacatgccatctcagctcttttaatgggacgccattcaaaattatgagttcagtacacacattgtgtatattaacatccgcaaatactataatgacaacaggcctgtcagtctctcactgcagctcgtaggatgaaaaggtaaatccagaatctttctcattggtacacttcagttcaagcttctgaaacggactgtaaattgagagagcaggaaatatttatatcacttcaattcctcaatagaatttagttgttacatcgcaataaaaagtgccagcgaaatatacattacctgctgtttggatcataataatacccgctaatggaaccatcgctacatgaaaagcagacatagtagaaaccagctatggtcaacccacagtccactccaacattgacaaagtactgctctttccatctctacatgtagcatcagaataatgctaagttgttatgactttgtatttcaataaatggggcacatacatgaaaggtcagatggtgcagtaccatgaatatgtaagcatagttgctgaagtccacagacttgccaccatctgtctctatctgactctgtggagaaacataagtgagaaatgtatcctaacaaatcgtggcaactaacaacacgaagataggcaacagaataccagaagaggtgtaaatgatgggaacttggaccagtgtctaatatcatcctctgggctgcaaaagcataagcaggaataatgtttgatgagtaagtttggactgttaccctaaactagggcatcaattaataaaacaagtagatgatagtatcaaggataaaacataaatagttaactactcacgatgcctcccacttgccagtgaaaaatgtataatttttagcatccactatctccccctcccagaatgttaccacctatggaaattatttacaaattgctacgcaaatcagataatggtaacaagaagtaaaacatagcattattttacattttatcggaacaaactgtttgcctactaaattagtatacgaatgaacaatttggaacataaagatcagagtcaaagtggaaaaggaagtagtagctcacaggggtatcagctaagggaacattaactgcttccattgttccacataaataaccctgttcaagatcacagtcattgatccgcacattaactttccaagcttcttctttttgtatagtagagacattctgggttccagcataacactgaaagaatggtacaagcatatggtctggtcagttccataaacaacaccgataagaagattcgatccttg

SEQ ID NO: 18402 - DNA, 1217 bp, Oryza sativa
atctgaagttagaaattcatattctaacttgcttctatgagtatgctctattctatagctattaatgataatatctttcatagttcacatatcctttatgacattagataccaatacatattgttatgtttcacaaatttagagtgcagcacatgattgcttacttcagagtgttgatatttgcactccaacctttattgcttgtgtaacaaacattttttaagtatttctttgatctggtattattactgtctgggttgcagattcttgactttggttttgatcgactaggtgccacttcagaggtaaattgcactctgccatcatctgtactatgaatatattctgaatgtagttgacttatgtactgtttccttggtttgacagctttgctttaccttgcactagtaaatgtggggtagtccctctcaaataaaaatgatgaaatttgggggttcttttgtatgccagttctatgtataagtgaagtgtgtgcaatgattgggactatgtagtgtttattaaaacttgaatttagcatgtgagttctaaaatggtcagttggtttcgggttcagaattaagtttcttatgaatatattgcatagtgacacagttgacgttcacaagttgaacgtaatgcttcaaagtctttgggaaactttagtatcaggctctcagcctctaaaacaggcaagttaaatgacaagtgaatgtcatattcagcatatccatcctagacatatgacagacatggacaattatcttcatcagtgagctttctcctctcaagtgtatggtgggtgacagtgaaaaaataacccaggcatagcaggcatttctgaacagatttttctcattagtatcatatagttctaatagaaagtgttatgtgcctttggttatatagtaatatatttgtatgcatccttttaccttagaattttctggttcccacatgagctatttgtttggtttcatgctgctggaagtaacagtaatgctgggcaggtgggccatcccattcttatgacagagtgtgaatgcaatccatccttttctcgagccagaatgtcagaactactttttgagacatatggcgtgccatccattggtaatgatacttatctttttgtgccattgttatcaattgtgcatggtagttttgaagtaagaattgtcgatgctaaagatgtttcttcctatgtgagtttcagc

SEQ ID NO: 18403 - DNA, 239 bp, Oryza sativa
tttcgttcatattcaaacctgtctatttacatggaaacaaaagacacgattagatcattccaaattccaattagacattttgggcaattgatcgtgataaattgggtagccttctcgtttacgtgaattgatttccgcaaccgccgccttctccgtcgctccggcgaacctctcggtaagtccgatccgtctcatctccctccttcccatctctgtactctatccctgacacgcaataa

SEQ ID NO: 18404 - DNA, 1235 bp, Oryza sativa
atactccacagaaatgttaagaaacaagcactttaaaaggtccaaaagtcaaaccatactagtactagaataaatgttacagtattgttttaccattctcatttagttaaaagaatataaatatcattagtatggggctatgggcttattaggatgcatccaattaaagagcactagaaataccaatgatgattgcacaaccaaacatcaaataaacgaagcttcattttaaatgtaagatctagggaaaatgaacaatcagtatgctatcacttcaggtctgaccaaactaccatgacatttaaaacgaggggaatcatcatgtacatctacaaatatagccgtttatgtgtcaactatgatcatcaacaagtatgcgattaactcaaagaaatacataccggcaaagataacaagaccatctgtagaaatccttgctaaatctggaagtgttttgttcagatatcttggggtcaaataatccaaagcatctgatacgataacaaggttaaaggaatcttggcggtatggaagagggaacttgatatcagccatacgaacaaagcccttgcgcacaaggcttttgcagctactatcagtatcctccaaatcataaggctccactccccatgcttcaaccttcccttccttcaacaagttagaaactactgtacaactatcagggccaacatggagaaccttatgcaactcattgccatatgcctttttaagataaggaagtgcttgcatgacttctggtgtacaagaacctgaatgcaaatgcaaaggaaaggttgagataatgagaagcacaaaacttttcccaataacacgtgtgaaaaggaatacaatggagattcctaaaaaaatcaattactaaaccctcccagagagggtcttataagttataactatcatgttccaatatattttatcaaaatttagagggttatctattagtatcatgaagcttaggataatacagtaaactgcgttgctgtttgtaccacacatcagacactcagacagccaaattacattggtatgacagtgtcaaaattcagcaggggaaaaaataattatcacatggtccatgttgatcatgtcataccagttgaattctttatatactgttcatggcctaatgaagaataacaccgaaggcatcaacaaagaaaaaaaaagacagaaacattcatggagaataaaaaaccaaatgcagtatctccagaatg

SEQ ID NO: 18405 - DNA, 325 bp, Oryza sativa
ctgtatgctttgaatttgtagtgcaatcccagcatggcatggcaggactgtattgtatgctctccttgcttatatatacagcttcatgtgtttctcaaaaaacccttctgggtttgaacaattctccagaagcgtagctagacagctttattacaatagggtctatatattaaccaactgaacaagaaaaaaaaggtgtatattttctctgcaaatagctagctagccaaggaagaagaagaagctagaatgtttaaatacgttctactatgttttggtgattaatgaggccgaatataactaagctaaatcgtgtgtgcatgca

SEQ ID NO: 18406 - DNA, 1501 bp, Oryza sativa
gatatacccggttttgcggttgagggatgctattcatgtacggccatgagttgagggaaggaaagtggacttattcctttttaatatgacggactgtatttttttcagataatgatatgacgaactgtatgatttcatcaaccgtaaaatcgtaaatccgttccgtccccgtccatcatatatctgaacaaaacgtacgatgccaaattagcaaagcttactccctccgtccaaaaaaaacttaacctagtcagattcatcctcttagaagaggtcacatcccctcctaagttagtcatacattcgataaccggtgacctgaccaagtctcatgttggtccgtactctgtatatactgatcaagtgataaagctatgtcccattggcacgcgtctgaaaaaatattctggattcatttgataccatgacattggcacagatctttcggaaatatgagcagaggctacggatttgtaatagtttggtcgtagcctcgtagagttgccctttcggcagtgaccgtagtagtcaagggctacaataaactttgggtgttcacactaaaattggaagtttgattgaaattgaaatgatgtgacgaaaaaattgaaagtttgtgtgtatagagaagttatgtgatagaaaagttgaaagtttgaaaaaatattttggaactaaacacagcgtttgttgtactttggtttccatgttgtggtttctctctctctcttcataaaattctggccggttttatcttcgctggactgtctaaaaagatgagattgatacttctacttctgattcggaacgacgattactgctgagtgctgattatatagcatactaatgcaacatatgaaaactactgttgcatgtattactattttttttcccagagagaactaattgacttgttgcatccacaggggctttaccatccatgcaagactggacatgtctttcatatgcgcattggtaatggctcgtcgctgtacaaagtttttatgtcacaagtatcgaatccagcaaccacagcgtttttaccacacatagaagattgaacatattacactttcagttatagcattaagcaaaaagaactcgtcaaatcgtttcaggaagaagccgacctcaagctagagataacatagctaaaatcattccactagataagatcattttcgcgttaaggtagccatatatacatagttccaatgcactcaaaagaagcatcacatattctgtaatcccagcatgatcagtgcagatgcttacccttcagaaccctgctaaatacaatgtgataaagcgaaattatcatattgaacaagatcataagatattattggtcccaccctctagcttcacattaccatggtctggcgggaaggcctggaggatatgtcagaaaacaaaacatattagtttatggttttcgatcatgcaccacaaagaacatcaagtgaaccaaatgctttccatctaacaaaaacagtaataa

SEQ ID NO: 18407 - DNA, 215 bp, Oryza sativa
aactaatattgttttcatagtctttccccgggttagtgtttggtgtagacctgacttgctagataggcgtcattctatcaagaggggtctatgaagcgaacgcattgatcttgtgccatattagtttatatgcatgtaggtgcatttggtgggcatgtttatccaagtgtgatgagttttctcaagtcccaaacaaagagagaagtgggcatgca

SEQ ID NO: 18408 - DNA, 1501 bp, Oryza sativa
gtaatctaatttgtttctcttgtaaaagataatcaaaaatcttatcacacttggccacatcaaaactatatttaacctcactttgtcgatctttgcgaggagtcggcattaggttagagcaaacaaaaggcttatttttattagtccatgaccattcggcaacatatatatcatgatcaccctcctcctcactatcactagcctcagggtaatcaaccacattaacattaggccttttgtcatatggtctaacaagttttttattatccttaacctggctttcttgagccagagccctttgcatgagttgactaacatcaagaaattgttggctatctagtctttctctaagaggagcaattaaaccattaaaagcaagaccagccaaatctctatcagttatattcaagctataacatcggtttctaacatccctaaatctcttaatgtaatcaatgacagattcattatacttttgcttaaccgatgtcaaatcacataacctaagctcagtttctccagtatagaaataatcatggaatttttcttctaattgaacccaaatatgaatagaatttgccggtaaagaagtaaaccatgtaaaagcattaccggacaaagataaagaaaacaagcgcaatttaaaagtatcactattagcctcaccacattgcgccaaaaattgacctacatgctcctatgtggtcttaccatcctcaccactaaacttggcaaattcgggaactctataattacggggaaacggcacattatcataataatcaggatacggctttttgtaaaccctagcacgattcctagtttcgatcccgaatctatccataataatatcactaattatatcctccatattattaggcccatgttgattcagcggtggatttggtggcctaataggttgtgtttgtggcacaatatgattatattggccttgtctagtatcgggacgataccccctagcaacatcattataagcattaggaacatgtgggggaacttggggattagttgtagcagtagatataggaggatcaaatgtcctaagatgatacaaataactagcattagtcattggatctatccgttgtatcggtataatcgcgccggtctgaccggcccagggcccggtcggactggcgtccagaggcacggtcggaccggcctgagtcccagtctgaccggccgtctggccggtcggaccgacggctaggtcgcggtctgagcggccgtcaggcccggtcggaccggtcgtgtacaccgttccatcggttctattacccgtttgatctaaaaccgagtttaaaaactcgagggtggatgaataggcggttttaaaacttttggctaaaaccgagttttgtatgcggaaacgtaaatgaaaacggttgagaggaagaagctagcctatgttgaggtttgcaagcctagggtggtaatagcacaaataaactctagtatgtaaacttactcaaagtaaatt

SEQ ID NO: 18409 - DNA, 152 bp, Oryza sativa
accaaccggtaaacttcttccacctattattcccaattattgtgaattcttttcattttgggaaaacccgaccaaaaaaaatcaattaaataaaaacccccattaattttaaggacttaaaaaaaaatcgatccggtttaatgggggaagga

SEQ ID NO: 18410 - DNA, 1501 bp, Oryza sativa
catcaaggcaccaaaaagggaccaaaccacaagggatgaaggagatcaatcctcgtctccatcgaaaggcacaatctcagtgctggcattagagggaatccactcagaggcatcatcagaagtaaccttctcagtcgcagcatcactctcctatacagcagcatccacagcagcctcaggatcagtcccctctgactcaacatttggcacctcatccccatcatcatcatcatcactagacgtggagttctcacagaaggagtgagagggaccctcaccggcagccacatccctagcagcctcatatgcagcaaatgggtcctcaaaagcttcatcctcagaaacatctgacacatccttgcctgcagccttccaatcttccttctgatgcctctcaatcttcttgactttctttgctatcttggtgcccatacaaaagatagcttgaagtgccttcttgatggtagaagaagagctcgagcgctgaggagcaactgaaggagcggctgaagctaaacctctagtagaccgggatggaggagggggagccgcagcagaagaggaaggagcatgagggtggaaagccttctaatcacgttgtttggagaagtaaattcctatcatttcctcaatcatcttcataatgtatgggggtataaatgcaacctctcttaggatcatagatggtctcaagaatctcaaaccaaatgagcttcataacactgaaggcagggcactggtagcgcatagagcaaaggaggtgagcatgcttggtaggaacagttgtggcatccccaacctttggaagcaaggaccacctggaaatggaatagataactttatagttgggatgcatacctcgagtggtacccatgcaaccaaaaggagttcctttctcatacatgaagctagtcctgtgcatcaataaggcttccaaatcaaagagatgaggcgtcgtcagatcctctggatcaagctctaaggcagcagcaaactgacccatggagactctgtattgtttccccatagtcattcacttgatgaaatgagtgcccttcttggtggtgccaaaatatgctgtagcatagaactacccaataatctcctcattccaatcatactcaagagcaaggatctccccaagattctttgcctgacacactttgattacttcattaaagactgcattgttcttgtgcctcatgaatatccagtccacatacttcatctctaccactggatggggtcttgccatgaaaacggagttgtaccaatcaacttgcacaagagtgcgaaagcggggatcctgagaattggcatcctgcaactgggcgcgactcgcaaggagaggaatagcgttgtcagcactctgcagtgcaggccttaaactaaatatttaaatccatctgtcgtttgggcaatgtagcacggaaaacaatgtagcatgcatataaatgtatctgataacaaaacagcaagctactggactgtcatttgggca

SEQ ID NO: 18411 - DNA, 463 bp, Oryza sativa
gaaaaaaataaaataaatttgtgataagtggaaaaaaaaaagtttgtccacaccacttgcttccctgattaaatggttccaaatgtaaaccatcattgaaatagtattggccaccagataacgtttataacatactagagcaggcgacatgcacagtaatgtggccaagatgtctcagctgttggacttgacaccatgagaaaatgaagagtataaacatagttgcaatcatcaacacaattacagaactacgaagtgttagatggatctccctccccttgagcccaacggctcaagggggccttgacccgcgccctgatcgggggcgcccagcccaatcgctggtgggcccccgtcacactgtgccatataaagaggggtggaggacgggacgggataacgttacaaggaacgaggttcgtcgccgccgccactccaccccataaaccctaaccgatcgagg

SEQ ID NO: 18412 - DNA, 207 bp, Oryza sativa
actaattatgtgctattttgaatagtttactagtgaataattagataactactatgtagtggatcccgggtaatttttattctagattcgccgctgccttgagctatttgacgtaagcaactgctacgatcttgcgatgtcgaggacgccctggtagcaaagtgcgccgcgatcaaagactgtcaagcttccttccgcccttgaagg

SEQ ID NO: 18413 - DNA, 1501 bp, Oryza sativa
tgctacagcatattttggcaccaccaagaagggcactcatttcatcaagtgaatgactatggggaaacaatacagagtctccatgggtcagtttgctgctgccttagagcttgatccagaggatctgacgacgcctcatctctttgatttggaagccttattgatgcacaggactagcttcatgtatgagaaaggaactccttttggttgcatgggtaccactcgaggtatgcatcccaactataaagttatctattccatttccaggtggtccttgcttccaaaggttggggatgccacaactgttcctaccaagcatgctcacctcctttgctctatgcgctaccagtgccctgccttcagtgttatgaagctcatttggtttgagattcttgagaccatctatgatcctaagagaggttgcatttatacccccatacattatgaagatgattgaggaaatgataggaatttacttctccaaacaacgtgattagaaggctttccaccctcatgctccttcctcttctgctgcggctccccctcctccatcccggtctactagaggtttagcttcagccgctccttcagttgctcctcagcgctcgagctcttcttctaccatcaagaaggcacttcaagctatcttttgtatgggcaccaagatagcaaagaaagtcaagaagattgagaggcatcagaaggaagattggaaggctgcaggcaaggatgtgtcagatgtttctgaggatgaagcttttgaggacccatttgctgcatatgaggctgctagggatgtggctgccggtgagggtccctctcactccttctgtgagaactccacgtctagtgatgatgatgatgatggggatgaggtgccaaatgttgagtcagaggggactgatcctgaggctgctgtggatgctgctgtataggagagtgatgctgcgactgagaaggttacttctgatgatgcctctgagtggattccctctaatgccagcactgagattgtgcctttcgatggagacgaggattgatctccttcatcccttgtggtttggtccctttttggtgccttgatgccaaagggggagaaaattgcaatcgaaggaggtcaagttatctttttcagccttgctgccattttgacagtttgtccggaagttccggacctttggtcttggaagttccgggcagacttctttgcccccctttcactcctctatctatatggacatgtaaaaattctatgtgtggatgtaatgactgttaggtgctaagtataatccctgcatcacttcatgctatgattgccttatttcttgttttgtgatgtgataattttatctttttcggtgcttctcatgtcatttgcttttaatgtcatatttatttatcgctcttattacatcccatgaatgaaaagggttgaaggaaactctccatgtttgctcccttcctaatatgcatatgagcttcactcatattttccatatgc

SEQ ID NO: 18414 - DNA, 1421 bp, Oryza sativa
aggatccccgattggcccaacacatcaccatacaaaaaaggaaaatcaatcttactagagtttctatttagagttaagtcaattctctcgtaaaaattgtctggcatttttttcatgctctacatcaagttgttcggaccgtttcacaccttcggttaaaaaccctagtccataaaccctagtcttttgtctccccttcccctccttccacctatcaccgccacacttcctccctgccatcctccatttcttcctctcgaaaaagaccttgctacctcatgcccatctctagtggctcatgctgctagatacgctagtacttcctaaggctacttggttttaccgcaaccgcctagacacatcgcgtactatctctaggcctgagcgtttagtaacttattctggtgaccatcgctaccaaattattgttgctgtcaccggagaagatggccgaagtataaatcttgaaaagaaaagttcatgtgatacccgtaaacggttctgctagctaactatcgacagaaaactgtcaaattttttggccgttgattctgcgctaagatttgtgcttagatattttgctaccggatctaaaccctattttcacaagctaatcccatcatcgcatgtttatggcagatttgttcaagttacatagttacactctagttacatgctagttacattgtagttacgctataattacattgtagctatagtgtaactacactataactacattattatctctatataaattagatataaagttgcatatattattttaatacatatatacaagttattattattatagtatagttctagtgaaactatatactataagttagatttgaaagttttctctgaaaaaacactcacagttttttagctttttagctagtctcataataaatctgtttgttttatcgtgggagtaaaacatcggaatctggaggaaattccttgggtgggtagagagtagagactagagagtcccatttcggtattcaactatttctattttctcctctcaaaaagggggaaaaaaaggatcaaccactacgccttcgtcttcaacctcccgttgctctgaaggatcacgagattcctcgccatcgcagctgatctctccgtaagtttccattccccttctccaggtttggttgcttcttgcaaggattcgtcgcgaacttttcttcttctttttctttttttgttctgatctcgagttgcgtttccatggctgtcgtgtcccgtgcaggccaggtgttcgacgaaatgtcgctggaagaaaccaacccggcggtggtggaggaggaggaagggaagcccggcagcgcggaggaggatgccgtcgcttacggtgaagtccaggtgttcgacgaaatgccgctgaacgaaaccgacccgccggcggc

SEQ ID NO: 18415 - DNA, 1501 bp, Oryza sativa
gagtgccatgtcggtttgagccttttaggccgaaatcaatttattttttaagcaactgatttaattttagttttagatttacagaaatttgtttggcactatttacattttaaattgctgggaaattatgatcaattatttgatcactcggtaaattatttttagataaattaaaccaatgaaaagataattattatttctttaaatattaaattatttctagaatttgaacatattccgctaaagatttttgagtgaattttatttcaatattacaaagtgcatgtttctttaccattgcggatgcctttaccttttctcttttgcagaggaaggtgaagccagagctataactgcccccgtttgtgaaaatttgtgaaagttggaatatgttctgaatgtgtagaaaatttggaatatctcacgcatgtgcgacatgaatctgaatgtgtatacaatatgaaatatgtttttatatttcccagtataatttggagatatttgcgaggtatgtacaaattcaagatttttatgcatatgtgttataagtacctaagcaatcttaaccattcataattagttgatattcacccggtgcaacacacggacatatttgctagtatagaagagaagagatacgtctatataggccttgtttagttcccaattttttcccaaaaacatcacatcgaatctttggacacatgtatggagcattaaatatagaaaaaataaaaaaaactaaggcgcccgttgttaattttggtaattaatgacaagcgctaattgtggactaaccgtttctctttgagttatatattttgtgttagtaccacgtcatatgtgcgcatggatgattatcgatggattaaaatttgatggcgcgaagcgaagaaaagaagatggtaaaactagtgctttagtattaaattgatcgaggtatagggcaatcaaatttgctagtttatttttagcttcaccatactattaagaggggtaatgacctagcaaagagatgatcttaattgccacattaggtcattatgcatttagacttgtgctcacatttcacaacacacacattctattcactgagttcggcctgaccagggccggtctgaccacgtgcactaagccggtctgaccggccacctagtggcggtctgaccgacatgaatggccggtctaacaggcaacacttgtacggtctgactagccccctggtggccgggatggtgtgctcttggatgcccgatacagagtcgccggagccgtattcggtcagaccaagctgagggcggtctgatcgagccgaggccggtctgaccggccactcaacgtcggtctgactggctaggccgatggggccctctgacagagctacaacggctataaaactagcgattgtagggtagcacggtctgaccggccacatacctccggtcagaccgacaatacactgagttgggggatttcgcccccaacgactagttttggttgg

SEQ ID NO: 18416 - DNA, 154 bp, Oryza sativa
agcagcaagaagaagagggccaagggcgatctgggccaaggagaggaggcggagaacggcggtgggaaggtcgtggccgtgaccgggaagggctccgcggacgccaagtacgccccgctgtcatccttcgccgccaccgcgcttcctccccagg

SEQ ID NO: 18417 - DNA, 1501 bp, Oryza sativa
gtgaggcttcctccatctccttcttcttcaacttgtacatgtcattggtgttgatcttccccaagaggcttgcgggtgtcatccttgacatgtcggagttgatgagcatggcgattagggtctcatacttctccggtagagcactaagcatcttttgggcaacctcaagatcggtgtaggttgccccaagccccttgagatcattcacaatgacattgagcctcccatacatgtcattcacactctcatgaggcaacattgagaatgtctcatattggatcttgaggaaatgaagcttggcatccttgtactcacttgtgccctcatggatctccgccaacttgttccaaatctcatatgcgatcttaaggttgctcactctatcgaactcctcttggctcaaagagttgaacaaagcattcatgacttgagcattgagtaggaggttgctgtgatcaatctccgtcaagggcgtgccggtgagatagcaaagcctacatccacaatactccaaatatggaagcttatagctttgaggtgagtagacattttaattttccaagtggagtagtttgtggtattgaacatgagagccttccctacatggttcacctcgttcgacatcttctctctaggcggtgaagcccaatcaagagagaccaagctctgataccacttgtaggatcgagatgtcgactagaggagggtgaataggcgatttaaaattaaatgacacctaatcaaaactaacctaagttgctaggctcggtgagggacaagtctaactaagcaactaagttatgttttgcaatcctagagtgaaagtggctcaagtatatcactaggaaagtaaatcacaattcctaagtctagtttagcaatcctagggtgaaatgatctcaagtatgtctctaggaatgtaaattgcacaaatgtaaatgcggcaaataaaaaagacaatgagacgaggaatttctcaccgaggttcggaaactcgctggtttcctactccctgttgaggcgagcccaactccatcgctcaaccacgaagccaccgcacgcccccttcgtcaaggggtgggcaaggcgggagccggcccacggagaggacaacccaagcctcgatcacttggggtagttcttccttcactccaaagatggtgaactccaaaccactcacaaccggcgccgggcctcctccacaatcttctcggagaggtcaccgagcaacttctccacaagccgtctaggaggcggcaacctccaagagtaacaagcgatgacccggctcggagatgatcaagtgccacactagctctacaatggaagcaatgcacttgactcttggctaaatcaaccttcaaacacactagatggatgaacacaaagctcaagtgggtgtgtgagatgcaaggggtgtatgcaattgaagtggatgccaagagagtccccttgctgctagtgggggagtatttatactcccaccaaccaaaactagtcg

SEQ ID NO: 18418 - DNA, 205 bp, Oryza sativa
ttctatgataaaagtaaacattcatttatttattatatatataaaaaataagatcaaagatatattttaaaaactgtgtcattatccaaaacttcgagaattataaaaccgtgagggagcactagtattggcttagctatagtgttgactgtgggcgcgcccatttattaacctttgctctaacgtcagttttgactgctctaga

SEQ ID NO: 18419 - DNA, 1501 bp, Oryza sativa
ttcctactccctgttgaggcgagcccaactccatcgctcaaccacgaagccaccgcacgcccccttcgtcaaggggtgggcaaggcgggagccggcccacggagaggacaacccaagcctcgatcacttggggtagttcttccttcactccaaagatggtgaactccaaaccactcacaaccggcgccgggcctcctccacaatcttctcggagaggtcaccgagcaacttctccacaagccgtctaggaggcggcaacctccaagagtaacaagcgatgacccggctcggagatgatcaagtgccacactagctctacaatggaagcaatgcacttgactcttggctaaatcaaccttcaaacacactagatggatgaacacaaagctcaagtgggtgtgtgagatgcaaggggtgtatgcaattgaagtggatgccaagagagtccccttgctgctagtgggggagtatttatactcccaccaaccaaaactagtcgttgggggcgaaatcccccaactcagtgtattgtcggtctgaccggaggtatgtggccggtcagaccgtgctaccctacaatcgctagttttatagccgttgtagctctgtcagagggccccatcggcctagccagtcagaccgacgttgagtggccggtcagaccggcctcggctcgatcagaccgccctcagcttggtctgaccgaatacggctccggcgactctgtatcgggcatccaagagcacaccatcccggccaccagggggctagtcagaccgtacaagtgttgcctgttagaccggccattcatgtcggtcagaccgccactaggtggccggtcagaccggcttagtgcacgtggtcagaccggccctggtcaggccgaactcagtgaatagaatgtgtgtgttgtgaaatgtgagcacaagtctaaatgcataatgacctaatgtggcaattaagatcatctctttgctaggtcattacccctcttaatagtatggtgaagctaaaaataaactagcaaatttgattgccctatacctcgatcaatttaatactaaagcactagttttaccatcttcttttcttcgcttcgcgccatcaaattttaatccatcgataatcatccatgcgcacatatgacgtggtactaacacaaaatatataactcaaagagaaacggttagtccacaattagcgcttgtcattaattaccaaaattaacaacgggcgccttagttttttttattttttctatatttaatgctccatacatgtgtccaaagattcgatgtgatgtttttgggaaaaaattgggaactaaacaaggcctatatagacgtatctcttctcttctatactagcaaatatgtccgtgtgttgcaccgggtgaatatcaactaattatgaatggttaagattgcttaggtacttataacacatatgcataaaaatcttgaatttgtacatacctcgcaaatatctccaaattatactg

SEQ ID NO: 18420 - DNA, 310 bp, Oryza sativa
aagagccaattttcagtggcatataagggattagactaattttcagtggcatataagagattatctctccatattatctctccttgaggagcccagactaattaacatgttcagatgagtgaatactatttttttatacacaaagggtatttttgtgcattaaaattacttgcattacaatagaatgtatgtggttttagtggacagtagatgctatgtgcaaattcataaaattatttaccaacagaaatatattctttaatacataggaaatgatacacacactttccgatttttgtttatgtccagt

SEQ ID NO: 18421 - DNA, 1501 bp, Oryza sativa
tgctcatgaacatgacgtccttatgggtttccggacaatccatcccaaagtgaccgtcattgccacagacctcacatgtcatgtgagagttcagggccttaacggtaccctgcttggcgtccttctcattgttgtccactctcttcataaggagatccaacttagtggtgagcatttccgtccacttgacggtgtgcatgccgcgttgatgggtttggagccgttccttgctccaacccatgtttgagatcatcttcttaatcaggtcagcggcatctctgaccgtcttttaagaagaatgcccctccagcagtagcatccaggtgatctcgggacgagggggttaatccgttgtagaaactctacaggatgagccactcgtctatcccatgatgaggacagatggcgacatattcttgtagtctttcccaagcttcaggaatggtttcatccctcgtctgctggaagctggatattcttccacgaagagcgttgatcttgcccatcgtgaagaatcttgagaggaatgccgttgagcgcttcttccgggtattcacaattgcacgattggtgtaaaaccattgttttgctctcccgaagagggggaacgggaacagttggagtctgataacatcagggctaactcctttgatggtatacatgctacagatttccaggaattactgcagatgaacacttgcatcctcattaggcttgccatagaacgggctagcctgcgtcattgtgattgggctggttttcaaatcaaagtcaccatctcccatgttgacttgggggtccaataggcacgttgtcagcagagggaatagcaaacttgtgtagggtcttcccagccatatcgttcaactctggtggcgcggagatgactggtctggttgccacgagttacttgaggaggaatgacacggggtcagatttgcctcacaagtgacttaggattttctttggagttggtcggcaaatcagaaccagtcatgtactaccctgttttcacataaaagagaaaacaaacaagattttcctacaaaggacagtgatcatacagaggtgaatataaaataatcttccccgataacggcgttagaaatgcttgttggtatctcttaacgacattactagaaatataattccaaccaattatgtagaaatattcatgatatatttatggttacaggtataatccgcaagtgcacggatataccattgtagcatttcaccctgaagtattaaggtatcatatttatttaatcccacgagaagatatgataagagagaactatgctaataatttatatatattacttgtatacatcaaggtctatgcagggcataagtaatccaaatggtaggataaaggtgacacacagaagaaagaactaagatactctcactaaaatataatttaagctaagtggaggaagaataagaaaataattcaatcatatacttgtagtatacatacatctttagtttacacttg

SEQ ID NO: 18422 - DNA, 660 bp, Oryza sativa
tgtgcacaccgatgagacgatcgccagcagccgtcgtccggcgtgcagcagacaaccacctgcggccatagtgggcgcctgaccattaccgacctcgaagcacgatagcatgacagtggctgaacaaccggccagggtgcatgcaagaaatgcgccgtcacctacggctctgctaaatgcatgaaatttggtagttcaactttaaagatactgagacaccgcttattgatagcgaaaataattatgggatgattacataattattggaattaatagattggttttagctcttttgaagattaattctttgaaaaattacaaaaaactcacctcgtgggatgtcacgcatgcatggagatgtttagtaccatattgcctattatagaaaagggaatggtgctctcctaaccacttaagtcatgtgtggtggagacaacaggaggaacacacttgcgctcacgacatgcgcaccttgcacctaatatatccatacatcctcaccccttgcacccttacgcctgatatctccctacatcgtgcaagcgtcctgatatcttcatataaataaaccaagccgccgcctactcgtaacatacacgaaatcaatccatacatcttgcaagcatcctgatatctccatataaataaaccgagccgttg

SEQ ID NO: 18423 - DNA, 398 bp, Oryza sativa
ggcgaattcgagctcggtaccctcccacatcattttctctttttgtttttgcattatatatagtttctcctgattattggttatgaatgctctcttgtagactcttagcatgtataacgaattgctaaaatcttgctcacttctggttggacaaattatatttcattatttatgagaatgtatttacaattttgaacatgttactttgccacatgcattgcccaaatagtgaacagtttgcatatgtatttcttgtacgaaacaacccctaaatcctcagttgcctgtttcttttattgcttgttatattagaaccacatttttgaactatttaggttggaagtaccatattgaaacaataaatctctcatgttaccattcaacattctgtctgcaga

SEQ ID NO: 18424 - DNA, 1501 bp, Oryza sativa
acattattaattgtttttaagcatttactttttttacaaatagataatattcgggccaaggttggcaacttaattggcaagtagacggcattaaatgtttataattaatatctggttttacagtataattttaagtttcaaactttcacgaaagttcaggttgtaaagtgaactcttagtacagttagtactagatgaaaatggcatgttagttttgtgatctttttgtttaatggagtaatatcgaatcatggatatgcggtggtacatgtgaggctgaagtcaactacgtcagtttaaccgtgagttggactgtacataaataattgagaatactatcttaaaaacaaacaagtgggaaaaaaactaataatatattttggaggtcaaataattggaggcaagatcttttcctgatatagaatttgccctgatggcaacttccaagtcctgatagagagaatttggaaattccatgaagctaaaatactgagggcctgtttattagatcgatccctggcaaaattttacaccctaccatcgaatgtttgaacatatgcatggagtattaaatataaacaaaaaaaataactaattacacagattgcgtgtaaattgcgagacgaatcttttaagtctaatcgcgccatgatttgataatgtggtgctatagtaaacatttgctaatgacaaattaattaggcttaataaattcgtctcgtggtttacatgcggattctgtaatttgttttgttagtagactacgcttaatacttcaaatatatatccgtatatccgatgtgacacgccaaaactttacacccctggatctaaacacagccttaggcctgagtttgatactgataagtttgaactttccgttgaaatcgggaattatagacttgtccatgcatgcatgcatgacttgtgttcagccactgacaagtccttttcaatagcctaaagtgacaaccaggccaggtcaagcttaggaatatagtatatatattggactcagccattctattgtctttttttccggttaattacatttgacgcgggagtattagtttgtggtactcccgaaatcaaatatataattgatcgaaggaagcactagcagtatttacatcaatattacgtggatttagcctaaaagtggtaattgctgattattcctacaaatgccgtgatgattttctgtctactgattgaaatatgaaatatttggtcaatttaaccctcaataaagctgcactcaaatgttcagacgcgattaaaaacaccaactttgtggtagtcattgcactggtgattacagggttcgtcttggctatacagtcgcttggatttcttatgtggagaaaggcacggcgctgcaaaaaaggtaactgatccttgtaattatacttaatttctcagtatctaacagacaaaacgttttaggatccaaatcctgactgctctcttatactccatattgctcatatggcttctccat

SEQ ID NO: 18425 - DNA, 1501 bp, Oryza sativa
tgaatttttttgttaagcccaaataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctattttttttggtgcggttttttttcttttctttttttttgcacctttctgcctttttttctcactttttgattattttttaccaaaaacagactcaaggacctcaatgtaagatcacagggactcaaatgtaaatatgaaaaatacagggactcaaatgtaaaagtccacaccaaaattaaaattatacaaaaatggaatgctgaatttatgccggttccgtttttccaaaaagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggt

SEQ ID NO: 18426 - DNA, 1501 bp, Oryza sativa
tgcttccgaaaattgtaaaaggattttccgttgccagctcgtacattagcattttgtttttattatggtctaatcatgagcttgacttgtgttagaataaatgggctaggcccgatttttctattaaatctcaaaggcccataataaatgttaaagataataataccaccctgggaattaaacgaggagtatctcaacttcaatagggagttattggaggctccctgttgaccggttgaggtggggattggaaagccacacgctcgctggggcgggcgttgcgcctgcttctatccttttgcaacggatcagaatccaaccccgagattgcctccgtaacttgcaatggatcagaatccaaccccgagattgcctctataacttgcaacggatcagaatccaaccctgagattgcctccgtaacgggcaggcgattcaatacccattgatcgcgtcgttactgcggcaacgggcggatctctctcctgcgccataaggaaagggggaacccgatcagatccgctcggttactttccaaacaatgtccgctcggttactttccaaacactggtgttcttcctcctccgcacgccgccgctgggtattgatcgcgtcattactgcggcaacgggcggatctctctcctgcgatataaggaaagggggaacccgatcagatccgctcggttactttccaaacactggtgttcttcctcctccgcgcgccgccgctgggtattgatcgcgtcgttactgcggcaacgggcggatctctctcctgcgccataaggaaagggggaacccaatcagatccgctcggttactttccaaacactggtgttcttcctcctccacgcgccgccgctgcctgtggtgcttctgtctgcttccccggttctgatcgcttgcacgcacgaaagatcggaacgagcagggcctccggaaccacaccttcgcctgagatctgcactgggtaggcgggtgatcaggtttttggggagtgctttcgcactactgctcctcgtcttcagttcgtcgtcgaccgtacgtctgcatcaccatatctgccgcacctgcacctggagctggagcaccaggagctagtgcacagaactacaacaccaacggaggcagttctgcctcacaatccagcagagggactttcacagggtataatcctctactgttattttagtttttgatatttctgttagtcgcagtacaattgcgttctatgtatgatgatgatgcttattctaccttaagcatgctcctgtttatgtttgattttatcactagatcacctcacattgttcatgccatgattattgtcttaatattttggattaaaatatgccgatatatgactatatttccaacaatccaaaaacctgataggtcattttcggtagttggctttgctgctgcactgaaaccacatgcttttgattgttctaattataaaaggtggaaagcacgtgcactactgtggttgacagcaa

SEQ ID NO: 18427 - DNA, 1501 bp, Oryza sativa
gtgatagcattggactatgtccaaacggctaaaaatctggcagatcagtttactaaggggctaccacgtaatgtgatagacagtgcatcgagggaaatgggcttgatacccacctaaggttgcacaatagtggaaacctgtccattgtgatcggagatccgtgaatttggatggcgaaacaaactattgtgtggttgagagaagagacccttgaaaagggctcattttcatgatgtacttctcttctactctgcatggtaggatggcttattccttaatgtgatccgagtggcttttctaagcaaagatgttgacctgcagaacatctcagaaggaacacacctatatgagttcgactgctagtcacagtctatgagatttgggtgatctctagatactcatgaaagggcctggagtttgacttatatgctccaaacagaggggatgcaaactgcagcccaataccaatcaagctgatattgataattcaagttgccccctacgtaattatgaaggttcggctggatgttacatactaagtgctcaggaatgacttgaggcattactgtgccatccggccgtacgtggtgaaccaagtgttctagaacaacttgatataaaaattgttgtataggctgaccgccaggcgttgcaaacccggccgatgcacttattgaaccttggtgctgaatcagctgaacgacttgctgtcttaacggcgtctgccgaatcggctgcagaggctgctgccttggtggtgtttgctgagctggttgcatgacctgttgctgaatcggttgtacaacctgttgaattgggggtgtctgctgacttggctgctgctgtattggatcaacaataggttgaggtggtagaaacatggcagcaaccggatcttgggtcagccgattcgcaacctgcctactatgctgtggctgctctctcgtcaagaaccgaggattcaccggctagcctggcgtcatcgctgacaacgcaggtaggggagttgatgctggcgccgtcggctgagctgttggtgtaactgagggaaccgcctgaatggatggctgaacatcggtgatcaaggaccgataatttggaaagacacctcctttcaaataaactgggcctgcagcctgatgctcagctactgaaccatcggctattgacttcatcatgtttgataaggtattgactaacaccccagactgattgatcagagcatgatgtacggcgtagtcaacccggtcttggaaattgttgaaacaatcttgtgccacatcactattccgattaagatctcctccctataatccttgagcaccatcaccttgatttccgagagatccgtcggtagcaccattgtcactcggttgagctgagccatctggagcttgcttcccatctccatccttagaagaatcagttccagaatcatcagcaaccacttttaatttgtacttctgaacaaatgttcccttgcgagtctgtgatgtgacca

SEQ ID NO: 18428 - DNA, 1501 bp, Oryza sativa
ctcaaacacgacaaaccccccctaccctgttcatcttcgagagattcctcccaatcccgagcagaatcccccgccccggcgaatccgcgcggcgctcgaggtaatccaatccctcctcttcctccgccctccccctccctcgccgcgtcggctcgccggacggacggtgggttctccatggtgtcggctttctttgtgggctctgccgatttccgcgttcctgaggccgcgtagaatctgcataggagttgtttgggtagatttagttggcggaatcccccgcggtgtgtggaatggaggtggattagcttggctcggttcggtcccatgcgtggatatgctgggccgcctttggagcatttctttgtggtgtggctacccagctgtataataaacatggcgagtaggattacttcctgtgtagtcaatttagccattccatttagggatttctgattctgttgcaggtgtccgtggcactggtggtaccttgatagagactagagtgaatgcctttttctttgttctgtttcattgtttgctgcatcctgatgcaaattagctcggcctgtaaactgtaaaggttgcttgtttgtgtcgtcgagatgggatttagtgcgccgcggcagtttgatgatgaattagggccttagcaggttctttggttaggagaatgttaatccagggtgaagagcgaagaagaacaagtagctcattaagctgcaattcatggtattcatgaaaagttgaaacgatatgtatttcgtttgtaattcatttccacagcttttctgttaaaaaagacattgaggtgtgtttgttattcaagtagtggaaccacgtatggagttttctggaatgggaaaaaatcctaatggagcaatactgtgtggaggtcgagtctttaccgatacttgtcacaaaataatttagttattagctctcttttatgaaaggtagaagaatggttgtgaataactgggaatggttgaggaggatctgtttgtctattgtgtacttttgtgcactttggggctgactatagttttgtttgtagctttgcacaagatattagatgtgatgcctttgtcacttgctgaaatactgaattattttccctttgctgacagtgaatttgactagctagtagccacgcatgaagccagatggtgaaactcagcttcgtcctacagctgctggacatccagatcctggtttgggcacatcatctgcagaatacgtggcctctctaggaccagctacagtatgatctgttctctttcttgtctttagaaacatgacagtacaggtagtgcaacgactacctaggatccttttctgctcgaagttctgatggtaaaatttgactacaatttgatcaagaaataaaagatacattattatatgactaatttcttaccagttacatcgatacttagttcttttaccaaccttctcttatactgctcaggttcagccctaataaataaattatttcttt

SEQ ID NO: 18429 - DNA, 1501 bp, Oryza sativa
cgagccctatgtaaaataagaacacacattcaatataatttcggcacatcgccacctttttgctttagttttatttcaacgagttcttgctttcaggttgacctgcatcgttttcgatcttctacaagaggtaaaacttgttatgatggattatgctcttgggattagtgcttccatctttatgatactctaatctttgacagtatcgtcatttaatttacaaccggctaacagaaggcagccgattaggttaaatagcgacattgatctagattatataagatatctaccactctatgaaacttccagcggcttgattgtctagatattgttattcttttcatacttaatgttgcatcagttaagtttgttctattaagtcgtgcttagaaaaacaatctctagcctgcctcctggttgccgattagggtagtatcggggtttcagccgatcttatctgatttagctatatttacttcacatgcttagttgacatgttaaatctgccctttatgttaagatattattgtatttaagtatattaagcttctgtttggtatatcctacttgctttaacatcttaacatagagttgtatcggagtattagccgatacacactagatctatctgatcggctatgctataaacacatatagtcttgttattagtatatgtttcaatctgagcgatttatactgtctcggcatgacgaccgatctatcccaattacttgtgtcagggttatggataccacatacctaatagtagttgactaaatctcggcaggacccaccacataccatgtcctatacggaaacaacctacggatataggagggagttccggataaggaaagacaaccagagttctacatggaaacgacaaggactactcggattgtattggtttccctagttctacttggacaaggggacacctatgggtataaatacaagcccccctagaaggaccatggacgacacccatgacaatcaacacacgcccaccagaagccacaacatacaagcctacgtaagccaagacacaccgccggatatcgacttcagggataggcatggctattcccctacggtgtctccggataccgtcaggagatacgaaagcactatctctgatctcgccgggcacggattcgaggaggaagactaccatgttgtcgactacgagtcagaccttcagaccgacatgtcgacaacagtcagataggctacccacatattgtactggtgtgattatggtgaataagagcaatactggcttcggccaacaagatgtaggattattacctgacaactcaggggcccgaacccgtataaaaatccctgtctccatctcttttacctcagtctcgcgtatatcctagcaccgatgatccccatactgtccaaataccgtagtcgagacgtcaaacgtcgacagtggcgcaccaggtagggggattttggtgctctaggatttcgacgagatgggttcaataga

SEQ ID NO: 18430 - DNA, 1501 bp, Oryza sativa
cctgcacggcgtacgccggcgccgacatccgcggcggcgggagcgggtgcatacagtggttcggcgacttgatggacacggggttcgtcgacggtggccaggagctctacgtccgccttgcaaaatctgagctaggtttgtgacacttgctatctcttttaattcaacgatattaatctgatgtgttttttgcatttaatttggtcttgcaaattggtaaactattggaattattatctctatatttcagttccattatcatttttttcttactatttttttatactcctatttgaaccatatgcaagaataaaccacgacatatactctccatggcttaaaatctacgttgtcgtcatcgtcatcatcattgttgttcttagccaaaagcccgtgcattgcaacaaaacaaaaatgagtttctagcttatttaacttgattaaaaacatagttagtccaagtagtactttacgatgttttcctcatggtacttaataacctgactcgaattgtgcattattcagatcttgtccaccgtactggttttcaaaaaaaataaattattggtcgaattttggggaaagtcaacagtgaaatggaaaagaacttgtgggagcgtggggctgattaaaggggcccatttatcaagttggtggaggtggtgtgatagaacaatcaccactgctattagtatagattattattattattacagaagacagtgaaattattagcagtgtgatgcataaatgttagtatatagattgtgttctagtacatctttttgtgtagggataaaatatattacgtctcagtttctatgattggctcaaggtctcggtataactagtcaatagtcattttatcaaagaattcttctagctaaaaatttcactcatcgtgtcctcgcaaaaaaatcacccatggtagctactgagtgtggttggtgaagagaaataagatatggataagactagcttctatatatttgacttggcatctcctgcttctacctgctctatattaactattgatactacatggacaatgtttcagttagttgcgtgatcattcacttaataatatttttaatcatgcataacccaggtgctatacaacaacttcaaaccaatgctaactctatgggaaattcatacaataagttggaactttctattcaaatcaggaaatagacaatcgcatctacaaggacgaacaagttgttggaaatatagtcaaatatcggcatattttaatccaaaatattaagacataatcatgacatgaacaatgtgaggtgatccagtgataaaattaaacataaacaggagcatgcttaaggtagaataagcatcatcatcatcatacatagaacgcaattatagtgcgactaacagaaatatcaaaaactgaaataacagtagaggattataccctgtgaaagttcctccgctggattgtgaggcagaactgcctccgttggtgttgtcgttctgtgca

SEQ ID NO: 18431 - DNA, 174 bp, Oryza sativa
acgcagatctgctataggcgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcaga

SEQ ID NO: 18432 - DNA, 1501 bp, Oryza sativa
tgtttaagatcgaaaaacacataaaagactcaatcgcagcaaaacagtcatgcaaatgggcaaatgcaagctctcaccttatagttttattttattttagaatggcaaggaaaagttttaaattttcccacttgtcgcggttgctctagctagtttaaccttatttaggtattatgttgataaattttgcatgtttatcctctcatctccctaaagtttgagtttaataattcttatcatgaaaatctgaaaaataaattcaacttttaaaataagcttcaatgtttttagaatatatgacttgcatgcaaatgtcttggattctccttatttctcgtatgataccttgtgcttgtgaaatatatcattaggaagacatgtcatctaagcaattggtaaatgaatgattgcctgacaatatgacccttgcttttttctatttaattcttggaaattatattaaaaaaagtataactttgcctactcatcattaatgttttattcctaccaaaaccatatgttgatcttcatgataaaccttatacatatgctgcttgtatcattctatgttttgtcaaatggtttagacccttattagatttttttttctttcatgttctcatcatcaagatcttgtgcacatccaccatatattgctctccctgtacactgaatgtttagctaaacatttttatccaccatcatatgctatacttctactccggaagtcagcatccactatcatccatccaccaaataaagacttcacatgactatgattctccatcctctatccatgccaaatgagacatgagttaaaaaaagaaatgattttagaaaatcataatgttcaaaaaagaaggaaacaaaaaaaaatattcttgagcatgatgaataagataatatagaaaatagccatgttctccaaataaagtataaggaggaggatcataccaaaaatgagtcatattcttccattttcccatcatccacctatgtattcttttccacacacatgtgcataaacttgatcatggtggtttgattagtatccttcttggatctactccctggttttacaaaattttttatacaagtatgtcattcttatttcctaccatgagttccacataagccttaatagaaatataggacaaattgccaaagcaaaaagtgcctaagtccctaaggatcacaacgggccatgctggaaataaaattgggctgaagtactgtgcaggcccaggcctgttagcactcccgataccctaaaagcaccgaagtgaaataaaacgtctcttcgtcttccccgccgagactctcgccattatccccattctctgctacagtacaaaactgcgccggccaaactagggttcatcaatccgctccaatccatcctcaaaaacttcacaaaatttctccccacatccaccgctccgattccccatccctttccagccgtatctcggaccaaatcaaaccatccaactcacattca

SEQ ID NO: 18433 - DNA, 239 bp, Oryza sativa
ctcggtacccgagaggaggtgaggtggagccgcatcaggagctcaatgagatggtggtggtggcaatggaggcaaaaaacggggagtagacaagtacctctctcaaacacctcatggagttcgccaccgaactgagctctagttggatctgtcaccaccccgatctccacgtggaaccgacaccacctcgagcttcgcatccaatcatctccacattgcgataggtctattaccctaca

SEQ ID NO: 18434 - DNA, 1501 bp, Oryza sativa
tgggtgtcgtccatggtccttctaggggggcttgtatttatacccataggtgtccccttgtccaagtagaactagggaaaccaatacaatccgagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacacaagtaattgggatagatcggtcgtcatgccgagacagtataaatcgctcagattgaaacatatactaataacaagactatatgtgtttatagcatagccgatcagatagatctagtgtgtatcggctaatactccgatacaactctatgttaagatgttaaagcaagtaggatataccaaacagaagcttaatatacttaaatacaataatatcttaacataaagggcagatttaacatgtcaactaagcatgtgaagtaaatatagctaaatcagataagatcggctgaaaccccgatactaccctaatcggcaaccaggaggcaggctagagattgtttttctaagcacgacttaatagaacaaacttaactgatgcaacattaagtatgaaaagaataacaatatctagacaatcaagccgctggaagtttcatagagtggtagatatcttatataatctagatcaatgtcgctatttaacctaatcggctgccttctgttagccggttgtaaattaaatgacgatactgtcaaagattagagtatcataaagatggaagcactaatcccaagagcataatccatcataacaagttttacctcttgtagaagatcgaaaacgatgcaggtcaacctgaaagcaagaactcgttgaaataaaactaaagcaaaaaggtggcgatgtgccgaaattatattgaatgtgtgttcttattttacatagggctcggggtctatttatacccgagaattacaagatatgcccataccggacacaactattatctctaacaaacactaagataacataagtctttacggcggacttttgcccaagcatatctataatgaaattacataaaacatcctaatttaatagatacaattgccttctcaggactctatccatgtgcggcaatcatcttgaagtacgtcaattcaacccgatatcatacatcaagttgcattgtcggaatcggctgcatcggcttacctagtccgactcagacccagccgaccctaatcgcagccgatctggactccagccgattcctgctctgtttccgaactcgatctccgcctccgacctttcctcaatctaatcttctttcccaatgccgatattaacaaatttggttgttaacacatgccccccaagtccgggatatttggtaatgttccggatttgccgtgtgccgactccgagcaagtttcgcactccgccgttttctgaccgttattct

SEQ ID NO: 18435 - DNA, 1501 bp, Oryza sativa
cgaagagacgttttatttcacttcggtgcttttagggtatcgggagtgctaacaggcctgggcctgcacagtacttcagcccaattttatttccagcatggcccgttgtgatccttagggacttaggcactttttgctttggcaatttgtcctatatttctattaaggcttatgtggaactcatggtaggaaataagaatgacatacttgtataaaaaattttgtaaaaccagggagtagatccaagaaggatactaatcaaaccaccatgatcaagtttatgcacatgtgtgtggaaaagaatacataggtggatgatgggaaaatggaagaatatgactcatttttggtatgatcctcctccttatactttatttggagaacatggctattttctatattatcttattcatcatgctcaagaatatttttttttgtttccttcttttttgaacattatgattttctaaaatcatttctttttttaactcatgtctcatttggcatggatagaggatggagaatcatagtcatgtgaagtctttatttggtggatggatgatagtggatgctgacttccggagtagaagtatagcatatgatggtggataaaaatgtttagctaaacattcagtgtacagggagagcaatatatggtggatgtgcacaagatcttgatgatgagaacatgaaagaaaaaaaaatctaataagggtctaaaccatttgacaaaacatagaatgatacaagcagcatatgtataaggtttatcatgaagatcaacatatggttttggtaggaataaaacattaatgatgagtaggcaaagttatactttttttaatataatttccaagaattaaatagaaaaaagcaagggtcatattgtcaggcaatcattcatttaccaattgcttagatgacatgtcttcctaatgatatatttcacaagcacaaggtatcatacgagaaataaggagaatccaagacatttgcatgcaagtcatatattctaaaaacattgaagcttattttaaaagttgaatttatttttcagattttcatgataagaattattaaactcaaactttagggagatgagaggataaacatgcaaaatttatcaacataatacctaaataaggttaaactagctagagcaaccgcgacaagtgggaaaatttaaaacttttccttgccattctaaaataaaataaaactataaggtgagagcttgcatttgcccatttgcatgactgttttgctgcgattgagtcttttatgtgtttttcgatcttaaacacatttcataataggattcatacgcatcgtattaacttgaaccaaaattattagaatagagaaccttatatataaatattgagaatcgcttcttaaaattttatacaactcacaaaatttcacatttcatcctaacctagtgttggtatttcttaacgacattactagaaatatttaatcctagcaatggcgtagaaat

SEQ ID NO: 18436 - DNA, 523 bp, Oryza sativa
ggtggcggcgtgcgatctgaatcgggggggaggaggagaggagttaggttaaaagggtttgcacgaatcttgaagcatatccaatggtctaaaattcgaatgatatggggttggattttctgtcacaagatgtatagacagccccaagaaagaaatgttcctctatttaattccctctattcactactgcattcatctatttccctccattcaccattgcagaacatcttaatggtgtcggttgtaaacttggcgtacgtgctggttccgcagtcggcaccaatttttccaggaccagcactaggtcacttgtgctggttgtagaatcaacactttcgtgctctctccaattcaagaagaaaagagagaagtcggctcgtagcatcagctcatcaagctaatgctttcgagcggcccctttcaagcagcccctaatctcatccatcacagctcaacaataacaatctccagacccattcatcatagatcaacacaagtaagatgaagaactaaacaagcaaga

SEQ ID NO: 18437 - DNA, 223 bp, Oryza sativa
gaattttgtcattgcattgaaaggaaacggacgaggttcattacatagagttaatagattgtaagggggaagagaaaatttctttccaaatttgaattacatagcgagcttcagacttgagattttcagcctacagagcagcttctcgcacacatcgctgtagacatgaggtgatggaaggaccttggcctctaaagacaacatcatgtctgtgattccacaa

SEQ ID NO: 18438 - DNA, 1501 bp, Oryza sativa
tgaccaggtggctgccgtgtcttttgtgtggccttggcctatcaagactaagccgatgagagccgatgttggtgtgaccgagctgaaggcattctgaccggcaggctgttgccagggcattaaatgcactgtaacgactacttttctatttgttatatttgtgggcggtctaactagccaccccatggcggtctgatcgataggcaacagaagttggggaatttgaccccaatggcttgtttttgtgggcggggatataatacccccccctagcagcaaggggactctcttggtacttgcttcatttgcatacatcccttgcatctcctcacacacatccttgagcttgtgttcatccttatgtggtgtttgagagtagtttgagcttagagtcaagtgcattgcttcattctagagctagtgtggcctttgatcatctccgagctaggtcatcgcttattactcttggaggtcgccgcctcctagacggcttgtggaggtgcttgcccgtctccaaggagattgtggagaaggctcggtgccggttgtgagtggtttggagttcactaccttcggagtgaaggaagaactaccctaatgatcgaggcttgagtagtccacttcgtgggtcggctcccaccttgcccaccccttgacgaaggggccttgcggtggcttcgtggttttgagtggttgtcacgcccagaaattcatgaaccagaatctctaagctgaatgtgtattaaacccctgtccaggaccagccagggtacacaaacgacaattgttgacatacagatccacgtcttacaaaaatacaaaagattacaaatgcagcggaaaaagataaaagcgagctaagcctgaagacttgactcctgcagcgggcgattccattccacaggcaatccttgacgacagcgataaaaccaacctcttcgagacatctccaactgagaagatcttcaactctggtgtgggggaaaagagagcaagactgagtactacccactgtactcagcaagtcataccggaaaaggaggtatgatgcaagatatatccaagggaggctaaaggtcctttcgcataaagccggcatttcaaagcagaagttgaaagcagtaaaacagttgtagtaattaacccatattaaccaatcactgtccaacgctacaccacgttgcaacaggcccaaaccaccacctgaactaaccagttccaaaagctaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaggaggccgtgacaggaccctttgcataaccccctctaaccgatcgcaccacaccttagggttcgcccccgtccccagcaggcaacgggcagcccccctttcgtgccgcag

SEQ ID NO: 18439 - DNA, 1501 bp, Oryza sativa
ttatgattatgaatagagatagtatcggggtttcagccgatcttacctgatttagccttatgtcttacatgcttaattgatatgctaagtctgttctttatattaagatcttattgcaataaagtatattaggcttttgtttgatatattctatctgttttaacatcttagcatacagtagtatcggagtactagccgatacatgctagatctatctgatcggctatgctacaagcgtttataacctttaggggaaggggtccgtattacaaaatacagtccatatccctaacagaatatgcgattatagataaaatacaatcgtaaccgactaggatctcgggtatttccttgacatacaagttagaaactaacctgagtcctcataaagatattctgtcaatatttggtagcacatacccaactaaactataactgccgtgtagatatggggtatccataatctccacaggagccccaaagacctttgcagtcgacgaaattgctttctcagaacacaaagcaataatccgagtgtttcaattccttctgctccagcctgccgagtgcctaaatcaaagactgtgaagggcgaaaataaaatatggtgcatcgagtagatgcacctaattaggtgtagcctcccgactatatggttagttgaaaaactagacatgtagtcaagaaccgagtggttttacagccaaatagcaaattgtaaagttcgtatggtattcaataaaatacccagccgactgcctttcaacttgaatatatcaagaaaaaatatgaaaagggcccgagcgataaacactcaaaaggtccacaaaaagacacatttgataaaaatccgagtaagaaactcttaaaatgatccaccaaatatgataaagatcatggtaattaagaagtttaatatcctaggctataacccttaccataatcaaaataagcatataacatgccaaaagaatgactcttaataaaccagtcatctcaaatcaacccaaacagcttttgtagcctaataaagctgacaaaaatagtataacacctttctgtcgggcacctttttcatctgcatcgtggtaattccaaagaattatcaaactgcattaaaaaggattttaacagcgtcgggtcacatcattgtgagctcaaattgccaaagcaaaaagcgcctaagtccctagggatcacaacgggccacactgataacgatattgggctgaagtactgtacaggcccaggcccattagtactaccgataccctaacaaaacaccgaagtccaagcgtcacttcatcttccccgccgaaactctcgccatttccctacttcttgctacagtacaaaaccgcaccgacgaagctagggtttatcaatccaccccaatccactctcaaaaatccacaaaacttctccacgcgcccaccgcaccgatttcccattcctctccagctatttctcagaccgaatcagcctattcgactcacgtcca

SEQ ID NO: 18440 - DNA, 562 bp, Oryza sativa
cagtgggcagttccggcggtggtcagccatgaggtggcgctggcatagacaaggtgcatatgtgatgaatcagggcggtgccagcgttgatgggagccacagacacacatgggagagatgaaggggaggagagactgacgggtgggtcccacgccgtttttcaccgtaggttgccacattgccatgccatgtaggcaaaagtgacgaatagttaagagaccacatcttaaagaagggaaagaaataattgcaaacctaaaaatgacatttggataattgccaaacctaaaaatggtaaatagttaaattccccaagatttgatggtggttggtgaagaaaaggaagtttaatttcattttactttgtaattttctaagaaacgcagtacaaatgtagacgcttataacgtgcacacactcatctctagaaatgcgcgcgcgcagacacactctatccctatagcatcttcggaagactagactagcatattttcagattaacaaatcgccacgccacgaacgtctcactgttaatgggtacatcgcttactattcatcacca

SEQ ID NO: 18441 - DNA, 622 bp, Oryza sativa
tttggctagtctcatttggatatgaaaataaaattgatgagaggtatgtattaaacttcatatattctaacttggtctctcttgtggatccaaaatatagtgtgagctccgtcattgatcttgattgattatgtgcatatgcgttcctttatatccatatgtatgcatatcttaagggggagtttattttatattttgtttattataagatctctagcttgatttaaaattatcgttcatctcatctttctatattgttatatccagttattatctatcactaaagagagaaaagattgaaagatctgggattaaacaatttgtgtaattgttactttggtgatagatgataaaccaatgtttatgggattaacctctcttttttataagttgtcaactaggttatttcccaatgatgagatgtggtagatatgcattctttggtgatggaccttaatcatgataaggatgaaatgcatggagataaagcgatatgtatcacttcttactcctaccttttgataggttcatatatatatgattttcatgttattgttatataagtgtgagactaatgtttacttgagtcttatcttatttagtctcctttacattgagaaca

SEQ ID NO: 18442 - DNA, 850 bp, Oryza sativa
tatctccccttatgtttctcttcgtgttggcgcccccgttgccttgttctcttttcttcccagtgcctctctttgttttattccctctctccctctgagaaaattcactttggagagaaaactaaaaaataaaatggcaaaaatcaagagttgaaccaataaccttatgattcattgcaagctcttttaatcaattcatcatttgattctatgtgattaaatgttattgtttgcttgttctatatctctgttcaaactttgtaagaacaaatcacttacgttactgtgaaaattataactaattactatgattcagtagtaacattatcgcgtaagtacagtaacgtagcacattactcaataatttatagaccgttaatgcacttatgacaataacatctttatggaattgtggatcaaggataattggtcaaatatgtggttatataaaactatatggccatgatacctagggctatgctataatacctacagttattgtgtgtcacgtgctaaattaaacccaatgattttgtataactaggactataatactcacaattttgtgaaatttactttacatctatactactttaaatgaagctagtggtggtcgagtccgccttcaacacaagctgacatgcgaggtcaggtcataaagtccccacacgtgaatgcttttgctttggatatgtcattatatgcataatcaactaaatatgctagaaacttgtaatttttcttttgcttttatcttttgtaatatctgttgcaatgcatgggttttagctagtgtaaatgtaaatatttgatcggaggaagtgcgaatagtgagctcttacctcatagg

SEQ ID NO: 18443 - DNA, 334 bp, Oryza sativa
gatatgcaattttctcgctaacaagagatatatccaggtggttttttcgcacttatgtttgtttatccacagcgagaaagcaggatatttctcccgtcgtgaaggaagagcggaacattatcgatctaaaatcgttctctgcgtttggatggttcataaccgaattgagctcagattagtagcctcaccggcggctgtgttgcagataacgatgaaagctctagcatatggagaattccagttctaaggtttgctgcttattttccatcttttggattcttttcttgatcgtttctgttcctaattcgttttctttatattttgcatttgcagt

SEQ ID NO: 18444 - DNA, 313 bp, Oryza sativa
cgattcgtgcccctcattcctgggacgaatcagatttgctcattgcttacactctgcactaatatattaggggaaacatttgcgtgcgccggaacactagctagtttatttcaagattcattctttcattcgcattcgcatctggattctagacggactggatgtgttcctgttacttcaaaagatatattttacatttttcagactacaactgctccaaccctttgccaaacttctcctatcgctctagcagtagcagatctccgctactccgatccgtccttcccctcgaattgaagcactaatccctctt

SEQ ID NO: 18445 - DNA, 277 bp, Oryza sativa
aaaacattgctaaaatttcgatgaatgcgcacaaaaaaacagccatatacaccaatggttaggacagcattgaaagatgtaacggtaccatgaggggattcggaataatcaatctactatagtatccatgtaaataaacaacatgctcctaatgacgaaaacatgtctaaatgtagtcaaatataatacaccaaaaatgaaggcgctaattaagcgtctaaatgtagtccaatagaatacaccaaaaatgaaggcgctaattaagcattagaccagg

SEQ ID NO: 18446 - DNA, 1501 bp, Oryza sativa
aatcgaagaagcttccaatagatgacaatcacatatttgtagcatcacagaagaagcatggcgggatggtactgaaaaaagaaaactgctagcttgaaattggatttaagttgaagttggtacccggtagatttaaaaattgtaaaactctgaaatattcagtaacaaaggcaaccaactaaagaagaaaacaaaaaaaaagaaggaagttgagatagctataaactatacctgtattacagtcttagagccaacatatgcttcaatctttttccaatcacgatcaaacctgttatagtaaaagcaagtaaagaatgcaaagaataagtaggaaggaaccatttttcagttgtggtaaaaccccactcgtaatgtttgccacaagataagaattcaaagatcatagggggggaaatgatccctttgttgttagcagttgatagttgatgatggagagctgcatctaactaatttgaaagagagttgctacttggtactgtagttcggagtaaagagatcatactgaattcgaagtggtccagtgaagataaagcaagttagatgggcagtaaagatgaagtagaggcatttttagcattcacatgagtgagcaattaaatccaggtgagcgttaggattcaaagaagaagtatatactaatactagtattttgttgtcccgaagtgaaattgaggaattagaattagatttagatgtccagtaataacaatcgaactagaacagtagtaggatacagcaggcaaaacggcatatgaaattggatggagaagtagcagaagatggaggcagggcagcagttaagagttagaagaaggcgcatggatgcttacagctgcagcgcctcgaggaacttgtcgtgctcggggtcggtccagctctcccgcgacttggtgatggtgtagggcttcctcaccctccttcccccgtcgtcctccacctccggccccggccccggccccggagacgacgaatcgagcaactgctgcggcgcggagctcatgcccgcgatctcgctcagcctcagcctctgcctagggttgggttggggtgctcagctcgattgcttgctttgtcaggtggttggctggcggtgacgaagacgaagaagaagaagaagaaaatggtgcgtggagtgagaagaaagacatcacatcgcgggttcttctcctgtccacgagttcccccgctgacgctgacactgggccccacacccctttccgcctaacttccatgggccgtccgtctctacatacaagcccaggcccaatagcccagaagagagagaaatccgccgagcccactagtacagtacaattttctttttcttcttcttcttattaccgacttttttttttctctcagctgtctgcttcttccatccttcgttgcatcggcgtggggcgtgcttagcttcctcccacccttccttccttcctccgctcttctcaattttttcgctcatcggagtcggaggagcagc

SEQ ID NO: 18447 - DNA, 175 bp, Oryza sativa
tagtcaacaattttcttttaagaaaatatgggacccacctttcagattctatctactgatctgtatctttttcccctctcacctctctctctatctctctatccctggctgaggagtcgcgacggctacgagcctactcttgcgcatgctagcggaggcccagtaggagcggcga

SEQ ID NO: 18448 - DNA, 547 bp, Oryza sativa
ctacatatttaagaatgtattttacaaaactatagatttagagttaaatttatcatggcactacagatttaagatattatatcccaaaactattgatttaacaactattttattacaaaactacacattaaaaaactattttatcacaaaactataatttttataactttaaattaaataaataatagtgctatgatctaagctctagaatatgtaattctttgataacttaatcactaaatctgtagttttgtgatatggtgcattaaatctgtagttccgtgaaaagtttaacgctaaatctgtagttttgtgatagacattcttaaatctatagttttgtgataatttgacataagtatatgtagttttgtgaaatttactctaatttcttaataagtcaaaacaatttattatagaataaaagtacttttatatgtgcgttctaaatcaaatactgaaaaaaatacattgaaaataacttaaaaatagatatgaaagttaagtttaaaaattcaaattttagcattggctttgatttattagg

SEQ ID NO: 18449 - DNA, 1501 bp, Oryza sativa
atcttggcgaggaagcagagtcactcgtgcatgggctgcttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaaccttcgcccctagaggcgcccggaccccccttatatatgggaaggagtccgggttacaaaagttaatctatatccctaacggaatacacagatacagattaaatacagtcgtgaccgactaagtctcaaggtgtttccttgatgtacaagttaagaaacaaacccaggatacacataagatattctatctatattcggtatcctatattcagcccaaatatcatcgccgtgtagatatgggatatccataatctccacagtagcccccgagacctttgcagtcaaccatcatagccttctcaaagatagtaatccgagtgcttcaaattatgcatgccaaggcctgccgagtagcaaagacgaagactgtaaagggcgaaaagacaaagaatatggtgcatcgaatagatgcacctaattaggtgtagcccccaactatgtgattagttaacaaactaaacatatagttgagaacaaaataatagcataatcatgcatcatacggcaaaagcatacgcggcgcctaaagagacattcttgccgactgctttttagccataataaaatgaatccgagtgatttacactctaaaaggttcacgaatgaactcacttgacaggcatccgaatataaaactctaaagattacccaccaaatattataaaaattatgataatgaataagtctaatagcctaggctatgactatttaccataatgaaaacaggtatataacataccaaggaaatgactatggtaaaaacaagtcattccaagtcagcccagacagcttttgtagcctaaaaaagcgtacaaaaacagcataacacctttctgtcgggcaccttttaatttgcattgcaataattccaaagaattatatgaccgcataaaaaggattttatcagcattgggcaacactattgtgcgcataaattgccaaagcaaaaaatgcctaagtccctaaggaacacaatgggccacgctgtcgaaaatattgggctgaagtactgttcaggcctaggcccatttgcacctccgatacccttaactgaagaaatccgagatccaagcgacgcttcgtcttccccgccggaacgctcgccattttccccactccctgctacagtaaagagctgcgccggcgaactagggttcaccaatccacccaaatccaccttcaaaacgtgatcaaaatccttcccgtgatccaccgcctcaattcctcacctctcccaagccatccctcgaatcaaatcagcacatttgagaaaaatcga

SEQ ID NO: 18450 - DNA, 411 bp, Oryza sativa
ctttctggcaatcatgagttgggggatatatatatatattgtaatcaaaagaaagaaaaacaggtgtattaaacttttcaacgcgatatatatataaaaaatacttgtttgaattcaggcatgcatgcattcagtataaatttatttaaaattttgtctgagaattttgttcgaaagtatcaccaaatatccatcggaattttatttaattttatcccaaaatgcaaaaccatgttccaatctgtattatttcaaatcacctgaatccgtatatgttcagcatatgagtatccgcatccaactgaaggcatatgacttatggactagaaggctatacgactgatccgagaatcctagcgatcgagatcgatcgccatggcttccccgtcgcggcggcggcggcgccggcgc

SEQ ID NO: 18451 - DNA, 1501 bp, Oryza sativa
tgcgagaccgtagacggtaagccacgattcagggttagtggtgccgtcatacttctctattccagtcggtttgaagccggctggccaatccactcgacgcaggtcgtcggtgaaggctgctactccgtcaaggtcgtcgtcgtggcggtctggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtggcccctgctcctgcggttggatcctgcgccggtgatgctgaggcttggatgacggtagtcatgagatcggaagtgggggactcggctgccagtcggcgtgtggacgctttcggagttaactgggaccgaagccgcgatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgttgacgtcggtcctcagcctccttcgcgatccgctcacggtcctgctgctcacgccgtagccgttcttgttcttgtgcttggtgctcctcctccagtcggcgacgctcttcggcctcccgggcttggcgttgctcctccgtctcattattggccatgaaaacgccaaagtagagaggggtgtagtcgtcatctaggcttccgtcgaagtcgtcgaagtcgtggaagtcgttgtagcgagaactaaattcgtcgtactccacgatgtcggtggggcgcgagtcgacggtgggagagctgtagtggtcatctagctgatccgtcgaaaccgtgccgagtggttggaggatgacgccgacttccctgaagctaggcgaaatcggtgttgaagccgacttccgcctaggcctacgggatgaagacgctgtcatggtggagacggctgctaaatcgtcggggagcttcatcaggaccggtgggtaagccccatcatcttgatctggtgtcattggagaagatgcaatctcggccgagtggtttgaagccgactcggttgagatggtcttgaagtagctttcagccgcgttcgggaatccaaacgggaccgaaatccggttctctcccgactggtttgattccgagtcgaggagagaaatcttgccgaagttgtcggtgatgaagtcgaggctgccgaaccgaaacgtctgcccgggcgggaagacgaggtcgtcgatgccagagaaaggacccattgcactgatcggcgaaaagcttgacgctgcccctacctggcgcgccaactgtcgaaactagatttcggcaataataaaagggggtggctatcaagctagaaaagtgtatgggtttggagacaaaaga

SEQ ID NO: 18452 - DNA, 1501 bp, Oryza sativa
cgccgcgtctagcttgggatgcaatgaccgggttccctcactaagatcttgtcgaaactagatttcggcaataataaaagggggtggctatcaagctagaaaagtgtatgggtttggagacaaaagatttatacaggttcaggccttcttataaaagaagtaataccctactcctgtccggggatgaatccgccgagtgtattattgattgtatgattcggggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatttacattaggtatcctgtacccagttcgaataccatcgccgtgtagatatgggatacccacaatctccacagtagcccccgagtcctttgcagtcgaccatcgtagccttctcaaagatgataatccaagtactttaaattcttcaagccaaaacctgccgagtggactgtaaagggcgaaaagatgaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccataataaaagaaatccgagtggtttacactctaaaaggttcacgaatgaacacacttgacaggcatccgaataaaaactctaaagattacccatcaagtattatgaagattatggtaataaataagtcgaatagcctaggccatgactatttaccatgaaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatataaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagtacctccgatacccttaactgaaaaaaatcctatatccaagcgacgcttcgccttccccgccggatctctcgccattttccccactccttgctacagtgaaaagctgcgccggcgaactagggttcacaactccggccaaatccacctccgaaaagtgcatcaaaatccttcccgtgatccaccgcctcaattcctcacctctcccaagccatccctcgaatcaaatcagcacatttgagaaaaatcga

SEQ ID NO: 18453 - DNA, 297 bp, Oryza sativa
ttgataactgtgggcaagtaagttgctttaattttaaatatcgaggttagtacaatcttatttgttgtatttcaatagttgcgattgtactaacttcaaaaagattatatgcagaaaaactgaagcttgcatatcgatttattgatgactaaaaagagtatatgtagaagaactggtgttaattgaactgagaatgatagtgatgtctaattaagggcctcatgtgacgctccgcaataattagaggaaaaagagcaaagcagcccagcagcaggacttgggcctttggcccaagca

SEQ ID NO: 18454 - DNA, 864 bp, Oryza sativa
aaatattgctaaggctcgggatctaaggctcgtcctagggtcaagggggctctgataccaacttgtcacgaccggaactgacccaacgggtgttccttgcgtgcgtgcattaatccttgtcccaggaggcaaggtacaccaaaagttgatacaattcagagtttaacaagcggaagcgtaaatagataatttattacatgggcagcgaaggcccagcacacacaaagacaaacgagaaacagcggaagactagggcgacgaccacaggcacttgacggcaggcacgagctagacaccaaagccttcatcctgcaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatccta

SEQ ID NO: 18455 - DNA, 361 bp, Oryza sativa
cactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcaaaataataaagatatctttgcgtggaaaccttcggata

SEQ ID NO: 18456 - DNA, 1501 bp, Oryza sativa
tacttttccctctctctctccctcggattcgtttggaaactctcccgcaaacttcgccggcgcatcaatggcggccggatcttccgcgaccgattccccctcatccggccgctctctcctcctcccaacactacataaacactccccgtgcctccctccttcgtttccgccactcgccgctctctctccccgtcggaatcgagctcgcgccgtcgtcctctctctccgccgtcgccgccgagctccggtccgccgccgtcgtcgccccgggcctcctcccgtttcggcgtcgccttcttcgggttcgccgcgtcctcgccgatctcgtccaccccttcgtttcgcccgccgaccgccggaacgccgccgtcctcgtcgacccgagccgcgccgccgccttcctccgcttcggtcgccgttcccgtcgtcgccgtcgacccggggtgagccatggaccgcccatttcgtttcccccttccctctcctctctcgggcgccgctccgtcgcgccggaggtcgccgccggcgaccatcggggcgcgggtgcgccgcctcccgtcggctgtgccggcgaggccgccttcgggcgcgccccgcggctgccatgtggggcccggccgtcagccgcccgtgtcctcgggtgcggctgacgcgtgggacccacggcgccgggccggcgtaagccgcgtgcacccggtccaccgtggaccgtgaggctgccgtgtgggccccactcccgtggacccagtccgcgcgccattccctcggctgacgcaataaatccgattttaaattaaaatttaaatgaagaaattcgcaaatattcatttaaagagcatataaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagacccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttattattattgttattgttagtatttccttgttcaccctagattaaacaaaaccccaactagtggacactctactcatggtaccactagcatgattttaggtagatgcttcgctgtttaattaggtaacattaggtggttttacaactctagactttgggaatattcatatcacctggacactttggaactgttggattattgtggaattggattcacaccgccccctctattcaaaatccccaaaaatggttttaggctgggctcggggtgcatggttttgatagtagcac

SEQ ID NO: 18457 - DNA, 1501 bp, Oryza sativa
taaaagaaatgagagaagaccacgacctcgtgtgtatcgggggttggaaaggcttcaccgcatgctggccgccacccgatgatctccttggcagggagaacgccgtgcgctaccatctccttcaggttttcttccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatcacgttttgaaggtggatttgggtggattggtgaaccctagttcgccggcgcagctctttactgtagcagggagtggggaaaatggcgagcgttccggcggggaagacgaagcgtcgcttggatctcggatttcttcagttaagggtatcggaggtgcaaatgggcctaggcctgaacagtacttcagcccaatattttcgacagcgtggcccattgtgttccttagggacttaggcattttttgctttggcaatttatgcgcacaatagtgttgcccaatgctgataaaatcctttttatgcggtcatataattctttggaattattgcaatgcaaattaaaaggtgcccgacagaaaggtgttatgctgtttttgtacgcttttttaggctacaaaagctgtctgggctgacttggaatgacttgtttttaccatagtcatttccttggtatgttatatacctgttttcattatggtaaatagtcatagcctaggctattagacttattcattatcataatttttataatatttggtgggtaatctttagagttttatattcggatgcctgtcaagtgagttcattcgtgaaccttttagagtgtaaatcactcggattcattttattatggctaaaaagcagtcggcaagaatgtctctttaggcgccgcgtatgcttttgccgtatgatgcatgattatgctattattttgttctcaactatatgtttagtttgttaactaatcacatagttgggggctacacctaattaggtgcatctattcgatgcaccatattctttgtcttttcgccctttacagtcttcgtctttgctactcggcaggccttggcatgcataatttgaagcactcggattactatctttgagaaggctatgatggttgactgcaaaggtctcgggggctactgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacac

SEQ ID NO: 18458 - DNA, 1501 bp, Oryza sativa
ttgttctgcttggtttcctaagcatctgtcttctcatagactaaggagcgtggtatgaatgttggagttattttacactactcctctattgtcttttttatttcctgcaaaaggttagtggataacaaatacccgagggacaacaaaaaattgaaaagattttatcatagcctgaagattaattgttcacatccatgctaacaaggaattgaattcttaataagcatggatcccacaattttgccataattttattttgtcatcatctttttttctttttactccagagacacatttttttaatcgagagacgcttcttttattctttgaaaacaaaattttcttttttttctctttctttctttcaattttttttattgttcaccaaattttcatttaagcaaaactcatacagggctaaggtaaatttgcatgaacatgctaaaggagcaattagaaatatgcgcaccgtacaccttgataggtgatatgtttctcctttttatgttagcaactgatttttctcctagctctgtcttacctccagtgtgactcgtgcttgaggactcgctcgtcaatttgaaaaattccctgcaggggttagttcacgaaggatatacatccgaagtccatgaaagtactggacctacggttcatttaagcaaacttgacaccacgtcaactttaattaaagaaggctatttatcctaagcatcatgcttaattttaaaaagcctatgaatgtcgacgaccacccaaaccatagcatacgaaaatggactgaggacgcataaccaggtatgatcaagccaaactcatctaaagacaagtatgtgtaaaagaaatggtgaatcatttgctgtcttttgtataccttaccgccggcatgatgcatatgttgaaatctctggagcggtagcatgatcacatgtgattgtcgatctctcctccgtcttgatgcgggttgtggtggaggaaggcactttgatcacgccaactcaagcgagtgcttcggttatgcacacatctcaggtgcaagaaccctttaccttgtgttggacgagattttgtgcattttttttaagtaaaactaaaaatcatgaatgtgccaatcgaaggaacaaacaaacaagctgtgtgcatttcccacaagttttcactatatgcgtaaattccatgattagttaaacacggtaattagtcttaactgaagtgattactgacaaggacgcacaaatgcaccagaaagtaataggggttgcttgtctgacatctttatcagtgccatatgcatctatacttgatcacctgggttcacaggtcagcctgatgatgaatggcaatatatatgggacaatcgatcggcagctatgcatgctctctgctggtcaatacaatgtgtatataaagcaaaatggaaacacacacgatcccattccatgctagaaaattttggaatggaagcattccatcacaatatcctctttgaaaagctgaaatt

SEQ ID NO: 18459 - DNA, 1501 bp, Oryza sativa
ggccaaagatccttgctatatatgtccgcgcggctgggacgcgcgtgtgcatacaaatacaaggaaatgctctctttgcgccacagtcgattggaaagtgatcgcacatcaatggatctctgatacggccggatcgccactataaaacaggccatttccttcacggcggggggaggcagcagagagagtacagaggcacgagccgagggcctgcagttcacgccgccgctgccgccatgcccagccttggcagtagtccctagagagacatacacagagacacaggagagaaacacagaaacacaaggacaaggagagcggacacaggctgctcatcggcaaccatcacgcacgtcgtcttggccggagtatctcggcgtcctgcgggaacgagcgtgctctgcggccggcgacatcggctgccgtacctcggcgtccggcaaggaggcgcgtgcgctgagccgctgaggaagcgcgctaaggaggagacgatcaccagggagacgatgccgctccagttcactgccatgggtaactagcctattttcttatcatccctttgctccatttcagcgcatgcacgccggtatgaagctcctcagcagagaagatgccggatgcaccgccatcgtcagagtcgccagagttgacgtcgtctgcaagtctccgtcaaggtgaagacgatgtttctatatggcgcggcgatgttgaagacgatgtttctatatggcgaggagatgtcgccgagatgctcggacgtcgtcaccttgctggtcggcctcttctctgcaacgccgtcgacgtccgctccccctcatcaacgctgctatcttcttcacattcattgccttgctgcctgaagagaacgccggccggagcaccactacttggtgcctgcaaggctattggattgtaatcttagagcatttatattctcttttgtttcgttgcatgtagagttcggttggagtctgaattctagccggtagaatagcatttttctgttttagcatatttgcttccttctttagctgcgttgactcggctcggatcgtgggatggcgcggtcagtagttgatccgagattgtcgtgatttgattcttttatgcatgtaacaaactccgtctggagatgaataaatagaagagaaaaccgaaaaagctgcactgtattacgcagtgccaactctgttcgtcagttgttctgttcgactctgttttttcggaacttcttcagttagctgtagctgcacctacaagcgtcagagtgtgtgtttcagagagactgagagccagttcgcatgagttttttctgacatttggtatcagagctttgctgagacgatccggtaatgtcatacacaccgcctggccgtcgtggtggcggtggcggcgggggaagcgacaacggctgcggcatcactcccgctagtcgatgcagggcacactgcccgtctcttgatcctgtcgaggacaaattatatagactgagcgctgttga

SEQ ID NO: 18460 - DNA, 1501 bp, Oryza sativa
tttgccgtatgatgcatgattatgctattattttgttctcaactatatgtttagtttgttaactaatcacatagttgggggctacacctaattaggtgcatctattcgatgcaccatattctttgtcttttcgccctttacagtcttcgtctttgctactcggcaggccttggcatgcataatttgaagcactcggattactatctttgagaaggctatgatggttgactgcaaaggtctcgggggctactgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaagcagcccatgcacgagtgactctgcttcctcgccaagatcgaacggtgactgcagcctcaagccgcagcacgcttgagtggtaatagcacacatcctgataaacgtaatcattgtaaacattggagcccttatcggtgataattgaaaccctgcctgcgagccattgaaactgacatcaatgtggaggcacctattgcggataagcttgatccgcagacagccatcacggacctcgacgaggaacctgatgcttccgcgagtgtgaatttgaacccttcaccgatgaggagaaatatggaggagtcagcttcagatctgtggagattgtgggtatcccatatctacacggcgatggtattcgaactgggtacaggatacctaatgtaaatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttccccgaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacagttggcgcgccaggtaggggcagcgtcaagcttttcgccgatcagtgcaa

SEQ ID NO: 18461 - DNA, 1501 bp, Oryza sativa
  unsure (1)..(1501): unsure at all n locations
agtggagaggagatagttcacagccagctgcatgcatggctttatcgatatatgcatggccagttgtccaactaaatactccggtgttcacgtcatggttgtaagttcgggcaattttgacatgcccccggcacaaatttaagtatgaatttgcttgcccccggttgagcatcttgaattcccgatttcttgagcacttcacaacctatgaggctgctttcgaaatcgcaagtgccaccgggttgttatcattatggaagaaaatagctcttaaccagagcatttcatcaaccatcatatgtgttggagaaagaacacgaaagatgggaggaaaccagggcagtagacaatatgagtagctcatccaacacaatggaagtgaagaaggattgacatacgtgaaaaaaatcacttgattatttttttttgcggggaaaatcacttgattattacttcgcagtgtgagaagagctcttctacgcttgattattttaataaagaaaantttaacaactatttattagccggtgttgcatgagtcgacactatttgttaaagcccttgatagggtactgttcatgacttgctctttttcttgcctaggaaattacttcctcattttgctgtacgatgaaccgagtttatctgaagagcaccaagtattgcagttgttgggtagtataatttatataagtaccatgcagaaccacggcaggtgatcatgctattaggccatcagaaatgttgcattttaagaggctaccatggttttgtgcttgttgttcaggagctggcccgcttagctccattcccctgttcaagactcaagagcagccatactcaatatgatcgctacgcttggcatggtcactgcggtcgcatgctagccgtagttgcggtgcgcgcgctcacgtagtgaccatttttgccaagccagctgtcccgtgccgcctgctcttcccactgccagtctgccccttgccacaccggcgcgcctatgaccgtagcagtgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggaaaggagtagggtattacttcttttataagaaggcctgaacctgtataaatcctttgtctccaaacccatacacttttccagcttgatagccacccccttttattattgccgaaatctagtttcgacagttggcgcgccaggtaggggcagcgtcaagcttttcgccgatcagtgcaa

SEQ ID NO: 18462 - DNA, 157 bp, Oryza sativa
gctatatggagtatgggctccaagactcaaattgagtatgtacccaatttgaatgagtatgaattttttgaaaatgtttaggtatgaacattaacttctttactagcaagttcattgaactgagtttgaactttttttgtttgattttggttctagg

SEQ ID NO: 18463 - DNA, 270 bp, Oryza sativa
ataaaaagaagggtacattcaaattcaaacaaaaatatactcaatgcataatattctcctttgttatcaaaattgccaataacatgatagattatatgagaaaaacatggcacttcaaatatcaccaagaatttcttttctacagttgtgtagacaaaaatcatcaaattgaatacaacccaagtatttaaaaaagtggataatataacctttttatttaaactcaatagtggtggtttgactatgcaactaacatgttcattcactagt

SEQ ID NO: 18464 - DNA, 603 bp, Oryza sativa
aaaatctgtagctgatgggatcagctaggcccgggtggccgtttgaaaagttgttggcccgggtggccgtttgaaaagttgttggcccgggtggccgtttgaaaagctgttggccgggtgccaaccttgttgcaatcctaaagactgatacattgcacatactccgaccggatgagacgcactgtctcatccgtgtcgtttgagaagcactcatctagttgttttagaaaaagagttcaaataaaatcaattacaaaaacaacagcctttccttgaagcctgcattaaacacttatttcccctggcttgctgagtactcccgtactcacccttgctctatataaataatcccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctcgtgcgcgctgtggcagtcgagatggaacatctcgtgcgcgcgttaatt

SEQ ID NO: 18465 - DNA, 1488 bp, Oryza sativa
attcctgcagcccggccaacagtctctaaaatgggcctaagcacagaaccatcacattataaaatgttttgatttctctattacttatctagaattgctaacatccatatgaatttagaagcatatatgttataatgtgaagcctatttaaaacccaacacatgttataatgtgaagcagaggaagtagtatttgtgagtgacatggcattacagaatttaccgttatttacgtacggtaccatagatgtcagattttatgatacaaaatataagggctaccacaatatgctaaaaaaaagtgatcttaagtaataaatatatagttaaggtgcatatacattgtacaagttaaaaatagtaaaaagtttcttgtgatgtaccttaagcttacaactaaccttaacaaaaacaagtacttattctttcctttactttctctctcctcaaatcacttaagagagttgggagccaccttaaattttattgagaaggctaatctctttttgcgaatcgaagaacacaaacaagaacaaagaagatacaaccaaaattgtagatgaatgatttagctcataagttggggtcttacaaaccgaactagcggcgaaattgttctcgatagaataatctaaacaaaaccccaaaccctaaaggtgacgacgggtactgatatatagattttagggtcgtgcaaccaacccttgatgcaaccctaataggttccaacacgatacacggaccaaaggcctaaatacgatgacacagcacttgaagacatcaacttgttcggtcaactagaaaggaaacccgcgcagatgcgcgggtgtcttatattactgttttatgaacacaacgctaaaaaaaaccatatttgttatttcctccgtttcatattataatactttctagtaatgcccacattcatatatatgctaatgaatctagacatatatgtatatgtgtacctaagattcattaatatctatatgaatgtgggcaatggtagaaagtcttataacctgaaacggaggtagtataagatatcgttattaccttataataaaaaagtatctacattgtcaaatagaccctagataatatgttagatgataataatttctcccagattctaataaaaatgacggcacccggttacgtataaattcccatattatcaagactacttattatcattgttttgaaacccgggcatatttaatagatgaaattgcatatgtcctatcaccaaaattaagcctaatacattattaatatactaaaaggtttaccattaatctgagtgtttgggtctcacttatttccaaatccatatataattattgcaagaatcccacttctataggttaatggaataacaccgttaaaatttgacataaatacccctctaacgggtgaagcttgccatagccgccaaggctttctttctccattaccttgaaaaaggggtcacgcatccatgtagcca

SEQ ID NO: 18466 - DNA, 1501 bp, Oryza sativa
tccacatgtctagtgggtaaggcttagtttgtggctcagtctggttgtaaacaaaagtacacggatggagatggacgaagtcgggggtcgatggacatctctaggacaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcttgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccagcttttcctgggacggggattaatacactagcgttcgggaaaaggcaattttctcggtcgcgacacgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttatcccgccctcttctgggagtttagatggctagccgcccccgccgtgcagcccgtgcaccagcccgctttggttttgaagatggtagagttgagccagaagaaaatcatgagtcggctaatgagcagtctcgccgcagcaaccgttcgcatcgtactgcttcccgtaacgcagaagttgagcaaccccgccgcggcagcc

SEQ ID NO: 18467 - DNA, 1501 bp, Oryza sativa
tccgatcgttctcgtcgtcgacgtcccatcggtcacccggctcgtcgtctcgcggcgccgcctccgtcgtcggcatcgcagcggcgtggtccacgccgtcgtcggctgccctcatcgtctcctcgccggccccggtcgtcgtcgtcgtcgtcctctcgtcgttcccggtcgtcggggcgttcgtccctccgtcgagctgttctcgtccgtcctcggtgtttcgtcaaggtcgctgcagcccccgtcatcgtcttcgtcctcgcctccgcgtcgtcaagcctcgtgccggccgcgtctcgccgtcgtccaaggatcgccgccgaagtcgttccctcgccgtctgtctccgccgcgcctgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgtttgttggccactcgcctcggttgacacacgcggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtgttgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggaaaacaaaaccccaactagtgggtactctattcatggttccactagtatgaatttaggtagatgcttcgctgattaaattggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 18468 - DNA, 314 bp, Oryza sativa
taatgttttgttttaaaaatttgaatgcacaaacgaacatctctcttgcctaattgcgccttggtgatggaaatgctttatgctatcattatcttagacttctttcttggataagaattttggggggacccctatctcgacacttccacaatacgtacaaagaagttagctacagaaaaacactggcgtcttggtgatccacttacaaacattgttcactcattgcttattaccataaaaaaagaatactaatcttattctgcttcacaatgtgtttgatcacattaatttgtatgtctgtaataatggatagg

SEQ ID NO: 18469 - DNA, 1501 bp, Oryza sativa
ttattagcgttaggaaaaagagaaaaaagtcgcatatatttttcagtcgtgatcactaaagtcatttaaaaacactggtatatttcacccttttgtttcccaaattacaggtatatgtattgtagtatcttacagcatagttgtgttgaactgggacattttgctggtttacttgagggtcccatatcttagagggcacatggattcagcaaaccgtaaaatactccttgtttggaataaaggattttgatagattttgataaaacttctggagggatcgtactgcttcctagaaaattcccgtgaaattcatgcacagatatgcccaagtattattttatatagcactttagttgatccagggagaaaagtgagatgttcttctggatagacatttaggctttttcagcatataggaagtccaattttaacatcactctccactcattcaaacgttttcagccagaaatcaaatatatgtgagcttgaggcacagctaagtgaggagagagacttgcgaagagaggagcgtgataaggctgcagaagacttaaagtctgcactgcataaagtgaatgcagaagctcaagaagaaatcaagagacaagctgaggctcaccttagacaacaacgggaacagaaagaagttattagcaagcttcaggttttaccttttctttccaattctagggaatgatcaggaattgggaaataatgtattgcgtggacctttctcttttattttcaggaatcagaaaaggaaatccgtttgcttgtggaaacattgagatctaagctggtatgcttttttgctgttgtttatttgaacactcattccttttccattctacaattatttaccttcacattcaggaagatactcgagagaaccttgtcacatctgagaaaaaagcaagagagctggaagctcaacttcaggatgaacagcttgtatccgccaacaatcagaaggttacagtcgtaaacatgtttagagctattaagcccaagttgtttcatttgtagttcattgaatgtatgtaacatcttttcttcacttcctccccccttgcaatcgcagaaatcagataaactggaaatggatctgagaaaagtgaagaaagaacttgaacacgagaaggtagaaaaagatttcaagttcctctgatgttttcatcacataagctaatctaccctggtcttcgcatgcatagaggattgctcttgtttacttactagctgattatctgtgttcttctgttagcaggctgctcgggaagaagcatgggcaaaggtctcagctcttgagcttgaaatagctgctacaattagagatctatcaatcgagaaacagaggtatcaaggagcaagagagagaattattttacggtaagaaacattgtttgagtttcatatagaggtgaaccccaagtttgtgaaactacaaatcagcttaccttttcttttgtttcctatgttgcttactgcagggagactcagc

SEQ ID NO: 18470 - DNA, 1501 bp, Oryza sativa
atgtataattggatagtgtagtgtgtaagaaacgccagcatgtcaattccgtgtgtaaataccgtatttgtttatacgacctttagcaatgatcagggttcaggacattagttcttaattacttttatggagttcatgtgtataaatttgtattattctccacagataaatagttaaatctgtactaatatcgctgaacggctatacccgtgcatcccgcatttcaattgaattcttggttcgcatgaacaagttgagcagaaaaagcgtttccaaattattgtactcctttctctgccatgcaagttcgagccctagaagtgtaatttactcttccgtggattaactacacagtgctcacaactgcatccacaatgtagtgctagagcaggtaataagcattaaataggggtttgttatcaagtaataaacattgtgacagtagtaaatagttactaccaggttacaagtttattgccggtagtaagggaatatgatgggtcccacctcacttttataagtcagaacaaggctttgtgataggttggttgaaggtggaccaatcttattcctccccccctctgttacatacacacattgctagatattttccctgacaacgggcccacccttattgcttggtttgggaataaacattgctgatgctgatgcccttagggcatgcttaatgtataatgtctacttgggtaataagatgggacctgatattaattatggtagttgctacaatatgctatgataagatgaggcattagcatagatcttactggtcccactcaattgtatgttatgtgagagagaaaagaaagtattgttattttattcttatggctaggcattatatatatatgaactactcctacaatgtataaggaccactttagaggcttccatagtttggatgactttcataactttcatagtttaccacaaaatatttggcacattatatggctaagaatttatttgccacaattgtggcaagttatggtaaaaaaattactcaatgacaagtgggctagcttgctaaaaaaaaaagtggtataactcacctgtggcatgaaccaaacactaaatttaattgtcacaactgtagcaaaggttggcgctcaaccaaacagccccttaataccccttgtatttctgcattgtggttgtcctaggtggtaagggactttaattttttagtctattaaatttgagaatcgcgttcaaaataggatgacctaaatttctattatttttgtctaaaaatatttaaagactagatagagttatcaaataacccacggccaacgggcattactggcaccggtggtcctgaaacggcgaattgatcgaaatccgtaggagctgccaatgccagcacaaggaggcagcggcagccgcactagctctctcgcccgaatctgttttttcaagatcacatcaacacacccgcatttgctgtggtgggcctgcatgacgacgcgctcaaagg

SEQ ID NO: 18471 - DNA, 1418 bp, Oryza sativa
cctgcagcccattaacagcattagtatgcttctgtcttggaatgatgaacctcgggctttgattccatcagacattacagctggttccaaatttcagttgtatagagttgttgaaatatactactcgtactcacctgcacctttgtctgtgaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagt

SEQ ID NO: 18472 - DNA, 1501 bp, Oryza sativa
cggaacggcccatccctctggaccacagtattgggccggaaagggatcgtggtgtatgcgtggcctatgaatattgggccggaacgggatcgtggggtatgtgaggcccatgtgagttcggctcgaacgtgtttgttgggccgagagtacggcaggttggaaaaccatggcaatgcgtcgctgctgacagcggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataaactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatgg

SEQ ID NO: 18473 - DNA, 1501 bp, Oryza sativa
cctaattttattactctaaacaaattactgaactctgaacaaactaatcagagaaggtacaataaatctaatcagcaggctccaaaatattccaactcagattattctcacgtggaagagagataactggagagagggaacaaagcgggcgctagatgtagcgccgagcgatacacagatacgcatgcatttgtgggtcccgcaaccaccccgccgatcccgtgtatcgttttgtttctgttgtgcctcttccgatccgcccgatgcattttgctccgcttcacgccgcctccgctcacccctgtctcgccggaattttctcccgcgacgtgaaactccgccgtgaaagctccagtgcgcccaaaaagttagtaatcccagttctcagcgacaaagaaagcgagaggaggattgagaggcgcttggtgcgggcatgcaactggcacccaaagcaataagcaacttcttgatttgaattggcttggtctaattcttttcttttcttctcccactgtctgttgaatgcttgtcgtctatgtttgttctaccgattcttcgtctcatctgttgcatctagtccgttctaatctcttcctatagctccttttattttcccttttgttcttctccttttttcatgtatagattatgcagttgggcagcagtgggttgtgatatactatgtgaattatcaagtgtgttgttattcgttaatttttcaagtagagtagtagataacccatatttattacataatacaaatggccatataagccacagagttgagggcgtttctgatcatgcacatgtaaagtttattgtttgaataatgagatcatgttgatataatagccaacctattgtactagttagttttggtattggctataaaatgacatggatgttattggagctagtagctggctacactattgaccttgctcttatatagcagaccatttttctgctgctgcaacagctataattcgttgctgactatagcccacatgcctctgagatatcaccagtcgacagtatcattcgcaggcctgtagctttcctacatttgtccctgctggcctcttgcccaggctctgccgtactttgcctttttatcctagaaagtccatagtgcaaacccaacatggctggattaaattttaccaaagcactgaaacccatacacactactgtagtagtatactccttgtcagtcagtctgtagctagtcattcagtatccagaccaaaccaatgctactagcccttctgtgcagatagcttttgcatttgtgtgtcctataaaaaatcgcaagatagccagcctgcttgcaccgaatgattcgagcacttgcatgtgttctttactactagtgccactcgcgagctatatcatttgatgcatgcatgcattgggtgtggatggatatttagaagacggtgttgctgaatctgatgcacggtgcatgcaattgcagtgcaggcacaggttggtgatcata

SEQ ID NO: 18474 - DNA, 1501 bp, Oryza sativa
aggatggcataatatagtctcattttgcataaatggcatttaacaaatacttcagaatttaataaaacagtaaagtatttaattaaacaatattaatccaacgctatacaacatacccgttgcataggcccaaccattccgagcaaccattcccggctgcacagttttatctccaaaccaggaatataccattccaaaccaggagctaaacaagttattatcaattacagcatcatttattatggtgagaagtatgagactaatcacgaaagacattgttcgaccagcccataaccgcgggcacggctatttgaatagttttactctggccagaggtgtaccactgtacccacaatacataacctcaacatcatgtcaaccatgcgtcgcgatacttaacaagtacccgaatagagattgtgacaatatcctctgcataacacaaatcaaagcagtgtaccgttctcgaatcataatcacccccttgtaaacaaggcatggactccccagcgacccccgtgagcttatctccaacacttcacaatctggtgctctacaatgaaccacactatacaaaaggtaaagccgttgcccacgctggcttatggtgacggttaatgtttcacaaccgaaaatcgtgaaccggtccttaattgtcatgagcacgaccatcaaaaccatgtgctcacaactcaccattatcatgttttagttggcatcttaattaatcatcctatcatgattaaccatcatgagctatcattaagccatcattaagtaatagtgaatcattaattatcccattcatatgagctagagtctctaagcatggctaagcatcctaattactttagctaaaatcatataatgttctagctaatccaattattaaccaggtgacaaagtataggtaatcaatatcaaagggctataacaaaagcaataggttattcccacccaatgacattcaaaaataaatgcaatagttgaatagaaacaatagctttaaacgggatcaacatgctcaaagggttgtttgggatctgtgtgacttgccttgctggccttggaactcttcaaagtcttctcctgcaaactcagactctccgtgaacgtcggaatctaagcataaaagagcaaaatcaccaaaacagtacataaacaatcgtaaacagcacatgtggatatttttaacatgtagatctcaattttagaaaaatttagagacttgaaccaactaaatccgagctaagatgaattagttatgaatttttaaagattaaatcggattaaatcatttatttagattttaattgaattatgacgcaataaagaattatttttgaaaaggaaaaatgatttattgcgtcagcggctcgggttcatggtggaccgggtgcacggagacggtctacggaacgaacgaccgagatctaatctagcccaaaacgaacggccgggatctaatcgatctaccgcgggtctacggatgacgcggcgc

SEQ ID NO: 18475 - DNA, 1349 bp, Oryza sativa
aaaatgctcgggggatcaactgttttaaaatttcacaaccaaaaacttattagtgtggttataataacaatgtagtagcactaatgagtgagataatagtgctggctagttacacaaaccaataccgattatccctccataataagtatcgattgttcactagaatttggcactggtttggtgccatcagtgctagttcttgtctgcagagcgcacatggtttgagaggacatgtagtggcgctatgttttatccaatagacagttagacactatagaggtggcactgataggttgttatgttataatgtgttttattctatttatttttattatagatattaattatttttctgtaaactcacagaaagttaataagcttcttcgatttaccgcaaaactacatcttacatacattacatacgtagaacgacgaagggtgtaatttggtagtttgcagaaattgccgagtgtcggttccatcagatgatcagatctgctctgtcgccctctccaccgtccacgtacgtgcttctcacactgctgtcagcagaggtgcctctattgctccacacggcttcacgtatatacacggaatctatgacgcgtaagtaatccaactgtttttttttttcccctgcacggcttgatctgcccagatcacttttgattcaagttaattatgtgtatagtacgtatattgccgattcgtgcttgaattataaaatactttaatctagtataagtcattgacttaagttattagcggcttcacacgtgtatatatgatgcaatataatatattatattgtttagtttattacgtgcaagtactaacattaattgctctccaatgttcgaggaacacgaatttagaaatacacatttggaacgtgctttgtgtgtttggttaacttcaaaattgtacatatagaacaatcagatgctccaataattaatcactattccgcagctcgcgatcctttcccagagagatgtatatcatctgccctcacactgttgtccagcaactcaacgtgttcccactaactggtcagcctctaatgcggagaagtacgcatacacttctaaaaaactctaataggtaacggcacataggtgatagtttatttaaaaccagcacctatataccttttcgtatcttgacggggtgaaacgggtacctttgaatactataggttctgtttatacagtaaaaaccaacaccaatgctgtaggtaatgattttataaaagaaacgtctcctataatattttatatgtattggttaattaaaaccgacaactacagtacaataggtaccggtttctaaaaaattggtacccataa

SEQ ID NO: 18476 - DNA, 246 bp, Oryza sativa
tgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccatgtggtcgtacttgtcttatgttcggatgaaattccaagg

SEQ ID NO: 18477 - DNA, 1240 bp, Oryza sativa
cttccaaactgccaaaggacctcggttgcactagttttgacagctcagggatcggctgtatctgtttttgaggttgaaggacgaaaattagatttattggaaaattaagggacctcagatgaacttatttcggaatggaatgtaagaaaaaaaaatctatgatccttacctcaaccatggtcatgaaaaataatatgaaggaagatgattggacattgatttgtagaattcaatgatttatagatggtgttgcagatgacatgtttacatgttgagctttagaattagtgggttataactttacagtaagataggatacacgagtcctaggcctccactcttttttggcacacaaaacatcattgcagcaggcagggaagatcctgattcactctagcatattttgaattttttattcggtggaagcagtgatttattccacaaactagcaatcatctcacctattggcttaggctagttcctttcagattatttatcgaattattaaatcagattattcgctccatgtgtctgtaaatatatttttaaaaaacttaagtttggaaggtgcttgtacgagtagagtgtgtacgttagtattggttagaccaattattttaggttatttatcaaaatatttaatttattcatagaattaagtaactgatctgtttcaaactaagtcgagtagcttaattaactcgcagatcgtacgtgcgtcctccatatataagtccacaaaaatactgtgtcataaatgatatactgaaaaaagaacaaatgtgcacgaataaactttattcaaccgctgacttatttaagcgtagattgttcacattttgtacagagaaattaaagctgtaattattctttgcatatatatatacggagtatgtacaagaaggaaccgccatatatgcatccaaagaacatgttaatacaacactagagataacaataacttaatttagaataaaacaagttgtcatcattttgccttgtcttacaaagttgaccagcggtaatgcacgccctaattaattaaacatgttcatctcaagatggcaacgataaaaacggcgtaccaagaaaacctcaagcttctgtttttctccatttattgccctaattaaccaccaacctcataatcctagccatacaattcgctgctaaacctgtccttgaaaccactatgtatatccaccgcaaagccggccacggcgtcctctagtcgcaacaa

SEQ ID NO: 18478 - DNA, 1501 bp, Oryza sativa
tggttgcaccggaaacactgaactactgacggtccctgtggtgagttgaaagaggtaacactgtttggcgcagtgttgccactaggggcacactgctgtggcggaggtgtcggacggttcatctgagggcgaggggcgtagcctggctggcggttagcctgagtgaccgactggtggtattgcatgggttgaccgtagcgagggcgaggtgtgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcgtttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcaggatgtgcattgcagtaattctcccaccaatctgcagcaggtcctcttagctggtgagaggcgtagagcgtcttctcaacaggagtacactgcactaagttgagttttctatcaacatctttcaaccaatcgtcagcctcgacgggctcgacggtctgagagaactctggcggacgtgacctcagaaaatctgtcagcttggatctattgttgcccacgtgagggtggccatttccatgcgcattatgctgaaaactggctatggctgtggttagtccttgcaagatttgtgtctgaactgccattatgtgttgcatgttgttttccacatgaggtggggaagggaggcgttcttctccagaattgtgactggcagtgcggtgagagcggtgagactgttccatctctgcatcacgggaaactgcgcgatgcgagcggctgccgcggcggggttgctcaacttctgcgttacgggaagcagtacgatgcgaacggttgctgcggcgagactgctcattagccgactcatgattttcttctggctcaactctaccatcttcaaaaccaaagcgggctggtgcacgggctgcacggcgggggcggctagccatctaaactcccagaagagggcgggataagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcgtgtcgcgaccgagaaaattgccttttcccgaacgc

SEQ ID NO: 18479 - DNA, 1501 bp, Oryza sativa
atggaaattttgtttcgtgcattctattacactcacccatccctgacatagttcaatgcaacatggacctaaatcgctgactagctacaagtgctcagagatattggtgaagggtcgattggccattacactaccgttttaatacgtggcaattagtatgtgctattgctagtaacaacttgtatgagatgaagctggcatctacacttctgtcgttgatcagtctcatcaccagccactctagttgttccagtcttagaaactactactttggtattacaggatatgtgcttctttccactactgcaacccatcttcttgccattactacggtgtgcaactaattgtctcctcagccgcatagttccagtgccacatcatgttattttcaaatacactgactattttggccttaatttatatggactacacagttgttgtaccgaaatatgcagtttgcaagttgttctatctatttgcacccaccacacaagttcgtataccataaatgcaatttactcaataaaaaaagagcaaaaaaataagtccgaatgtatggtaaaaagcacggcaaaaaaagtccgaatatccgttttcatcatccgtgtgtatatcttctctatctctaatctaatctaatatatgactcttctctatctctaatcaaatctaactattttaaaaacaaaagtttccatcgtgcgctaaaaaacaaaacatacaccaaaaaataaaatcggtttacaaaaaacgcgtgagaaaaaacacatgagaaaacaatgtcagaaagcaaaaaaaagcgctagaaaaaaaggtttccattgtccgtaaaaatgtaaaaaaaatgtgtgagaaaaaatattcccatcatccgtaaaaaaacaaaaaaaaataacatgcgaagaaaaaagtcacgaaaggagccatttctaaaataaattgtttgaaaaaaccacgcaagaaaaagaaaacaccatttataaaaaaaaacaaaccgctctaaaaaaactgtgaaaaaaaacactaaattgatggacgcttggatcggataggatcatcgattttttttcatctcctacaaggcttttgtttcatcatctattcttttgtattggagaccctgcatgtctctataggcaattatcggactatttttgttaagtaaagctactattcttgataacatattatatggaaataatatgaaaaaaataaacatatatttaattgttatctagagaatagttcatagtgactctattttgtgtagacttgactatgcgaggtaatgtatgatttgattgattctattattggttgcaagaatgagattgaaagagtattttagataatatgcatgttgtcacatgaataattcaattattttaggtaaagcaagcatcggtaaggttgccatcgttaaggttgggtcattacattagatgttccagttttctgattgttctaaaacaatccatacaaacgttattattgccatggt

SEQ ID NO: 18480 - DNA, 1501 bp, Oryza sativa
tataattaagctttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccgcgtgtgtcaaccgaggcgagtggccaacaaacggagtccactagacaccacacgggctgcacacgtggaaaccacgcggctaccgagcgggcacactaacacggtcaccacacgcacaagcgaacgactaccgacaccggtacacgggtaccggggtcgacaaccgcacaacgagcacgggcgacaacgaaaggacgaggacggggcagcaagaggggagaccttaccaccacgcgacgaggcgtgggaacgacaacgacgaacaggcgcggcggagacagacggcgagggaacgacttcggcggcgatccttggacgacggcgagacgcggccggcacgaggcttgacgacgcggaggcgaggacgaagacgatgacgggggctgcagcgaccttgacgaaacaccgaggacggacgagaacagctcgacggagggacgaacgccccgacgaccgggaacgacgagaggacgacgacgacgacgaccggggccggcgaggagacgatgagggcagccgacgacggcgtggaccacgccgctgcgatgccgacgacggaggcggcgccgcgagacgacgagccgggtgaccgatgggacgtcgacgacgagaacgatcggagacgacgatgatggaccgcggaggggtttggatggaggggaagcgaggccaagggcgaccttgccgctgcgatgccggaggtggtggtgccgcggctgaccggtaaacaagcgaggaggaacgggcggccggaggactccggcgaggcgggtagaggggttggtggcgacacggcggcttccgggcgaaaccgaggggtggacgaggtggagggctacgtcaccgtgccgagggaggggacggcagcgccggctgacgcatgggcatggcgaaaggggcagccggaggagatgccgccgaggaggaaggagaagccggcgcgggcgacggtgttccggcgaaattcgggcgaggaggaggagatgccggggatgagggcggcgtcgcggagtcgagggaggtggtggcgacgtcgaccggcgctcaggcagggagatagaggcggctggaggcggccgacgcggatgaaagggaagggcgacggcgggaacgcagctccgggggtctccgcgggaaacggagggcaagccggggaaggggaggcagctgcgatgctggaggaggcgacggcgcgaccggacgacgctccggcgaggagggagagacggctggaggcggccggcggcacgggagagagaggaggacggcggggagagggctagggaccacgggagatcgcaggagggggctaaaacgatagaacggagcgagggggttgcatttt

SEQ ID NO: 18481 - DNA, 1501 bp, Oryza sativa
gagtactcagcaagccatgggaaataagtgtttaatgcaggcttcaaagaaagggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgatcaagattggcacccggccaacaactttcaaacggccacccgggcctagctgatcccatcagctgcagattttccaaacaacgatccccttttcacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcctgtggggatcagccacgtcggtagacctccaagctttcatgacaaggcatttctaaagccgacacaggtttaccatatgccgacgagaggggtcccagaccaacaacaggttaggtcccagaccatactgtgccaggatgcccaggggtcctccccgataccaccccggcgaatccacatgtctctcggcatcaaggctcccctgataagttagttacttagccaggggtgtcccattccacccatgtggtcatacttgtcttatgttcggatgaaattccaaggaaacggtccttaagtgcgagagcgggaaaccgtacacccggtatgttccccggtccgtggttttggaaattcatttagttcgcaagcaccgacccaggtgtcgtgttttccaagccttttgtaaaacccaagttttacccaagaagtttttcagattttaagtttgaaggcgaccgtcgatactcgcacagggtgcacgaatatcgaggcgtaactagatggttacaaggggacatgatataaaaattaacaaaggaaggatcaaatgcaacaaattaggtaggtccgccaatctgccttgcagacgggacaaacagattaagtgcgatcctatcaatgcataatatttttcaagaaacataattaaattcaaatataggctcaagatgttcaaaggtggcttgccttgctcgagatctagagcttgatccacgaaatcctcgcactgcgggtcttcgggctccgaaactatacgcaaaacgggacaactcaacaaatggcaaaaataaagccctattaatgacctctaagcgtgccattagatagatctcgagatttgaggaattttggaagttgaacggagtcaaacggacttacggttgggaagatattgaatttctaagattattgaatttttggtctaaaggaaaaggatttaattaaatccttttggaaaaagaaaagaaaagaaaagaaaagagggagggaaattagacttccctcgggcggctagggcgcggcccgagagaaaaggggcggctcggccgagcttaa

SEQ ID NO: 18482 - DNA, 1501 bp, Oryza sativa
tcgccgccgtcaagctccctccggcgaatccgagccgttggctcttctcccctcgtctcgtgcaaccacccggtgtgctcgctttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcggccaagaccgggtcgagccgaccccggtcagccgctccctccggccccgctcgcaggcgcggtccaccgcgagccgtgaggctgcgcgtgggcccgccgcatccgcgtcctccgcgaaccgcgcgcgtgcaccgcgtcccttccccaaaccctagcgcacgccgcatactccctccgcacggtgagccgagccgctgacaagcgggtcccacccgggaccacgcgaggtgagcccggtccaccgtctccctctctcctcccttcctgcgcgcgctctcggccgccttttgggccggccggcccattaagctcggccgagccgccccttttctctcgggccgcgccctagccgcccgagggaagtctaatttccctccctcttttcttttcttttcttttctttttccaaaaggatttaattaaatccttttcctttagaccaaaaattcaataatcttagaaattcaatatcttcccaaccgtaagtccgtttgactccgttcaacttccaaaattcctcaaatctcgagatctatctaatggcacgcttagaggtcattaatagggctttatttttgccatttgttgagttgtcccgttttgcgtatagtttcggagcccgaagacccgcagtgcgaggatttcgtggatcaagctctagatctcgagcaaggcaagccacctttgaacatcttgagcctatatttgaatttaattatgtttcttgaaaaatattatgcattgataggatcgcacttaatctgtttgtcccgtctgcaaggcagattggcggacctacctaatttgttgcatttgatccttcctttgttaatttttatatcatgtccccttgtaaccatctagttacgcctcgatattcgtgcaccctgtgcgagtatcgacggtcgccttcaaacttaaaatctgaaaaacttcttgggtaaaacttgggttttacaaaaggcttggaaaacacgacacctgggtcggtgcttgcgaactaaatgaatttccaaaaccacggaccggggaacataccgggtgtacggtttcccgctctcgcacttaaggaccgtttccttggaatttcatccgaacataagacaagtatgaccacatgggtggaatgggacacccctggctaagtaactaacttatcaggggagccttgatgccgagagacatgtggattcgccggggtggtatcggggaggacccctgggcatcctggcacagtatggtctgggacctaacctgttgttggtctgggacccctctcgtcggcata

SEQ ID NO: 18483 - DNA, 946 bp, Oryza sativa
tacttacatgatgtccttttatgcaactttctaccggtttacttctagtaaatgaagtgcacaaaacgagtacaaaatagtaaatttctatacacaccttttattacaatcctagcaattaacatgattttctgctattcaaaggtatgtgtaatttacagaactactaacccacagaacaatcaattaccccaaataaacaattaccaggaaataaaccataaaatatgatgcttccaaaaggggtgctaaaacaaaggtttcacaagttcatagaagctcttttgcctaaaaacaatgtttctaggattgactatgattattcaagaaactaactaaatagttaaagcaaatacttagaaatacgggactaaggtataaatccttaattcttctctatttggcgtaaacccaactcatgaaggttcaaagtataaatggcgaatgtatattccccgtagtttctaatgtcccataggacttttccgcataatttctgagttccgcataatgccttggaaaccaaggacttttcaaataaaatgccattttcggaccaaaatcacggtttgtgcccgactccttttaataggccaatttctacttggcccacctccttatactggctagcttgaaaacctggccagcccatctcatatgttgcccaatgggctattacgaccttctcccacaagaagtgggtgaggtatgatccaattgccattcttcaatggagacgacggatggaaccaatggcaaacgtgctagtgagcccttagtagagatggacgactatagcaagttgccatgctcagaggcggaacggcggtgcaacatctagtagcaccgacaccggcattcgttggcatcaagccgtgaccggcatccgacaatcatagcttcatgttacgtgtcgacgaaactcggctcggcatacaggctggta

SEQ ID NO: 18484 - DNA, 1501 bp, Oryza sativa
tgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgctgagtactcccgtactcacccttgctctatataaataatcccccctcccccagttgctgaagaagatgaagtggatcccgctgacgaggagttcttccaggagcaagccggctacgatgagttttagggtttcggcctagttcccaggtcgcgcctgtattgtttggtccaagtcttggcttccgcttcccttttgtaatgcagttgtgagctcgggatctgtccgcagcccgacttgattgtactcctactctataataaagagacctttgttgctgtgataatctgtcttcctgtgataccagcactgtttcctgggactggtatcgattaacaggttaatttggagcgtcacgggctagttccggtcgggactagttcggggcgtgacagttttcctcgtgcacgcttttcaaactactaaacggtacgttttttgcaaaaaaaaaagttctagatgaaagttgctttaaaaaaaatcatattgatccatttttcaaaagaaaaaaaaagccaatatttaattgatcatgtgttaaaagatcactccgtttgtgtgcaggagggatgggttcccatcctgcaccgtcgaacacagccttagtgctgggtctcggctactcgtatgaaactaagtggaagggaatggagaagaagttggatggtttgattcatatccatgtataagttgatattaagatatttccaacgtaatgttttttcagtattggattttaaataattgaaatcatatatataaaagttgtgcatgtaaaataatttttattccctaataaaccgttttggattaatatgggcaaccaaaccgttgttgtgcatcgtcttgcatagagaaaaaggcgtttcccgggctgaaaagcgtatatcacgaagacgtattcatcttccgtagagaagagaaccccaccacgtttgacattccatcgctttccccaccccatggatggagtaccacaccagatccgatcagatcagatcagcagatcaccaagtctccttcacactcccactccagcggcagctgagcagagagctccaccgccgccggccacca

SEQ ID NO: 18485 - DNA, 971 bp, Oryza sativa
taacaaacggagaaagacatgcattgttagcccatcgtaatgaagggttcagaattagacatcacacaagatcagtctcattagaagactcttctgcaagtgcagaactatccaatggtattgactccactaatcagccaaaattagtgtaacaaataacagtgagaatccaatcttaaaaatttggttcatgttatatattcggtaacaatgttttttaaatagacaatctatgtttaatataacaaggtaccaatgatgtacatcctccatcacaatcattcatcaatacaggcacagcatgcgcgccatgtttatgtatagtcacctatttcaatacaggtgatggtgaagtcatttttgaggttgatactgatgttgatagtatgtttcatgttgtgcaatttctcgtgtaagtgagatgtgattctaatttctacttcctctgttgtaaaatataataacttttatctatgtatctgcacaaagatatgttgaggtacttaacagattagtatgactactggacgtaagatatatttttgttttgcactgagaccacacagttcgaaacacactgtgaaactatgaacatcaccttgtcccttagactttacttattacactctcttctaagtttatggtgtattgttcttgatccactgaaacattggctcttcattttgtacagtttgttaaatcctatgagactaattgaaaatcatattggctggggcaatgcccagagttttggctagctaacctcccacatatataaattaaagagattaacattaaagacaagaagactataattccacttaattatttaaataagaggcatgtgtatgggtgtgtaaagacggttgggttaggtaagactgggtgagaaataaatgacaagtggatatatagctaggaaaaataatactcttgagccctctaatatcttggaacattttttttaaaca

SEQ ID NO: 18486 - DNA, 241 bp, Oryza sativa
attcttcacatgcccttcacacgaggtaaatcgattgaggttaattttttattgtgggggtattactgtttttgggggtaaatcttctgaaatctttgcttgttctaaaatgtacagaagggtggaagtggttgcgatttttggtattgggaggaagggtatattaaatacctgaataggaaaggcttgattgagcaaaacacttgtgcaaagttgctgaatgaagcaaaccagagggaaa

SEQ ID NO: 18487 - DNA, 339 bp, Oryza sativa
tgcaaaatacctttcctgggcagcaagagaaatctgtaaagtaaagcagccatatatccatcccaaggccccttttatcctgaggttaattcacatgcaaggcaccagagttcagaagcaatgaagatgcttctcttttattttagaaacagtttctaacctggatattcagctcaccatgtcagtatggtcctaaactgatcattcacacttgagcaatgcttatagatgtttagctgattacaactttactttgagtccacaaattttggcatcccatgaaagtgtcctgtgtggtcctaatagctactttggaggtcataatcttcaatcaagaaa

SEQ ID NO: 18488 - DNA, 1501 bp, Oryza sativa
cacatgaccccacttgtcagccacaaagttatggttatgttatgccagaggatctgattcggcatgcggatccttgggctggttggtttgcatgatattttcgtagcaaaaactagttgtagttgagtccatggctctaaaattctcctaaggtccgccattgatctccccatgcaagagggaggcatgtctcagagaggcctgtagcgactagcgaatgagcaggggtccaacaggccaacaggaagctcgtaccaagacttgcaggcagaaacctacatgaatgaatgccttgattgcgtgccgggcagtctccccacattcgcagcagcatgcagctgacaccgatcgaacagggcgcacgtacgtacgtccgaggttggccagtggaaagtgcgctgcgctgcgacgggtggcaacggaacgcaacgcgccccatatgcatcgcatccgtttcgtcgcttccgccttgccggtggctgccaaaattgccatcccctggccagtaaatcagcaaggggcagtggcgcagtgtgcaagctggcctgggtgtaagacggtacaaaagtggtgcgtagcgcatgtgaaactgatggtgaaacacatgtgacgcgagacgagacttgaggcggggagagggctatcaggcaaccccaccgcaccaccggaaccaccacctcacaaacaccgtcaccaaacgccgacttaatacccttaaaagcgacccgatccccagtccgggcaacgcaaacccccacattcctccgctgctgctgcgtcgcgcgcgcgtgtgtgcagtgcaccgcccgttcgcggagccgattgattttacaacaccgcgctcgctcgcggtcgcggggggggcggaagctggtactactcgctatcatgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggcca

SEQ ID NO: 18489 - DNA, 1501 bp, Oryza sativa
acatgaattttggtggactagtaggaatcattatactctacattgtcaatttttttttagaatttttcacaactatttgcatcgaatttagaagaaaaaggtatataaggggatatcccctcgagggattagaatccactcccaagaagatatcgttcttctttgggttaattagacacatgccattactaatttgaaggtttggaaaaataccattactatttgacaaattgtaaagatgccattacaaatcgcacgatactggaaacatgccatgttctacgcctgatcagcgattgttgaccacgtgtgactaaaatttgttcttaatgaccaaaatgcccccgtttgaccggctataccgactggagtcgggtcagcaggagtagcacacattttatcccctttctcgttctcttagacctaaccctagcaggagtagcgacgacggcggcgacgtcatctacggcggccgcggcaacgacaacgtctacggcggcggcggcggtggtggcgacggcgcgggctacgacggctgcggcggcatcttcggcggcggtgacgacggcgtctacggtggcagcagcggcgtattcggcggcggcggcgacggcgtctacggcgtcagcggcgacgactctttctttccatggaggggtaggaaacgtactgcaagggatggagcccaaatcaaggtaaggtagtcgattccttcgattcgatgtgctgtgagctggatgtgtaggtttttttttctgtgcattccatgtgtggttgacttgatttcattccaatgtcaatacactgttgttctcgatagagttaaaggttcatggttttaccaccatagattcggatggtagacggaggtatactaagggttgtgtgctgaaatgggatgttgagtatggtagcttctctttggatttgttgatgctaagcttaagctcagaggttagatggggtgagcagcagactgcaaccgtgtggtttttggacaagggcagtaatgaggacgttagaattgtccatgaatctcaactggttgacatgtttgaaatgtacaagtcagaaatgcatgctgaattaatggtcttagttgttgagagtgtactctgcgatgctagtgctaataacatagagccaacatcaatgccattgtgtgttcttccacttactcagacagggcagggagcatctgcatctaaagtggcagtttcaagtgaacctgcaactcaagaagcggatgaaacattgcctaatgtgtttgacatggaggaggagtatgtgggtgttgatgatgagggaatttatattcaacctattcacaccattccacctacagatcatgctgaaacctctggtcaacctagtgctgaaaatgctgaaccatgtgctgaaaatgctgaacctggtggaccttctgggactgctcaacctcatggtgaggttgaggtcactgatgatgacccagcagagtttaatgttcttcataaccctg

SEQ ID NO: 18490 - DNA, 1501 bp, Oryza sativa
aggccgttcaaaagtgccttggaagttggcgatgaagtggtcgcgtagctctgcccatgatccgatcgtgccgcgtggtagcccgtggagccatgaccgggcggaatccgttagggccataggtagataattcgccatggctttgttgtctcctcctgctgcgcggattgcgagaccatagacggtgagccaagactcggggttggtggtgccgtcatatttctcgattccagttggcttaaagccggctggccaatccactcgacgcagatcgcttgtgaaggcagcaactccgtccacatcgtcgtcgtagcgatccggtgaatgatggcctcttgctgcacggcgctggttgatggtgtcgcgaagatcgatggggcgccttcgatgtggggagtgtggtcgttcaactcgacgctccctatatcgttcgggaggcgaacaaacagaccgttcatcatgtcccttgctcctgtgactagatccggcgccggcaatgctgaggcttggctggtgatagtcttgagatcgaagattagggactcggctaccagtcggggtgcgggtgcttgcagagttggctggaaccgaggcagcgatcatggtcttcgtctggttcaagatgttgacaacatgatcagcttggttgagtgcgtcttccttggggagggtgtcgaggagagtgattgctgcaaccgcgttctgctgggggggtgcgaaagaccgttgttccatcgacgtcttgttgcccaatgagctctctcgctcgccgcccagattccaaggcgcgttgccgtcgatcttcagcctcctttgcaatccgttcgcgatcttgttgctcacgctgtagtcgttctcgctcctattgctgtcgctcttcctccagtcggcgacgttcagcttcttgccgttcgcgatcttggttcgcttctcgggctcgacgctattcctccgtttcgttgtcagccatgaatacgccgaagaagaggggcgtgtagttgtcctcatagccgtcatcgaagttgtcggggtcgccgtggtcgtagtggtagccgaagtcgtcgtagtcgaggatctcggttggtcgagaactgacgccgggggagttgaggtagccatccaattcttcaacaacattgggccacatcattgtgagcacaaattgccaaagcaaaaagtgcctaagtctctaaggatcacaacgggccacgtcggaaataaaattaggctgaagtactgtgcaggcccaggcctgttagcactcccgataccctaatatcaccgaagtgaaaaacgtctcttcgtcttccccaccgaaactctcgccattttccccatttcctgctacagtacaaactgcgccggccaaactagggtttatcaatccgctccaatccatcctcaaaaagttcacggaatttctccccgcgtccaccgctccgattccccatccctttccagccgtatctcggaccaaatcaaaccatccagtccacattca

SEQ ID NO: 18491 - DNA, 1501 bp, Oryza sativa
gaatctaacgagcctaattaatctatgattcactacagtgatgctacagtaatcattcgctaatcatgaattaatatacctcgttagattcgtcttgcgaattagcccataagttatgaaatgagttttgtcagtaatctacgtttaatatttctaaatagtaaaattttgaagggctaattattagtcctccggatccaaacaaggtctaggaaagagaagaaaacatcacaccttaagtctaactaatcattgccttctctctatagctgtagcttttcttcgtgtcactgcagcgagagcagctagagctagcctgttttacctgatggactgactaatggaagaagcaccatgatcatttcgcgtaggtttgtagaggtcaatatatgtagcacagttgggggtgcaatagtgacaagtgtgcctgtcatcgtctgcttatcagtcacagctagaaattgaattttgaaaaactagagttattggaggtattttcatcatagtttatttcgcaacatcacatatattttattttcacgaatatgtaaaaattttgcacctcattgtattaaaaaaatagtgcttgaatgcaatttaatgtgccggtcaccattgcctggattgcatggctatgtcctttgagtttgtaatcactcgttttttctttcttatgtgattgaattccagtgcaattttactgttcatcatgtacgtgaaggtggcttatggtacgtatatagagatgacaaaaagcatgcacgccacttgactagaaagttaattaaatagttgtgcaattgttctttatttcttttacaaaaggctgttgttgcaaaattttagctacctttcatatggctttgttagcacacaacgagttccactagctagcatctactccattcctccaatgtacgcagttagccataatattactccatgtgttttttgaaaaatatgattcgatcagctaagcttcggttcggacatcccttctttgcagaagtgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttaggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccacccacttttattattgccgaaatctagtttcgacagttggcgcgccaggtagggggagcgtcaagcttttcgccgatcagtgcaa

SEQ ID NO: 18492 - DNA, 1501 bp, Oryza sativa
aaatcgttaattatgatctcaactaacgtttcaagtcttgtaattagtatgcttaatgattgccttttgccgtgttatagcaagcaacactcgaatattattgagttgcacggcgatggcggtgcaagcgatttaagcccatattcaccgataagccaaaacggtttattagaaaataaaaattaatttatatgtaaaacttttatatatttgtttatagcaatttaaaaactaatgctaaaagggaattacgttaaaaaaaatcttgaaatcaacttcaaatacaagttcgaaaatttaattaaattttaccttttgcttttacttattagaccaactgatggcgctctaaatttttacgccgtcggattgctgcttaactaatttcccgtgcagttctttttattaaaagaaaaatcacgtatgctagtaccgtttacaaggatatcgacaactaatatgcttttctgcattatatatccacaattgatgcatggactggatttttcccactatttaaagaaatatgttcgaatatctttattttttaaggactcatttgaaactcttgaaaaagtatataaaatacctgattttaatatgaacgcaattgagaaatagaaaattgtctatttccaattaatcatcatataacgttttatagattgttatgaccatgttaaatctatttcctaagtctattcgtcatatgcgtatgagagtaaatagatattagtgcatgcatccatacacataactatgtatgactaacatgcaatgtcttgtgattttattattggttaagagcagagatggtgcatgtatcgagtttgttaccggagtaaatgtagtgtgcgagagttattgacttttcttagtcttagcatattcatgtaatatgataatcaattggaaacaaagagaacatatataagacaaggaaaatacatgaatgattgatcgttcgaatattacatgggagaacacgtgaattgaattagagaaataaacttagggaaaatttttcaagaggttaaaactcttgctaactttccttaaaatttttggattgtctatttcgttcgaatttcaagtgaaagtatagtgtctaacatttttgttttaaaaaaaactcattaggatttttctatagaaataaaatccataattttttatatttttcttacgaatcagagggggtgtaatttgttttgctgaatccaaattagataatttgggtcatgtggctagcatgcttacgggacatatctgtctctcagtttatggtctagcttacttgtgaatcgaaaattgtaaacctaaataaacagatagccccttttttttgtttttttaaacacaagtcattcttacaccgttaaatcattagttaggttggagtagtttgtggcttatttgaagcggacctgtcgcagcactgttgctgttgccgcatacaaatagcgtgcagtcccagttccagcgcagtcacggcggccta

SEQ ID NO: 18493 - DNA, 1501 bp, Oryza sativa
tagctgcgtctttcaggttgttgagagactttgtgcaataattagactaaggcattaagcattatcaagataggtgaatgtttattcaattattctatcgaataaagtggggaaagggtgaagaacgcgtcagatatcacccaaaaatgtctctgtccaacaagatttagtatttgcggcagcctgtgccggataacctttcgctgtgcttttttttcctcttgtttttttctgccatcggttcatgaatcctccaagccgtttttttggccactagtgtgctgtgtcctgcactactctctcaactcacaagtcataactcaacctttttctaatggaagaatccatctctgaacatttccagggcacagtagctccaagctaaccgttgaaaaatgaaagaaacttctctcatgctattccacttcagtagtacagactgtacagtgtcaaataaatgaatcagcatgatcaaactaatttgtggcatggtatcatgttagtacttgaccattcattgcatacatggtgattgcacagtagttgttcgatcacgtattcacgtgatggtaggatcatcacctgctaattaatcagtactgtcagcggtcaagtttattagcacaagatccagagctggttggctgtaaaaaagaactaatgaatatactagtacgaaaaagtcacagcaactgaacatggaaacgaagattagtatttagatcaagacaaggcgaagcgacaagaactggcgcaaatgctgtgcagctgatcaccagatgcagtatagtggacaaaagcatttgccagcagaatatacaagtcccaagctctgcagccaactactaatggcgatcataaacaaagggttagatgcaggatggaagtgtgagatgagatgagatgcagaaaatggtcatgtgacatcatgtgcaagcaggcaccaaccattaggctacaagaagaaagcattacttctcccagtgcagtaaagcaggcagctggtatcaggagtggactggtaaaagatgcattagagcagacaactgtacttgcattaggtagaatcacattaacactgtaagcattagctggggcatagtcagtctcagtcacaacaccaccctacacttgtgtagtttataagtgtcaagtgtcatagaatgatgctcgagtataatacagtcaaaagagcaaggagagctggttatgagatccaacgagaggggaaaaaattatgtaatgacaacatggttaatattggcaatccctaatggcaatccatacaaactcatgttcaactgtagtgctgggctgttgtcatctgtaccgttggttctcacgcttgctgaagttcccgccatcccttgagctgtgtctgtccgatgtctgaggcgcatctcttccgggtttcttatcctgtatgatgaacaattgcaatcagaaaatgagttaactatactgtttagtaaatggaagaaatcaaaaagttcataagtga

SEQ ID NO: 18494 - DNA, 1501 bp, Oryza sativa
ataattcaaaacatagtccttttaaaatacactaaaaactgatagaaaaactacatttcgattgaaagagaatcaggaaaatgagggaaactgctagatccagagataccacatcactattgatcagaataattttcaggaacaaggagtttagaaaagcacacgacgtgtttaatacactatacagtaccgtgaaagcaaattcacaataaaagccagccacaaaatgatagattccaattaaattttgaagtacaatgactagtgatgatattagaaagtaccaccaatacagttgtcacatcaaccaccaaaacctgttcaaatagggaaattgggacctatgagtgttacagcgttttaggttctttgtggttggcatcagaactaatataagacaattagtcatacaaacccaacaagaattaactattccctaagatgttttttttgcacagtaacagtataggactgaagcaatcccacccgcacaataacaacagtagcccccaaaaaaatgagggcacaaacaatcatcagaaaaaagatcacaataacatcattggatatttggataggggcatatggtagattttcctctgctgatactaatatttcatttggcgctctaacagaggaagatgctagtgtttggatagatgaatgatagtacttactcctgtactacacaaacacaccagaaaagacatcaacaggcagagtaggatggcaaagttctcaggaaggcatcttctttgcattttttttcaaaagaaatatagatgtagaggcggaaataaaagctattaagtatcaaaggatgataattgttgaatcatggcaggttcctaagaaaagaagatatgttagaacttataacagaaaggtaaacatatatccctaaacttcggtggagtctaattccaaaatccaaacaattgcacatgtaagattgaagacatgtcacgtatacaaatagataagcaaagcaaagattctgtagaagttgggatctgaaaggaccaaagcagtattatccctcggtatgtctgaactccagaaaataatctggattgaatcaaccaagtttaagaaatttgtgtgattatgtcaaattttagcatgttatttacaagttctcagcagtcaaacaaagatgatctgcagacacttaattgttacagctagcccagattaccaaaagctcttagcgatgaggccatgagggccaaagtaggatgccagggcagccaaaactgtaactgaagtttcttttttcaaaaagaaaaaaaaagtagaaccaagggaaatactactacttcttaattggctttctacaagagcttcccccttgccttaccaagtagaataaagaatagtaaataacactaacattggaaggtagattctatttgccatgatttagccgctatcttcatatcaagaatatgaattatagtaatggcatataacaataaccagtactacaaaagcataaata

SEQ ID NO: 18495 - DNA, 1501 bp, Oryza sativa
tgatcgtcggaaaaattgtctgaaatgttctaaaatgtctctgttttatgtggttgacaggagctggaggaggtgggtgggattgaggagctggagaaggagatcaagaggaggattaagaggaaagagaccttagatgcgatccaatgagagctacttatcacacatttttttctttttatttgctgtcatctcttattagtttttgcttcagtggcaattgtagccttgtaatatgcttttctgtcctgttaatagaagaataatttagatagatatttggaagctcatttggacggtggagcacacaggtattagaaatgatgtgctggggctgaatggctgatgcttttgctagtactgctggtaatgatatatattaatcagtaccattctgaatttattagtctggttgagtcgtgctgctgacagtgaggtgttcactgataaaatgtgtactttcttttatattctttatttgccgacattctgtatctcttgttcacgagatgtgccggatgtaaatatgaaagtgatgcatggctgattactttttgaccgtgaagaagaattaatgaagcttatgcacactaggcggttcctccatactgctgaatggctgttcattaaggccctgacaagtgacaaggtcacagactgacagttacttcttgaggtcaaggaggttaatgtagtttatcaggattaggttgcaaactgacaaggaagatattgtccgttgtgtttctactcttggtgtcaagtcgatcctcacaggatcacggtcgtggcattgctggtccttggtagaacaaggtagggcaagcgcaatgttgtgatctgggacctttcaaatcagatcctagtgattgtcccctggttataaagaactgcatgttacggttactgcatgattagttaggcataagcatgtgacgaggatcctcgtcgtgatattccgtccatttttcaatgttgatcaagcgtggcagatctcctgctgatctgccagcaactgttgctaggttcagagtttgcttgatcttgtttaagctcttcatcggcgttttttatgtttgaagtcatcgtttaatggcatactactactatactagtgatgtcctgtagtgcattagaaaatacagaatgggccacatactcaaacactgttaccggttgaccaaaacaaggcatatatcgaaattcacacactgcagacttgcagttgttgactcatgtaactttacccttctcttaggccgtgtttagttcacccccaactcaacggttttgatgggcctaaggcccaaatcaacggttttgatgggcctaaggcctgaaaccatgtcgaacagttcgatgggccgaaccatgacgagaaagcccacctgcgacactggacagcaacggcagccagccacagccaactcgccttatcccgtaatccatccatggcataaagctccctcctcagctcccacctccgtctccgcgcacgctc

SEQ ID NO: 18496 - DNA, 982 bp, Oryza sativa
atatatatatatatatatatatatatatatatatatatatatatatatatatatatatatatatatatatatatatatatatatatatatatagggagcgtatcctatgtacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttgttacggctaaaatataatgaatttgatgttaagattttaaccctaggtgtaagacaattgaaattatgtgtatgattttttctagattttttggtgatattttttagttggtgtgcacgtgtgtacacgtaagggcctgtgtgcataggatatgttgccatacatatatatatatatatatataaaagttgctttctattcattcataatgctctgaggtgattgcttttattatttttttagttaattccataatttgtgctgattaatttaatttctagatagaatcatgtttttatctctacaacagatttacttcaaatgacatgctaaagttaccttcttttgttttaagttacttctataatatatataaattacttttaggttttactgaatttacttttatatatctaagaagtaaattagtgaaatctaaaagtaatttagacatatcataaaagtaatttgtgatttttcatcaaaatataatcatgtgagatcttgttgtaaagatttaattgttacgaacacaacggtgtaatcggatcatagatcggataagtagtttaagagaaaattgtatttgaagtatagatggatgatacctcttatagatggagtggtagctagtttagacaaaccagctaccactagctatgtagt

SEQ ID NO: 18497 - DNA, 251 bp, Oryza sativa
ttatcttgaaggtctgcagttagtgttatatattctagtgcaacaagtaagtaataaaattagcagtggcattaactcgatcgatgatggctaaactgatccttccaaaggactgccctataaatcaatagtgagagagagaggtcataattaagcagaacagtagcaattagtaagacagtagcttgtggtagagcttgtaaagtgtgtagtgtacgtagatagcaatataatggctgcatcagtgaaga

SEQ ID NO: 18498 - DNA, 1501 bp, Oryza sativa
ccctaagctcctctctcttcctcagggagcgtcgccgatccgtgggtcgctgctcaccctcccgtcatcggctgccacccggcgtctatcgccgtcgctgttggatgcaggtcgttgtccggcgttgactgctctcgctattggatcaaggttgtcgcccatcgtcaggcatcatccactgccaccgccgctcgccggctcgccgcccgatcgagcaggccagcacccatctccagtgcccaccaggtgagttcccacccttgcactgcagccaccctagccaccatgtccaattacgatgaaacattctcttttttccctctttcatgttctttgtaggtgaaccaggtatagaggatgtggtggaggcgtgggggctaatcactatcagtcagattttcgtggatcgagcttattacctgagttttctcctcttcgctgatggaaccggttcaggtgcgctgcaaaggtaatagttcaagcacccccagaaatcaagtagtttaaatacttatgtgttgaataaactagcataaacgacataacggtgattcagtagtttttgttgtaatagttgctatcgttgttttcttgcagatgaatgtgctcttatcctgatacggcatatagtgaatcattgtggaatgactgaaatctgttttactgtggaatgagcaaaaaatgtttacttgcgttgatgtcgagaaggttatataagtcgggagctgtttggaaagggttttatcggagcaacattattgggaaagtattttgcggagcagtttggaaagggttttatcagagcaattctggaaattgtacttttattggatcaataatgattggaaaggattttatcggagaaatcttgattaggaaggtatatgtacgtgtggtcagaaatttatccctttgcaattcaatagatgcattctctattttgctaacaggaattaatttgcatttctttggtaagaaaacagacgatgtgcattgaaagaattattgttctttgagatcttgataatatgtttcttgtccaggcattcccatgagttgcaaatccaaggaagttaataacacgacctgtctacagtattacaagctaatcgatttatcccattacaagctaaagcccactggtatgtttttgtttctctgccattcaccattgaaatatggaatgccatattcttttttccttcgatgcactcttaattgtctgttccaatttcttcgaccacttataatttgcagtttgatattgctttatcccgctgctttgccattagaaccaacaaaaggagaaatgcctttagctgaagtcctcagattcaataccaaagttgattgtttgattctaaacataattatcatggtttcttgtggtcctttaatggtgatattaagatttgggcaaaattggtacaaaagcaacatgtctaaaataccttggtagcttccccatttctattatctctccaatttactcttaaattgt

SEQ ID NO: 18499 - DNA, 776 bp, Oryza sativa
gcatatttctgtacaaggggaaaactacccccagtttgataagatgaagccattgctgattgatgttagagatttctacactctgctagtgcatgctgcttttcaaagatttcctaacagtgaagccaataattttcgatattgtatggtactccgtagcctgcagtatgtccatcacagattcacaatccatcacagattcacaatagaacatgcaattgaccacttgatcctgtacaacttgtttgttaaggaatggaatagagtttagatcagtacgtcgccaccttatccctcaaagacacatgcttactagaaaaatcaggaatgggatgatgtcatcatgaatcaactcatggttgatggtttgattcctcaaaccaaacaactcactagtattacttaacccatgtttggtgtgaaattatttggagtaccatctctttggttatagttgcatatgaagtataaaccttgggaacaatttgcacaaccaggttaatctttcaagcaaaagctggaataagagttactagtagtgtttgcgcagactggacttgtctggtagtgatacacctggtttccttgtttctgttgcatttatcaagcaccacacatccatattgttttaagattcatcaaacccagggaggacaagtaaaaaatgcaaacattttttttatttgaaatcaccttttatgtatttttatattgatttcaattgtatttttaaggtaagacttaaaaatatatatccctgatgttttaacactagg

SEQ ID NO: 18500 - DNA, 225 bp, Oryza sativa
actagtatgccttttaccataaataaatttttatggaagaaattctgtggtgaactttcataagttaatttgtgttttcagaacaaactgagatttattgttagtttgtggagtattaactattgcatcaaatcttgcaatacgtaggctagattttacttttacaatcatttcttggaatatatatttcggacgaaaccgaggagcggccggagtggagagcga

SEQ ID NO: 18501 - DNA, 1501 bp, Oryza sativa
ccaatgtaatagttaattcatacaatagttgcttactatactattaatatctaatcccacatgtcatacacacattacgtcttggagtccgtgctgtagttggctacggatttgtaacccgctgctcttctctatcttcatttatctatttaaaatatgtttataattagcttatagcatgctattgtacatgctcttagtagtagggtggatctcaatatcaagtagtagtaaatgctggatattgtccacgatgtctaatgcccactgtggtaaataaggtgatctaccataggaaaaaaaaaaacatccataaggatgagaacatcttcgttcattaatggcatccaaaattcttcaatcatgttccaaaatccaaaattgagttgatgtacgtttcttcccaaaaacacttccaaatctataaaatggggcaaaacctaattatacatcaatccttcaatcatgttcattcagaaaatattacatcattttttttcaaatccctaagttttaggggctccataatgtaaaagccatggtattgtgattagttccaagcaatcccatatattgggacaaaaatgtttagtaaaacccaaggagcaagattataccattcctttgcctcacatatatttatgtataataatcataaaaagaacagtatgaaatgtctttgaattcatatacatgttgaaacaaaatgtaataacaaggattttatgtcacgaatgcccaaaaacttttttaaaaaaaaattactcttcaataaagtataatacagaaaaatgtgcggactacatgtttgtgcatataaggaacattcaagccaattaattctgaaatgcatcatgtaacttaagatgattacgaacttgctttcaggctgtactaattttaacggaatctgctcatagttagaagtactagtacacatcaaaacacacacaaaggctgtgttcggcagccatatttcccaactcctctttatcattttccatacgcacacttttgaaactgctaaacgttataatttttttaaataattctataagcaatttgttttaaaaatgtcgtattgatccttttttaaaaaaataatacttaattaatcatgtactaatgactcattccgttttgtatgcgtgggatgagttttcaactcgggccgaactcagccaaagagtacaatggtcggaattggttcgtactactcaactcattgaacagtgctagtatttatttatgggaaaagtccattttacacacttgaactcttacggttgtctaaaatacacccctaaactatgaaaccgtactgcatcctcgatctgtcgataccagacacttaaccaccaccaacaccccccctccccaaactggcaggttttacagtggtttttgacacgccaacatcagcgcacagtattggctcaagtgtgtatgggtcgaggttctatctctcacacacatgctctctctctccccctattcatgg

SEQ ID NO: 18502 - DNA, 670 bp, Oryza sativa
tatatttagataatctgtagagtaaatcttacattttgcatttgtttgtgctctatcattttggcagttggctagcagccagccagttacccagaggaagaaaggtgcttcttgcatgttagatgtgcccatgttcaatatttcatattagtatttcctgtgcaaacagaggctgttcaattctacagtgtaactacagatatctattgcattccattccttaaaatattcgtatttcatgggcctttttcatttatgctcatactttccacgggattcatgtagactattaatgtatatatgtagaagcatatcgtttgacttgagaggtgatgtcatgggatttgtcttgcataatactttcataacagacagtttccatgtactatattgtaatgaaaaacatgggcaatattgcattggagactgaaaagtgaaaaatgacctgtgtttgtgaagtttgagagggcaaagattaaccttattaccaacatgtggctccgctacattgaaaatatatattttaattcttccatttggtttaatattattgatctttttgatgtagatgtcatttcagatgtgtttgcctactcattttgaattttttctttatctgttgaatggttaataaattacaactcattttcctttcttgtttatacaaagg

SEQ ID NO: 18503 - DNA, 1501 bp, Oryza sativa
ggccctgtgcagaccgtctgttctgccctcctctctgctcttctcttctcccagttgctctgcctcggaaggtacctttaattatctcttcaattgattcctttatcttctttgtttttatggtctttataaaaagaaaatgtagagattcgactgcactttcatacttaacctcgtgtgtttagtctattatataaacctaacatgatcccaaaagaaatagtaaattaagaacaactatatatgcatattcactggaatcacatgctaccttctgggctttggcaaaagaaaaaaaaatacatatatggtacatttgactgtaacaacaacaatagtaatacaactgtcattatgatacatatagatatgctgattcgtttatgtatacataataacgtggatctgaaaggtatcaataatgataatcctgtgggtacattacataacatgcgtgatacagcttggcagggatggtgctcatgttctgtgggctctacatcgtcttgtgggcgaagagcaaggaaggtcatagtattattcatttggaaggtggcgatgttgagaaggctcttttatcctaattaacaacccaccttttctttttctcttgtaattcttgtaagtatgtacgtattagatgtaattgcaaaatagtagcagtagctcttttttttttctttctctaggtgtatctgtgtctagtacaaaaggtagtatttgtttgtagcaaacgtcagcacatacttttgagtgcggaagaagatagagtacactacagtacccctacatgaggaaagaaaaaaaaggagttagaccaaatctggatgagattaggactgttgatgacgaattaatttgtctctactgtgcatgatgcatcatcacaatgtaggtgggtgtcaaagtgccaccttccaccactggagctggagtggtatgtgatcgtccaaacaaaatcgaatcgcagcaattattaagtttaatggtgatgatacgacgctcactcaggcctttgccatctccatcgttgacaatagagacaattttccataatctaaatcatacgcacttttcatactactttgaaaacaaaaaaaaagttactactcgtggtattttttaaaggataaaagaaaaataaaaggtggtagtatattttagtggagtctggaaaatatatccatgtcggctgttgatgaaaaagaaaagaggaaatacaacaagcactagtagtagggcgtatggaataataatactggggcggggtgagtagctaggagaggaggagcacgcgtcgtcgtcgtcgtcttcctcctcctccgctcttctcttctcttctccgcatcgcattcattcaagtctagtctctagtagacgacgaattcgagatcgaatcgatcgatcagatccctctcctaaactataccaaaccctagccctaacctcatccacctctccgcccgcccccctccctcccatctgccccaaaccctaacga

SEQ ID NO: 18504 - DNA, 1423 bp, Oryza sativa
gccattgcctcgtctcctctctcccgccgcatcgaagcaaggctccaccgccggcgtcgccctgaagagagatgagaaagagaaggggggcatatgtcatgtgtttgcctttttcttgactagaataccacatcagctaaaacaacccttaatattatcatggaccatgatttagacggtttggttaagattagatgaactcttgtattacgatttaggctgtgttcaggacccctccttcctagcacgcaaaacgaaactcgtattattgcatgattagttaagtattaactattttttttaaaaaaaatcgattgatatgatttttttaaaacaattttcatatacaaatattttatataaattacactatttagcagtttaaaaaacgtgcacgcggaaaacaagaaaggtgggttgggaggggagggggagaacacagcctgtgtaaatgaaagtggacgtaaagatgaagacgtgactcccgctcgagcgtcccatgggaggaggttaaaatcggacactgacgtccgatttacgtgtaaaactattttaaactgatttatctcttaaattacttcaaatcatgattcgattgcactattaaattcgttgcaattaaatcttcaaaataagaccacacatggatatattccgacgaaaaaaattagcttattattgaattatttttaaatgttgcacgatgtttcaccaagcatatcggaattatttcactaagtagatcgaaaatgtttcactcgtttaaatcgggtgttgtttcaccttatataaaaacaatgtttcagcaaatagcaaaagaatgtttcagttcactgcaatattggatctatacatagtgaaacattgtgagtacactaggtgaaacatttttaggtgaaacaaaaaataaaccaaattcccttactagggggttccaaaatatgttggttttttttgttgcaatggaatatttcattcactgcaacattagatctatacatagtgaaacattgtgagtacactaggtgaaacatttttggtggagcaaaaactaaacgaaattctcttaatagagagtttccaaaatatgtgggtttttttgttgcaaaagaatattttaattcactgcaacattatatctatttaaaatagtaaaacattataagtacactagctgaaacatttttgtgaaaaaagaggagagataagttggtgggcccaacaggtgcgcgcatgtggggagggaagcgactgattttcccacctcctccggtcgaccgatgttgggcattctcctaaagatgagggatgagaagtgaacttgggccctagcccatagagccattcggctctaacataaatagatgggccaagcctccatttcctcctcttcttcttcccccgcgaccgccaccgttgcagc

SEQ ID NO: 18505 - DNA, 1501 bp, Oryza sativa
ccaagcaaaaaagagctccacccttttccttctccatttgacatggactcgtggagagatagagagagaaggcttcgaatatttggtagtatcaccttcacactgttctactattgtgttattaaatcatagtagtaattagcagtcgtacccatttgcagattttctcaattggcggccgggctccctgaggatacagtctggctggtgatgttcatgtggctgatagcgtcatcgcgatgagtgggtttctttaagatgtacgcaagctacggctcggaattgccattcaggcattcacacgatagtcatggcaagtctaataccaaaagaatggtacacgacacctggcagcgcctccgttgcgtatgtgcaattacgaggctgtgtactctaatcacgataataatcatggccttcttactagtactgttccagtgcgtcctgctactgtgctacgcagtaatcatcacgccgggccagccaaagcatatatgctccgatcaccattcaggcgatcactgattcgttcacacaatcagacccccggaccccggctcgctccggctgctcgatcggatgccttacgtgcaacgccaaccacggggtgtagcaacgcaacagaaggccattttgtccccatataccccgacgtacaagccgttcacgttccacgacccgacccacgagcgcgtgcgtaaattccttttgcttctcgcggacgacatgacatgaggacgagtaaaactcacgcccccacaacgtcgtacaggtccatgactcgtgtgctccgcccgatacgacgcgatgcgtccggtgatattttttttctttttagcatggcgtcgcgactcgcggcacgcagccacgggcacacgacgtgcgcgcgcgcgctgcaacctgcggctgcggcgttcgctcgattcggcgcaggcgcgcagcgagcgcgagagccgcacgagcacgaggagacgcaggaggatgcggggacggaacggtggctgcgtcgcgtgtttgccaatgttggccgagacgcgcgcggcgcgcggatgagccgagcaaaagagggcaattttttaactgttgacgcatcacatgggaaggacgtacggggaaaaaacggataccgtacctgtcacgacgtaggattattggattatgctttggacaagccttccttcctttttccagtttctaccattattttcgtcttctttgcccaggcggcagcggagaaggaacacactttcttttcacgctgttcatgaccaaagctgctgtaagtagtactaccttcgtctcgcgaccaactttgatcgttcgtcttatttaattttttttataattagcatttttgttgttatgagatgataaaacaagaatagtactttactcgtggcttatgttttcaaattttttcaaaaaattttcagataagacgaacggtcaaagttgggcgcggaaaaccatggctgtacttattttgggacggaggaagtac

SEQ ID NO: 18506 - DNA, 1501 bp, Oryza sativa
gtccatgatgtctcgcaagcagttataccttgaccgtaaccaacagcaaagacgggcccttggccaccctcgaaacgccatcaatccgccgaaaaagatcttagatttcgctgtttcacttagccaatttgctcaaggttttcgtacatagatgtcgtcatatatgtcaataattcagttttcagtctgcatctgcatcctcttgaaatgtcagcatgccggttcttgtatcacttatgggaggtcacagcctaatcgatactagaaagagaccgtctccttgtttctttgtacgattcgatacagcaggaaaaaaaacaatggatgatgaaacgccggcctctctcttcagcttaccttgatataccactccatttggacaaattgtggagaatccgaactctcccacgactggtaacagaaaggacaggctactgatcgctgtcggattagcggcaattgtcccttcttaatgatcgagactctgagctagccctgacttgatttagtatctgtctaaggatacggctcctgcacgaatcttatcttgcggtttacttgcaacaatagatcatggatctatcacccctatttacagaaacaaaactcattgcttttaaagaactcacattttcgggtaaccttgttgtcccttgtgggttgtggttgtggcaaggtcctttgaacccaccatctgaattcaagttgcaaacttagtacatatactattttagtgatagacaatctatacgttgataggaaaacgtcggtgatgattttatcaattttaaaatataccggtccaatcctcgaatgcgtttttacctgcacattcgatgagtgcgagaagcttgtggtgactttgtcattattaagacatacttttaaaggtggttatacggatagggtatgtatatatgtatgcatttggtaagtgggctcgtatgtaattgaacgtgcgtggttgtattgtgttttgtttttttcgaaaaaaagaacttatgaatcttgtactattgtctgtcttaattcattaattcattcgtttgacgacaattatgcatatatttgccaacttcgggtggcggttctctaatacaattcaatagttatggcatatttttcttctgttggtgtgtattagtttatgtttgcttagctttgtttgtgctatcgtgaactttctatgtgagttttgttctgtgtgagttctgtaataattggctgtaactctttgagtaaagactggaatgttacattccattatctaaaagaattaattcattcgtataatcgtggtattatctgataataacacaattacacaagacaacgctaagcacaaatgtataggtagaaaatgggccttaaagcccatttggccagtgaaatctaaggcccaaaagatagcaataatgggccgaaacccaaaagttaatgttgactctgtgtgctccattatagtcctccacgaatccatggtcgctggaaaagggtggag

SEQ ID NO: 18507 - DNA, 1501 bp, Oryza sativa
tggactcacttgtgtaatttgagcgagtcttcgagtttagtctcatcaattgcatgttttatgcacattatacttatttctaattatgcatgctaacttctgaaatacattatgacgatatgatacactttttttttagtctcactttttaaaattatgttacaatccagtggattttggtataccccgctgcacgctggaagatctaaaaggaggtgatccagcgttcaacgcaaaagttctccaggatgttcttgctggtcaaagaggttcaattgctgatgctctcgtaagttaatcattacagttatcctctctttctagttacttctactttctaccttctaaacttcttgtaatgcatttttttacaatgaactcagaattctgcagtggttagcctatctttaacatacgaatatttcataggaagttcttcaatagatgggggtttgcagtgcgccctgtcataaacagcttaccgatccttgtcatgataggatttaattttgtttagattttttttcacaaatcatatatgacacttaattattaccttgcacacgttgagttgctttgctatgcaaaacattaatcaatctttttttcttcataggtgctgaatgctgcagcatctcttcttgtcagtggtaaagtaaatactttgcatgatggtgtagcgttagcacaggaaacacaacgctccggggaggccatcaacacacttgaatcctggataaagatttccaatgtaagtacttctgataattaatatttgcaaagcacattttgtctgtcagctaaatatgaatctgacgccctccggaaaattgttgatacagagttgctgagactgatgttggttggccaacagaattcctcgataagatcctcaccaaagaaaaaaaagggattcttcaataagacctgaggaatgatggcaaataaggattattttaggttatctttgtccatagtgacatatttatgtatgttcgttccaagtgccatctggggtgagattataaggttatggttgggattgtagcttcttttctagtctatttagagatagatgactcttgtttagagatcttggtagtgcccgttacattatgtgctagtgcaaggcgtggaaggaaaacggagctatacagtatatctgttcaatgttgcatctcaattttgtaaaatgcttcagaaacaatacatatgattcatctcgactgcctcccattataaactgaacttgagttcacaacgataccctggatgtgcacgcaattatggaatcatttccaatatgcctatcttcagtttttcacacacaatcagttcacaagcacaaaatggacactcataagtatgtacaaaaccatacattagtattgatacacccagtggtggcaggcagataagtctgcgctagctatctaagaccaaaacgatggacgctagcagcagcattcagattttctttggggaagaagcgttgtgtttc

SEQ ID NO: 18508 - DNA, 1501 bp, Oryza sativa
acagcaagcatgtaagtttggtggccttctgttgaggacatgatcatgatcatgagcagcagagcacggggagcactttgcctagcgtggccggaatgtattaccagcagaagatgcatgtgacaagcaagcaaacaaacgtccaggcccagcacagtgtttcttccaaggcatctctcctcctctgcactgtactgtactctgtagtgtaatcttgctgtttgcagtagggtctctgaccttgaaaggaaatctgttaattaggcccatccaaatctcccgtcacttcgctttgacatcccttggattttcctctgtctcgtgtcatctgctcttttgttctattcgctgggatttagttgcgcaaatcgcgcgcaagcttgggaaatggtatgttagtttttcatttgtctgatgtgttctttgccctgtttctgacgtagcagtacaaccttgcgtgcgttttgtaataacttcccttgcaaatagagttatgcaaaatctgaaagcatcagtacatctgtacacgaacagaatggtaagcgtataagtctgaaacaaataggagtagtaaccgattaactgaacggtcagaaatagtattgagctatactttgtaagtcaatgttgttttcaccctggattgacccaagattaccgctggtaaatcgaccagaatctgacactgacctcctaacaacggatagcgtgatactaattttttggttaatgacttggaattataaatgtgtctgtagttgagtaattgctgctactgcatcagcatgtctgaaattcacctagctggctcttgttaagcccaggctttaagaagtctgtccccctagctccccactatagctggtgtagctagtccacaacaaacagcgcacaagctcacttgctctcaacccaaggacatgaaagcgacgacacgtcgcggcatggccgatcagggcctaccatcgaagaagaagaagaagaagggttcgagcgcagcggccgcgcgcggcttcatgtgcggctgcggcggcgccaagtcggtgtccgtcgtgtcccggctctccgccgccggcaatatctcgcccgccacgaccacgccaccgacgatgacgtcaagtgctaccgcgacgtcggcgaagacgacgagggtgaccgtgcccacgcccgcgccgaacaccgtgcacgacgcggatggcacgccgagcgtgggcacgctcctgctgcagctgcgcgagctggagcgcggcgtgcgcgcgctgggcgtccgggaagaccgcgggatcaggccggcgacgccgccgccgccgcggcacaggaggagcgcgagcgatgcatcgtcaggcggcaggcggcggcgcgggcggctggaggaggagagcgtgccggtggtgacggagtcggacgacccgctgggcgacttccggcggtcgatggcgcagatgatcgtggagaacgagatcacggccacccccgagctgcgggagctgctgcatcgctt

SEQ ID NO: 18509 - DNA, 1501 bp, Oryza sativa
acatagcgggagcggtgcaggacacgtggcgggggcggcgcgcgcgggaggcacggcgtgggggcgcccgattttaactcccccgctagatgctcgatttgagataatttcaccattacaatcactggtacatgaatcttactcttctatatattgcctcacacgttaacacatgtatcttaaaatgatttgaacctgtcctcccctctccatcgccatccacggcaatcaatcctgagacttgcagcgtgcagcaaccatgtcgttgcttgttcgttttccagctctatcatgttaatcttcacaatttggccggcttcggacggcccgagcgagaaagaaaatcttgaaggtatcttctgctgttgctggcagcatcgtcgtagctggatgccgcgatccctgtcactgggcgactattacgatacacatcgtcgtacactttaaacaccatctggagtagtaagtttttttttcccccaaacgatgacataaaatcagccgtgctggtccaaggatctgccgtctaatttgcttttgcgaggtagtccagtacattatttccttcacttgaaatgtttgaagaaaaaaacatatcaaattcatataacatcgattttatgttgatcacacacgtcacaggtggtgtcctaaacacaacctgatcgagattcgagagagacatgtatatgcttagcgtcggattagtactaaaagacgggatcggtttcggtttacatcatcctgagcggctgagcgtgagcatttactcatttagagtgaattacgctttgggccatattttattatctatatttcactttggactatccttaaacgtatcttttcactttggattggataaatttaccattgttgcgatttggaccaccacgaatgatttttttctcatacaatcaacaaccttaaacacatcagctctagtatacagtcgatctcctctatatatggttcatatgtttgctgaaagagaagttaaatatgacgagaaaagttgtcacggtagtctaaaccgcaacaatggtaaatttacccggtccaaattgaaaagatagatttaaaggtggtccaaaataaaatttagataataaaaggtggaccaaatgacaatttactcatttatttatttatttatttatgtatgtatatggcccaaaccggaagaagcgaacaaaaaaagagcggcaacaccaacaagacgaagcaaaaagtcgagtaaaaaaaggcagtaaaataggcaaaagagagagagagaaaaaaaaagcccgcgaagggatagagagagagaaagcgcgggggcgcgaacgacagcaactgcatcacccaccttcctctcctctcctcccctccaactcccgatccccaaatctctcgcccccacccatggatcaccaccaccaccacctgccgccgccgccgccgcggtcgccgatggagaactccgcgtcctccaagccgcccaccccggcgtccaccccgt

SEQ ID NO: 18510 - DNA, 1501 bp, Oryza sativa
gagtagcggcattagcgactttatccctggccccttcaagcctattgatcttgtcaactaagacatcaaactgtgcctgggacttgatcttgcggtctgcatcaacagattcacattaacgaatcagcatatagaagataatggcttttaaggtattgattattggtaccttcaacctcctttaaagctgagtccctctgtcttgccagttctgccttaccattttccagagtttgaatctgcttctccagttgagatatcttggcagtttgcactacattgactctagttaatcaagattacaaagataataacataagttagttgggcagagtttgtgtgtaccttttgatgagccgctcagttcaaaattggatttctggagctcagcaatccgatccctcagatcatgttcattcttcttggcaagctcttttgtttcgtgcagatgattcctggtggcttcgagggtcccgagatgagggactaacctctctaaggttgccgttttagcttcgttcctaagatgaatcctctgcaagacagtttaattagcacctggactaaatggcaaacgagacggttgagatcaggcgtcaaagagcctacatttacaatgcgggtggcttggctgagtgcctttttcagcaagcatacctcttcatcttctttttgcttatttattacgattccttgaggctgcatgttgtcatcccaccacttgaccagaatgggagggcgcgaatcctcagctgcttgtatccggaggatctcttcttcatcaccaatcattggtcctaatgtatccatggataacgatcaaacaatcaaataaagtcagttagatcaacgtggtttcagacaaagtgcttacccgtgataatttctggatgaggacgagtggactcagatgcctttgaaggagatccagaccttcggtcgtggctggcatcttgaccgcgaggactatctgcttgagctccaacttctggaatctcttggcttggcttggtgtccgactggttttcagtcgggggctcctgattaattccggctccagcttcggccgactcatttccggtcgggggttgatcaccagactctacattatcggttgctggctggttgtcactcagctgatcctcggcagttggctcggttccttttaagttcgtttccctgctggtcggctcagaatcttttccagaaggatctatatcagatggtttcctgcaagtttgattatcagtattatttcctcactgggtgtgcatcaatgcaagggagatcgttatatgagttgtacctagaagacttcctgatctttggcacaggacgactggatgttttttttccttggagtaacctgcttcagcagtttcttggttgcctctcggtctctgagctttctagcagtgtcgccttcgtcgtcacttagaaccagcttcctcttgcgagaatctggctggccgattggatcagaagcacttagttgagtttc

SEQ ID NO: 18511 - DNA, 561 bp, Oryza sativa
agctcggtacccacttgacttgggccggcttgggctgcacagcacgcgcgcgagggagagagaagaggaaggaatgggccgaaaagggcccaagctgaggaggatgatttttattacttttccaattaaaataatcacttaaatgatctttcaattgttaaaaatacttcctatgctcaaataattccaagaaaaatcttgaaaatacttggacactcaaagtacttaaaaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacaggagccccggggagtgtttttataggcctcggggtgcggca

SEQ ID NO: 18512 - DNA, 1501 bp, Oryza sativa
tttaattgcattcatcacagcagtcaattaacattgaaaggggaacattccagcagtgttcataatacataataaataatcaaatctctttctatgcaattggaggtgatttgacatttgttttattctaggagttttatttagtttcaattaatttatattaaatttggatgtccacatgatcgcgttaactagaataatacttaaactgataatgtagaattttttatgcatagataaatagagatatgattaattattccaaacaacttatgttgagaagttgagatgtttcatgtgactagcgttttgtgcatcctactattaatgatctgatcttgtcctgaatctgatatgtgtgattgcaaacaacattgaaatgactaagttatgagccctactcttgagaaaatgaaatcaagtagtatcttgtgtctgtttaagccagagagtagaggaatatttgggtgtgcctctgcacatcagattgaaaaagatttttaagttcgcaaatgcagttgagggtgcgatacaaataaaaatacccaagtattattacttggaatgattagatgatgatatggctgttttgtctcttacagcacgaggtgaggtgcacttcaaaatgccagtgtatagattgcggtaacggccccagaacaaagtgtgagtatactagactgttatttctgtttccttgtcttatgacatccaagtgtgtaatcaattgctttggaatagcttggaagcatcgtattttgattttgttcttcacccatgtcattttctttgtcttgaatatatttatctgacttactttatacaaaacagatgattcaaacatcggaaaagatcagagtgatgttagtggcctaacctatgaagagcccacgatggacaccatgcaatctgagcacactctgaatccaaacaaacgcccaaaatattttgcaagtttttggctccttcacacttcgttaacataatttaccagtgtagaatgtaaatgtaatttcaaagtgttggaaattttcaaaggaaacactgatgatctgctcttttatgcagtgatatctctcgcagatcgtgatgctttaccatcctcaagacaatagccactttcttccaaaaatgcaactgtaaatacaaacaggtttgagtatcccttgtaacgaaatcttaaagcacggtgatcggtgaggccttgaactccatgatacttcaaatcttgtcgtccatttggtagtctcagtgggttcagttgaccttgcgcttgatcaagaactacgaagacagttcccacctatagctaatatcatccatactgttaccaaagggccggggtgtatacatttcatcccaatatggaattagttgttttggcatgcaaatgttcctgcttcttaatctctcatgttcttggggatattttgatcatgcctgaatctgtgaatccttcagtgatgagagcacaagtattatgaggtatgatgatgattgc

SEQ ID NO: 18513 - DNA, 1501 bp, Oryza sativa
aagcttagagttactagcatgtaaaatgtcaagtgcatagcttgaaggaagaggcagctccaataggatgtccaatagtcactcttgaaaatgtggtgcctgattcatcttgcacatagacaaaaatacaatggaaataactgcatcataattttcttctctctagggccgtgttctttttagctactttgccaggttattcctatggatcatttgctccatgcctctaaaggtatttttgtaaagaaaaaaaatatttctaccgcattatatagaccacttgttctaagatatttgtcaagtttatttttttaaaatatttaatttatccatgtaatcaagtagataatccatactaataataaattaaataatctattttaagtagggccttagtacatttaacgctcataagcagagaatataaagcaaacttagattttactagggataataaaaaataaaatacaaaataaactgtacatttataagcaagaaaatgtatattttctgttcttaaactattgacctgagttaattagttttcatttctcacctacaaaacaaagtaaaccccatccataaattctcaaatcatgtaaaactcgtactttatgaatttgatcattgttttgatccatatatatatggtgatgctaaacctgtcatacgaatggtacagccatatgaatatatgaatatatgataattatcatatgaatatatgataatttgtgtaatatataatggagaatgattgtccatagatgagaaagcttgttctctacgacaagcaggttatacgccctatgtagttcaaaatatcaatcaaattggtcgatttatttggttggaaaatgatacaagtacaaacaaattcttacaaaattttttaaaaaactgatgtggtacactatgattgcatcttgacttgaataaatcaaatggctaagatctttgtttggtaaaagttttataagaattttttagtacgtgcagtattaatctatctcattgtactatagttgatggatgggttttaccaggttgtaattgaaggacaatactaccgactagggtgcgttttaaagcttgtttatcatgtttatcgtttaaagcttgtttttcgaaaaaaaaagaaaaaaaaactaactagccaggaccagcgatagatgggcctccctctaaatgggcccagaaagcccactaatcccatcgcattcgccatttcgcctccactgtggcggaaatatctcctccgcttaaacccccacatcgccctagccgccgccttccccttcctacctcgccgccgccgccaccgccgccgccatggccgccgccgccgccgccatccgccgcccgctcctccgctccgtcgccttctcctcctccaggtcccgctccctcctccacctcctctcccgccccctctcctactcctaccccccttccgcctcccccaaccatctccaccacccccaccagcagcagtggcagc

SEQ ID NO: 18514 - DNA, 1501 bp, Oryza sativa
ccatggcttttacattatggagcccctaaaacttagggatttgaaaaaaaatgatgtaatattttctgaatgaacatgattgaaggattgatgtataattaggttttgccccattttatagatttggaagtgtttttgggaagaaacgtacatcaactcaattttggattttggaacatgattgaagaattttggatgccattaatgaacgaagatgttctcatccttatggatgtttttttttttcctatggtagatcaccttatttaccacagtgggcattagacatcgtggacaatatccagcatttactactacttgatattgagatccaccctactactaagagcatgtacaatagcatgctataagctaattataaacatattttaaatagataaatgaagatagagaagagcagcgggttacaaatccgtagccaactacagcacggactccaagacgtaatgtgtgtatgacatgtgggattagatattaatagtatagtaagcaactattgtatgaattaactattacattggctgtagatgatttggagctagttgtgggctatactattaaacttgctctaagttgcaaaagttacattgtggttgctctccttgcggtgttcttcagtaaagagcacaaagtttgaggatactgtagcaaattttatcaaaataattattcccctgtccgttaaaaacttcaaaatgaaacactctatcctatttttaacaaatgataaaatggtaaaacaaagtcccaagctcgtgcgtgcactcacgtttttttcaataaccatgacacatgctgttgtggtgctattcgaatcatgaacatctcgaatattttcatatataaaaaatgtcaccaccaaatataattgaacaaacaactcgctttacctgcaagaaccgaaccaaacacgtcggtatcatcgtgttcgtgtaggatataaatataaacacaacaaaaatgatgtaaatatatatgtgaacacaacaaaaggttttgaacgatgaagacttaaccgaaactacaaaaatatattttgatcttgacaaatttgtagatgatttaacattatttgtttttaactatacgcgtcccacacaagctcatcataaaagtactccctaatacacgctcacaaagaacaaccacaaatctttggtcttcgctaaaaaagctatgggcgcataatatctatggacattattatttaaaccttaaagggagcagtaatacaaccacgatttcaccgctgttctaccggtattaatttcctgatttaacaccttattttagttcataattacttagggactagggtttgcattttcgatttcagccaaaatttcggtagcaccaaaatagaaatttcgtgatttttggcacttgtcggaccaaaattagttgaagtacttttacatgttttgactggatttgaataaaacttgaccaaattcaacaaacatttggtaaaatccaaaaa

SEQ ID NO: 18515 - DNA, 521 bp, Oryza sativa
tgtttcaactgttcaaaatgtccccttttttttttcagagttgcacaaatcctctctcggtaatcacgccgctacttttaaacccattctattcatcttactcaactgctatcatgtacaaatcgatctaggtcattgtggaattacaccaaagcgcatgtctggcttgctctatcttcatgggcctctggtttttatcatttatgtcaaacacaacaggattatatatgcttgcatttcgtctatgaacattcattctgttattatacatatatggtttgcatatgctcatagttgcctgcacaatctactcacacagttgcgaagagcgcatgctatcctcggatgcgagcgtgggactgttgttcgtcacttctcatccagcacttgctcctctcttgtaaaggaagatagtatgtgttctctctttattcctttctgatgtctcaataaacttttgttgttcagaaagaaaaaggaacttcctttcgtcatacaaatatttgggcatcactcgccag

SEQ ID NO: 18516 - DNA, 226 bp, Oryza sativa
aagcaagatagtgaaattacagctcgaaatggttaaatatttctccaaaatgatttcacgcccgtttggttgccacggcacgggcatctcgtttttttccctgcacaatcgtatcaacgcccgcctttcgtgggggcaccatcaaccgagacacatccttcaaaatgttattgcttgaaaggcgaactaatgttgcaagaacaatgttgtcgccaaaattcaaaga

SEQ ID NO: 18517 - DNA, 1201 bp, Oryza sativa
cgagctcggtacccaagaaaaagaaaaaaaagaaaaaggattttccctagaataaaaatattgcttgctccattttaattggttaaaaattatttctagagctctgaaaattccactaaaaatcctgttaataaatttcgacatgaagaactcaagaaaaattccacatgtcaactccgattattatttgcattactttcttagggttttctcttgattgcacctgcattttcttggggtcgtttataaattaaattttaggcttggtaggagaacttcggggtgtgacactagcactccagattgattaatcaaagcatgttgcacggcatagtcaatccgatcttggaagttgttaaactgcggttgtacttcattgccatctggtctaagatcttcaacttgtaccccctgaaaaccatcacctttatctcccgagccctctggaatgcctttactacttgattcaactgtaccagccggaacttgttgtacttctccattcttagaagaacctgttccaggaacatcagcaactaattttaccttatacttctaaacaactgttcccttacgggtctccatgaaagaattcaagaactggtgttgtatttgctgcatcatcagatcgagctccttcttttgttccggtgttaatttgtctatagtgacgggaacaatgtttccctcatgaacttcaaacccactaggctttgggatatcagtcttggaagggacctccgacttgccaatcgaagacggtgatggtggtggtttctcagccatgagagaacgttattgcaactcggtcccactaggcgtgccaaaagcgtgttgatgtaaaaacacgaggcctggaaaatctgcttaacttcagtgcaggtccaaaaatcttgcctttagattcgtgagcgtgccagttggtttgatcctgcaatcaacaagaaataaaggcaaagagactgcggttaaatccataaatgatagccgatcagctagttgccgatgacacatcatttatctatgagccgatgtcatgtttgaatcgatcggcagatataaataagtaagaagagactaaatctactcgatcggctgtagatattgacagtatataatctctatgtcgatatatacttaaatcaagtaattgggatagatcggacgccatgccgagacagtatacaaatcacttaaatcg

SEQ ID NO: 18518 - DNA, 971 bp, Oryza sativa
taccctctgaccatgatcaggtatgctgcctcctgacaggcgtgatctgctgtgcctccagatgcctcaaccaccatgttagctaggcaggtacccacgtagccgtggacctccaggcgaacacggtgaggaagctcgccactgagcggtggaatcgtcgtgtactctggcgcgttggggtagcccaccaccagtgtcatacgtgccaactccgccacaaagtcgatcatgccttctccgcggtggttgggtgggtggccgcccatctagagaagacaaaggagtaggatcaatgcatgctcaaatccaaatttaaataaagcaataaaaactcaaataagggaatcgaataagagcgaaatttttatgcatagatcattttgcatgagagcgaataaataagacagactcacataacgataaaataatgagaaattagatacatactaataataacaataaaagcataaataccttgcaacccatgttcctaagctatgacctaatgcatttcacccatcagatcccaactgactgacgaataaatctcaacagttttactaaaaccctggactgacttgttttgaaaaatctcacttaaacgagcgaccaagatttttcccttgaaccacaagaacagatcccaattttcccggaataaatccaattgcaaagaacatatgcaatgaaaaggattcagagggctcttaggtttttccatttggcttgtcctacggtcaaggtcggctctgataccaacttgtcacgcctagaaattcccgaatagaatttcaagcagaatgtgcattaaaacccccgtccaggaccagccggggtacacaaacgacaatgttgacattcagatccacgtcttacaaacatcataaagtcttacataaatgcagcggaaaaacgaaagacaacaggagctaagccttgactagaactgcagcggaacaccactccacagg

SEQ ID NO: 18519 - DNA, 273 bp, Oryza sativa
aaaacaaacagtcaaaattggacacggaaacctatagtttgccttttttttttggacggatggagtaggtaagatatgatgaattgatgatttattcagttgactggagaatcagggaagcaattaattaactaagcaggcccgatgaaggccacaacgacaccatagcccataggcacgcacaggcgcacacacatccagtgcggcagtgctcagcttaaatggaactagggcatcttggcagtttaacagccgacagagatcctaacaaga

SEQ ID NO: 18520 - DNA, 1501 bp, Oryza sativa
cgtacttaccacaagccagcgtgggcaacggctgggcttgtagtgtagctttcctctagttgacgcatccaggcaagggtgggcgtgatggagcggggcaggccctgtgacagcctctgtcgcttccggattcacctaggcatgagaggggactgcccgttgcccgctggggacgggggtgacacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcactctagtgtaatcttttgaaattggatagtttaggtggatggttgggcctgtcgcaacgtgagttagcgttggacagtggatagttaatattaattaattattacaactgtttaatctttcaacttctttttataaatgctcgctttatgcaaatgaaccactttagctcttctttgatgattccgtgcatcatacccctattccggtatgacttgctgagtacagtgggtagtactcagtcttgctctccttttcccaaccccagagttcgagttcgggtcagatgaaggtttctccgaggagtaggctccgtccgtgccgtcgaggatgcctgtggagtggtgttccgctgcagttctagtcaaggcttagctcctgttgtctttcgtttttccgctgcatttatgtaagactttatgatgtttgtaagacgtggatctgaatgtcaacattgtcgtttgtgtaccccggctggtcctggacgggggttttaatgcacattctgcttgaaattctattcgggaatttctaggcgtgacaagttggtatcagagccgaccttgaccgtaggacaagccaaatggaaaaacctaagagccctctgaatccttttcattgcatatgttctttgcaattggatttattccgggaaaattgggatctgttcttgtggttcaagggaaaaatcttggtcgctcgtttaagtgagatttttcaaaacaagtcagtccagggttttagtaaaactgttgagatttattcgtcagtcagttgggatctgatgggtgaaatgcattaggtcatagcttaggaacatgggttgcaaggtatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatgggcggccacccacccaaccaccgcggagaaggcatgatcgactttgtggcggagttggcacgta

SEQ ID NO: 18521 - DNA, 416 bp, Oryza sativa
catgcaaaatacgttttggagtggttttcactgtgggtagtgtgacctttgtgtggttctatcctacgtggagtcttgagaccacagttgcttgtggctaccattgtacatgccctaagagccttaagtctgaaaatgtttttttatatacctcatgatgcatgcttgtaattcacttttcccctgatgataatagaatctcagcagagaataaatgaaatgagacatagtatagtcaagcctacacacagtcaaaagccggtgacccaagctgatgcacatgccagggccaacaagcgtatgtaaactattctcaactgtatgaaatattaattctctattcgcacgaaaaacgagaattaattaattaatgtggcgtgaaacacgtgctccatttgctttttccattctgcaga

SEQ ID NO: 18522 - DNA, 1396 bp, Oryza sativa
tatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatggccggccacccacccaaccaccgcggagaaggcatgatcgactttgtggcggagttggcacgtatgacactggtggtgggctaccccaacgcgccagagtacacgacgattccaccgctcagtggcgagcttcctcaccgtgttcgcctggaggtccacggctacgtgggtacctgcctagctaacatggtggttgaggcatctggaggcacagcagatcacgcctgtcaggaggcagcatacctgatgatggtcagactacgggagcgccacaactacatcttccacgacacggcgtaccgatttcaccctcgtcgagccagtgatgatgatgtcagcaccttccgtccgacagccggcgagaacgacaccacctttggtcacatgtgtgctgtgatgaggggattggacaggatgcactcggacctgcacaaggcgaccaaggccttgaacgatgggaagctcatgaggatcgtcactctgaaggacgagatagcgcgcctgaagagggagaatgctcagttgaagggtcttcccgcgccaggaggagtccggatccgcactacgccccgcaagacgatgactgcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaccggaggttggttgtctgctactcccagtggcagccgcgatctcagcagcagcagctccagtggctcacagtcaggcagcggcgagacttatctgccaggctccgggagtcgctcagagagacctggtgatgagcaggaggacgccttcgactccaccgaccgcaggagccgttccgagcattaggctcgttttccattagtttatcgactgtctagcttctgcttgttagtttgtgtgtttaggctgcttgtttgggggtcagtcgacggtcgatatcatgtgcttatgatatggctgtcttaataaggatttttttttgcttgttttttttagtgttttaattcagattagaacaattgcagtttaaattcctttgtaataaagcttagtttctgagcatctgtttttcttcttttccccgtctgcttttccctccaga

SEQ ID NO: 18523 - DNA, 512 bp, Oryza sativa
taaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaaga

SEQ ID NO: 18524 - DNA, 1330 bp, Oryza sativa
ttctgttaaaaatgctcgctttaggcaaatgagccgctttagctcttctttgatgattccgtgcatcatacccctattccggtatgccttgctgagtacagtgggtagtactcagtcttgctctccttttcccaaccccagagttcaagttcgggtcagatgaaggtttctccgaggagtaggctccatccgtgccgtcaaggatgcctgtggagtggtgttccgctgcaattctagtcaaggcttagctcctgttgtctttcgtttttccgctgcatttatgtaagactttatgatgtttgtaagacgtggatctgaatgtcaacattgtcgtttgtgtaccccggctggtcctggacgggggttttaatgcacattctgcttgaaattctattcgggaatttctaggcgtgacagctagtcactacctttttaaacatggtgaagtcattggttgatggttcaatggctgagtatcaggctacaggaccggtatatttaccaggggatgttttcccaaattatcggcctctgatcacaaataatcagccgagtacttccagtgtaccaccagcagcaccagtatcagctcctgcacctgctgcaccatcatcggcgccaaaacaaattaccaatcctcgcaacatactggacaaaaggtcaatcggctgactcaggaacatgttgctgctatgtttttgccaaatcagcctactgtcgaaccagtacaacaattgccgattcagtagacgccaccaaggcagcagattgctcagccgattcaacagcaaggtttgctaaatgcatcggctaggttgaggacgcctgataatcagccaaggcagcatgttacaactcaagttgtccctgagcatttggttcataatgtgcaaccagatcaatcggtgatacctcaagttattcccgaacatttggtgcacacattcagccaaactttcagaattatcaagggggcaatttgaattaccaatatcagcctccatcgccacatgttcagtataagcaagggggatcagctcagccttagttcgctcctcggtacaatcaattcgagtctctaccacaacaagcacaaggggtgcctcagcagagaccatgggccgatttgattgcagatgtgatgagggagcaatttgggcttaagccaaaagacactggaaacttataacggcatccatatcctgaatgatttgagagggttcaattgcctaaccgatacaaagttccggattttttaaaattctcaggacaagacaacgtttctacctatgagcatgtcagccgatttttggctcagtgtggtgaagca

SEQ ID NO: 18525 - DNA, 260 bp, Oryza sativa
aagtataggaatagattcttttcaatactctttccacttagcttagagatttaatataagagtgagtagcttccggtcctcatggaaagctacactcgttgaggtagaaatcgaagagagcgccaaacttccaggcacacttgcagagcttccgctcattctctacctattctctaatgtacaaaagatataatagagcctcttgtatttcacctcaaagttgtgtgtgctggaatgaagtgagctcctccttttatagg

SEQ ID NO: 18526 - DNA, 523 bp, Oryza sativa
gaattcctgcagccctgtcctggtcggacacaactcctatctctaacaaactttaagataccataagtctttgcggcaaacttttgcccaaacttatctctaaggaaattatataaaatatcctaattaatagatacaattgcctttacaggacccaatccgtgcgtggcaatccatatgaagcacattaactcaacccaacgatgtgtaccgggtcacattgtcggaatcggcccaatcggctaccttgtccgactcgaactctgctgattctgatcgcagccgattcggacttcatccgattcttattctgtttccggtcgatctatctcttggattccgcttcgattttatcttcatctccgatacttgaattaccaaatttggtcgttgacagtgcctcatgacatacaatggggaggcttgaactatcagtcccccagatcaagcggtatgcctccatctctcggtgaatggcgctcaagttcctctcgttgggacttaggtgaaatcactaggagaa

SEQ ID NO: 18527 - DNA, 1501 bp, Oryza sativa
gggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacaaaagcatatgcggcgcataaagaggcattctagccgactgctttttagccataataaaaagaatccgaatggttaacactctaaaaggttcacgaatgaacacacttgacaggcatccgaataaaaaactctaaagattacccaccaaatattataaaaattatggtaatgaataagtctaatagcctaagctatgactatccaccataatgaaaacaggcatatgtggtgtaaaatccgagtaaataaactcataaaggatttaccaaccgcctaaaaaaaatgactacaatatataatcagcctaagccataatattggtcaataaaaacgcacacttacgtggcaaagagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacgtgacaggccacacctgaaaattcgcattgcaataattccgaagaattatatgaccgcgtaaaaaaggattttatcagcattggacaacactattgtgcgcataagttgccaaagcaaaaaatgcctaagtccctaaggagcacaatgggccacgctgttaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgcaggcaaactagggttcaccaatccactcaaatccaccttcgaaaagttcatcaaaatccttcccgtaattcaccgcctcaatccctcacctctccctagccatcccccgaatcaaatcagcgcattcgggtaaaatcaa

SEQ ID NO: 18528 - DNA, 1501 bp, Oryza sativa
gtagacggtaagccacgattctgggttagtggtaccgtcgtacttctctattccagtcggcttgaagccggctggccaatccactcgacgcagatcgtcggtgaaggctgctactccgtcaaggtcatcgtcatggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaaccgcccgtcgtgacccctgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtcggtggggcgcgagtcgacggtgggagagctgtagtagccgtccaactgatccgtcgaaaccgtgccgagtggttggaggatgacgccgacttccctgaagctaggcgaaatcggtgttgaagccgacttccgcctaggcctacgggatgaagacgctgtcgtgatggaggcggccgccgaatcgtcggggagcttcattaggatcggtgggtaagccccatcatcttgatctggtgtcgttggagaagatgcgatctcgcccgagtggtttgaagccaactcgattgagatggtcttgaagtaactttcagccgcgtttgggagtccaaacgggactgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctccccctacctggcgcgccaactgtcgaaactagatttcggcaataataaaagtgggtggctatcaagctggaaaagtgtatgggtttggaaacaaaggat

SEQ ID NO: 18529 - DNA, 1501 bp, Oryza sativa
aaaatttaattaaattttcgaacttgtatttgaagttgatttcaagattttttttaacgtaattcccttttagcattagtttttaaattgctataaacaaatatataaaagttttacatataaattaatttttattttctaataaaccgttttggcttatcggtgaatatgggcttaaatcgcttgcaccgccatcgccgtgcaactcaataatattcgagtgttgcttgctataacacggcaaaaggcaatcattaagcatactaattacaagacttgaaacgttagttgagatcataattaacgatttgtgtaaaacttcgaagatttggtcaggtgggaggtcactttcatatcatcagcaaatttctgtcatcactaagaagaagaggtgtccatcaccaaatgtgcgagattctcagctaggagagttggatactacctccgttttttaatagatgacaccgttgactttttctcacatgtttaactattcgtcttatttaaaaaatttacataattataatttattttgttatgagttgttttatcactcatagtactttaagtgtgatttatatcttatacatttgcataaaatttttgaataaaacgaatggtcaaacatgtgagaaaaagtcaacggcgtcatctattaaaaaacggagggagtatatggtttggccgcgtactatagtgattttgctcttgctaacagctagctgcgtgtctgtgtgcgcgatttttttttcggaaaaaaaataaaaaacaggatgcggagaacgcatgaacttttttcatttttaaattttttgttttaatatttatagaaatattatactggcaaaaatgtttacaaaaatatatcctgccgcacaagtggagagcggcaaggtgatgtggcacacggcgtcgtgtgcgcattttgcgttgaggtcccttgccgggtgaaatgcaattttcgccgcacgcaaaattcacatacccgctcagcggtctccggcgtctgctcacacacgtcaccctaccgttctcaaggagggttgcgtggtctatttatgtaaatattttcgtctgtataatatttctgtaaatattaaaaaaataaaaatgaaaaacattcgagaacgcatgggctattgggctgggtgctggagcccatggccgtcaggcccagaggagaaaccagtgatcctacaaacgcgacttgatcattgaccactgaccatgctatttatggggtaatcagtccaggttgcaactggggcctacaatttctgttccctatatgctccacagagcgactcgccctcaaacacgtagactggaacgaacgaacagacgaacacggtgcactccactactacgctatttttgaccatgtggccattagtgatctgtgctcttttggccgctcatcgatcttggccaccactgtcgtcgtcatctccttttccaggccttatttggcatgaaaggaggaggcggcgatcggcatcat

SEQ ID NO: 18530 - DNA, 1501 bp, Oryza sativa
cgcgctgggtgccgtcgtccacgagcttcctcatggatgacagcgtgaccgactcggggatcgccaacagcaaggccttctcgcagctcagcagcggcgatggccgttgatcaatcagctggtcagtgaaccgacagtcggtcagactcagatagagaagtttgtaaccataatttttcctctctttttttttatgctgatctattctctgaatccaaaacccatgcacgtcgcagcaacgatacgtcttcagaaattttgctgaacacgaacggaataccgtaatctgcagcaaaattggtgttgcaattttttctgtccttgctgtctgcatcgtggattcatttcatatgttagcgcgtgacgaaatgacttgacccaggatgaacagatcattttatatgttcagatgagaacaaaatcctttgcctgttctttcttcccaattggccacgggcggccgttttatagtacaaacaacaattctctgcaggaccttgacagagacttgtgtacagttgagttgtattgtactcctacgcatgtctggcgtcaccctgatgaggccaaattctcgttaccgtgttccgcctaactctttgattataatgatgattataatgattatcttgttagtggaagattcattaatgggatcattcctaaactactggctttagagcataataatatatggttcacacgattgctgacctagaaaagccgccgtcccgccaaggccattagagaaaccaaaaataaaaggaacttttttttttccaaattcgatctcgccgaagcttttgcatactacgatgatcatgacatacacgaattgtgtggttagaactcagccaaactgggacgtgcatagctgcaatgcacgcattcttcagaatccccctgattgtctcccttctgctttgactggaaggacggcacgcatgcatgcgcccaggaagagtaataaccaggtaaagccaaattctttgggctatttccttttcgtttaattatcaggtgctgaccgctgaccgtgccgtcgtaatcacactgccctgctgactaatctaaaccattttttttatctattatcctttgactgtttaattttgactacaattccaagttgcaaccagaaatcactactgccctattcaggtggcaaccgatatgtccacggcgaaagagacagcccaaactgcaaggcaaaaggctatggtacttgggccaaaacgtgtacagatgctctcccctccgcaagcccaaccaaatccacggcccaaacgaaaaagataaaagcccacgctgatcagagcattaaaatacctaaaccaaccggcacggccacgacgcgtgggccccaccatccagcgagtcctcggctcgtcgcacgcgacgcggtgaattgattgatcgaccgattcctccccaactccgctcgccaatccacagctggcctccatttcttcctcctccccttcgccgaatcccccacacc

SEQ ID NO: 18531 - DNA, 1501 bp, Oryza sativa
atcacacagtgtggttaaagattaagcaagctcttgctactccgacccgattgcctttctctgctaccaattccgcctgatgatggtgagggacgcgaaccgccgcaccggcgttgccttcctcttgcgctgccggtggagagaatggccgcctcagccttcagtttcgagaattgccttcgcggcctcacgggcggcggagaacggggatgtcgcagactcgtcgggggacggcgcgtgtccgcatctcccaaactcgcatgtagaacggcgggaacgagctctctcggtatgcacaacactgcagcaactccgcacgccggggatgtctgtgttgtaggctcgtagtcgtagccatccaccacggggatttagatccactgcagtcgactgatcatcggcctcacatatcaggcacgatacaatttgctgcagaggatcctgaatttctgatcaccgccacggcgccacatcgtccaacaagagtagcagggccgcgccacaaggctgcagaagaagggggacgaacgggaacgacgggacgtactagtaaaagtcagtaacggaaggcggcggtaggagagggggtttctcgtttagacccgtctggtaagtcgtactggattgcttgggtgtgccacatttagtgggctttctgaaacaaacaccgggttgcaattacggcccatgtaatggagcctacactattcatcctcctcttccttttttttatataactcctctgtcctcggctcaaagatcagaatgtagacaatctcaatcacaattacacccattttccccaccgtttcgaaggcatcccatgctccaattcatgatggcctgggtcatccgtgccaaacctatgacttcatgccaaacaagctttcggtattcgttacaagtcactactcttcttcatccaaaaaatataattaaaaaaatcatctaaacacctgtaagcaaaataaaattatttttaagagcttgttcactttgttgtcaaatcaattttatcaaaatttattatgttttaatgctaccattttttggtaccgttggatatgttcaatttgatgtcttctaaaattttataatgttttttcgagataaaatttttgaaacttctcaattttgttaggatagtattggcaagatcattttaaatttgttaccatactataaatttagtacattcaaagtgaacaatgtctaactccatagacatgtgggccatattctctctccccaagagtcagcttctatgcttaatgcccaatacttttattaggactgctaaaaagatgtctataatgtatagaaaattcacactgtggatgctcttataataaatactcactagtaaggatgcatttatcatgtgtttggtcatagggatatgatgggttgggttggagaaaactagttctttaaagtgtttggatcagggataggtgagatgagatgatcatgattcctgaaaagtaatatttccttcaaa

SEQ ID NO: 18532 - DNA, 1501 bp, Oryza sativa
caacaatcgaatttcccgagttccgcaaagaaatggccatgtctatcctataattgcgagaagggagacagaggtcgaacacctggtggacattggtgtagccgaactcctcggtgatgagggggaccaccttctggtcgtatacagccttgaggcggtgcaccttctgtgcctcggtggggtcgacgaggacgatgcccgaaggcgaggtcggcggcggcgccggcttgggtggcgcgtcggccgcggcggaggcggcgacgcggagggctcggcgaggaggcggggagcggaggaggaggcggacgttacgggaggaggaggcggtggtggtgacggggaagggggccggcgaggacggcagggtcacagccgtggccgccattggagcgtgcgcggagacggaggtgggagctgaggagggagctttatgccatggatggattacgggataaggcgagttggctgtggctggctgccgttgctgtccagtgtcgcaggtgggctttctcgtcatggttcggcccatcgaactgttcgacatggtttcaggccttaggcccatcaaaaccgttgatttgggccttaggcccatcaaaaccgttgagttgggggtgaactaaacacggcctaagagaagggtaaagttacatgagtcaacaactgcaagtctgcagtgtgtgaatttcgatatatgccttgttttggtcaaccggtaacagtgtttgagtatgtggcccattctgtattttctaatgcactacaggacatcactagtatagtagtagtatgccattaaacgatgacttcaaacataaaaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaaggtcccagatcacaacattgcgcttgccctaccttgttctaccaaggaccagcaatgccacgaccgtgatcctgtgaggatcgacttgacaccaagagtagaaacacaacggacaatatcttccttgtcagtttgcaacctaatcctgataaactacattaacctccttgacctcaagaagtaactgtcagtctgtgaccttgtcacttgtcagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggta

SEQ ID NO: 18533 - DNA, 1501 bp, Oryza sativa
aagatggtgatgaggaagaatctgctaacgataatgaactaatagacgccaatgtgaatactgtgaaagaaatgtgcgtggatgttaaacaaaaacataaaaccaaggtcaagaaactttgcaaaacaattcttcgtcaggtatggttgtttaattatcatactctctgtatgtggcttcatgtgttgtgccgtaatcacaacgtttatttacttgtattattcccaggccccagcacaatctatgaaattgaaggaacttaaggtagctgttgaagcacattcagagtctatgttctccaacttctcttgtaggcgtgaagctctattgttcttaaagaggaaggtacgggttttctttttcatttggcagaggctttgcgatctttctctctttcgttatggagtaattagggagcacctactatagaaggtatggtatgtagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcagaggcgctctacttttagaacatgttttttgcacattgattttgttattatctgaaaccggtgccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcgcatagtcagcttcgttcacagcggtaggcggcggcccggcgtcttgaggcgatgcgcattggtcgggggaattcgggataagcagcgaagt

SEQ ID NO: 18534 - DNA, 1501 bp, Oryza sativa
acctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcagaggcgctctacttttagaacatgttttttgcacattgattttgttattatctgaaaccggtgccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcgcatagtcagcttcgttcacagcggtaggcggcggcccggcgtcttgaggcgatgcgcattggtcgggggaattcgggataagcagcgaagtcattcatggtcgcgccagcgacgccgaggccgtcgcggatcctgccgcgagcgtcgcactcccactcccagccggccgccgtcggcctcgcgtccgaccgcgccgccgccgccaccgtctcctcccgccgccgccgcaacttcgtcttcgtcgtcaacccctccggtactcccccctcctccaccccgctacccttaccccctatcctatgcgcgctctcaacgcccttcacgtcgtcgcaggcgccaatggccgcacgggcaaccagtggaagcagctgctcccgcacctccgcacccgcttcgctgaccaatgcgatgtaagactttcgatttctcttagatccctggatcgtagcatcctgaaccggaagctgcaattgctgtatgagaccatatttgggatcagatccccatgctaatttgggggctctacggaatgttctgatttgttggtattgcgtgatcagatttgtgagtgcatcacctcggccccgttcgacgccatagatatcacgagggaggtgtgtatgggcttcctatagctgccagtatccaattgttaatttccccttttggttttcttgttacaatgtgtgtatg

SEQ ID NO: 18535 - DNA, 537 bp, Oryza sativa
cacttcttagttcattcttctattgatgttccaagtgtttttctctttgtagttgtagatacctactccctccgttttttaatagatgacatcgttaacttttgaacgtatgtttgaccattcatcttatttaaaaattttatgcaaatgtataagatataaatcatgcttaaagtactttgagtgacaaaacaactcacaacataataaattataattacgtaaatttttttaataagacgaatagacaaacgtgtgataaaaagtcaacggcgtaatttattaaaaaacggaggttgtatatcacaaatatttagatatagtcccgcagcaacacgcaggtatcatatactccctccattccaaaatgtttgacgccattgacttttttttaaaatgtttgaccgttcgtcttattcaaaaaatttaagtaattattaattcctatcatttgatttattgagaaatatacttttatgtatacatatagacttacacatttcacaaaagtttttgaataagacgaatagtcaaaca

SEQ ID NO: 18536 - DNA, 481 bp, Oryza sativa
ataatgaatgcagtagaatacaagagcatgtctctgattaagaaactgcctaatgcacaataaatttaatattagttatctagtttcctttgatgaccgtttggaggcccataaaaaaccaatctagtaccggatgtaacactatgaatctgtatatgtatatatatatatatgtatatatatatatatatatgtatatatatatatatatgtctaggttcatagtactagaatatatcacatccgattttaaattcgttttttataggacggagggagtatatatttagacatagcctaaatgcacactaaaaaataatcggtaacttcctttgaatattttaggggtcagctatatttgggaattataggcgaatttcgtacattttaccctttttatcctctagaccaacatttcactttttttggtgacttttggtgtggatccttgctaatatgaaaaaaaaaatctgtgtaaaca

SEQ ID NO: 18537 - DNA, 191 bp, Oryza sativa
ctatagggcgaattcgagctcggtacctgtttcggatttgccgtatatcgactccgagcaagtttcgcactttggcggttttcgaccattacttccgggctttaaataccaaccggtacccttgagaaaatttaaaacggtccttttcgttttcaccggttgaaccaaagttggccttttttttttccagg

SEQ ID NO: 18538 - DNA, 390 bp, Oryza sativa
aaacaaagggagtatataatactctttcttcattttttggaagaatgttggggctattctggttggtattaattattcagtggttcaccaattgttaaatactatacaggctataccgtctttagattaaagttgatgcatctatatgaattgcctaccaattgtttttcatacattttagaggaattgccagatatatgaaccttttgctagcttcctataagtggaatattcaataatcaaactcagataaaacctacagtgaacatgacatagcaacccaatatttattgcataaattatgccaagttactcttaacatcttgttaggtagcaattgggttaacatatctctgcactactggtatttgcatggctttccttggaaga

SEQ ID NO: 18539 - DNA, 272 bp, Oryza sativa
attacgaccttctcccacaagaagtgggtgaggtatgatccaattgccattcttcaatggagacgacggatggaaccaatggcaaacgtgctagtgagcccttagtagagatggacgactatagcaagttgccatgctcagaggcggaacggcggtgcaacatctagtagcaccgacaccggcattcgttggcatcaagccgtgaccggcatccgacaatcatagctccatgttacgtgtcgacgaaactcggctcggcatacaggctggta

SEQ ID NO: 18540 - DNA, 1501 bp, Oryza sativa
catagtccataccctcaccttgagtcaccgagtattggccggcgtgagggggcaacagggaggagcagacgaccatcggtggctcagatgaaacccgatgcactcggtccacctccccaccgcacgctgcttggatttgaccaaaacggctggtaagcccctaagagaattatcacaacgccaatagtcggattcctgctatattcggaaaaggaaattaatctattaaaaaaagcttatccagaagtgaccgagtacaagaagaatacggcatgacaagttatctattaattaggaatagtttgttagtttccttttatctttaggaaagtgtgtttagtgtactataaggactttatgttttctttttatcttttagggaagtttctttcttgtcctacaaggactagaatctcctcatgggtataaatatgtacacccggggtcactgtaaaacatctctcgatcaataatactactattggcacatcgccaccctcttttctgaggtttttacttatcaaccggcggaatctggcacgtggtgcggggctgcatcggtacagtttgatctccggtgaaggggtaagccctacgttccaccagccctagtaaatctattggctacattggtgttgttcaaggctgcatcgcttcgatctcgtggatcgctctggtttggttgatatatttgcctacctgatatctcaattctatatgtagttgcattgtgtttaaagacgcatcggtttagtggggactgtctcggttaggtccgatcttctgtcttagccgatatatctctacaatcacaatgttgttataaatagacctgttatatccatcacattatacatatctatcggctcattgagtattagatcatcatatataatctcatgctgcatcggttaggtccgacctactagattgttgctgataatataaatcttgatgagccgataggttcatactagtattttatcaatcagaagttttggcggatacattgcaaaatttgatcaaattgacagttgatgagttaattgttcaaagacgtcagcttggggggcagattgcagaacaataacaatattggctcggggggtaaacatatcagtatcgacatgatgaggcatatcaacaatatcggtcagagggaattcaaatacatcggtatggagaagatttggccgatagaattgcaaagataatagaggagtggtttggaatcaaacctaaggaacatacttctgtgtatcggctaccatatcctgagtggtttgatagggtttcattgccacatcgatacaaggttccagatttctccaagttttcagggtaggatgatacatctacaatggaacacattagccgattcttagcataatgtggggaggtatcggctgaagaagctctaaaagttagatttgttccattgtctttggctggatcggctttcacatggttttcatctctaccatcacattctatcatagga

SEQ ID NO: 18541 - DNA, 1501 bp, Oryza sativa
ccgttggtcaaaaatcaaatcccacatcacaactttaaatcgatctatctccatccaattttaaagcccgtctagagaacatctaaccattatataaccgtatacgtatctcatgatgcaagattttgacctatattcgtaaacatcatcttgctaatttatctctgtccggactcgagatgtgcccatgtcgaaatccctcgccattgacaaaaccctggaaggaaaaacaacacgatctgtaggtgtatatacaaacggcaaaggttagaaaaatctagaaccctggaattcaccttcgatgaattgtgcatttgtgttgttgcatacatctaggcgacggcttatgacaggtcatggagttaacattcgatgaattgtactatacttgtgcagcatctaggcggtagaagatagtgtcgcagtggaagaaataattaattttaatggaaagaggaagccaaacacaaagattaatgaaaattatgcatgcatctttgtatggtcgagagacgtcctgttgagtagagatagaagctaaggtcagattgatctccatgattagctgattcgtatgaaagcattggaggtcggcagtttaaactgggggcagaaaagctgggatgcatggatgtaccatccatcgaattaagatatacgtctttttcttacccatgcatggaggagtaattaaattaggtactataaggcaggtaacattgtaatattagtgaactcttggaaggacaggtttggacttcggacaaagtctcgaaccttcattattttattacaatagaaagaatttattcattattgttcgagatgaaacgatgaatacgaacatcaaagtatagttcaatttgattgctattttttattactatatataattttttttgacatctagatatctctgcctataatctgacttgtacattttagatgtcgagatgttgaaccacagaggaaattatgtttgcagctaggaagatccatccatggttgttgcccctactattgatacatgaattccgttgatttatattgtttgtggtgtggtcaatctctgtttttctattgtttgagttacaatatttatcaaatgggaggaaagaacaaaactgagcgtgagcctctaatcctctttgatgaaaatataaatatcatgaattcccctttgttaacaaccaaatttggtaaattatgaaccaggttcagcattggaatcgaagtggattcggcaaagcattagctgaagtctacatcggctgagatggattggacagaggacagccgatacaaccgattttattgagatggttataaaaccgtttctgcaatcgatcaacgtgctacgaaaggattgccacgatggagataagctctcagataggcaattgtatctattaattaggatatttcaagtggttttcttagagatatgattgggcaaaagtctactgtaaagacttatgtgtatcttagagtttgttagaga

SEQ ID NO: 18542 - DNA, 1501 bp, Oryza sativa
gtatgagaccatatttgggatcagatccccatgctaatttgggggctctacggaatgttctgatttgttggtattgcgtgatcagatttgtgagtgcatcacctcggccccgttcgacgccatagatatcacgagggaggtgtgtatgggcttcctatagctgccagtatccaattgttaatttccccttttggttttcttgttacaatgtgtgtatgatgatgatgatgtaggctgtaaaggatggggctgatgccgtgattgctgttggtggtgatggaacacttcatgaggtattatttgtgttgacttttgcaatatggatacaacctttgtactaaatttgtccagaaacttgatattcaaatacggtaatatttgtggatggaatgtgcaggtcgtcaatggcttcttctgtaagggaagtcctgtccatgctcttgatcaaggacctgatcattccacagcgcttggtgtgagtgtacttagtttctagctattctatccaatcagatcacccttctagcctcttaaattaagcattagactattctgaactgaaatgtttgtttatgcactggaatttgttcggtagtgaagcggattgtttttctctgacagctcattccacttggaactggttcagactttgcaaggacatttggctggtatatttctccagcataatctacatatggtgtttagataacctctactttcactgatgtttctttcttttgtgcaaccaggacaaatgatcctcatgaggcgattgatcgaattgtgagaggttccttctttgattcttcttttatagtgtgtgctgtcagtccatactcgtggtctcatagtggtcattcatctcctggtatatgtatatgaatgcacagtaacattattaaagtaccagttgtcatatgactagccaggtgattgggtttgtcttaaaagatttgaaataaagtttttggaagcataacaatgaaattgctattataaactggccatcttcatgaaaatatacaaaaactagatttatgtctactacgaattcgcaatcataacatatgaggctcacaggtgcatatttttgcaggagtcaaatcaaaactagatataggtatgatggaaggcccagatggaaacccacattattttgttaatgttgctgatatccatttgtaagtcaagcatggctcatttgacctgtgaaattcaatggatggtttgaaaaggaaaaaattgctctgcacctgcaggagtgctaaggcgggttatttttcttctatgtacaagagatttggcaacttatgctatgtttttggagcgctcagagccttttggggacatagtaatcgagatcttagaataaaggtttgcatcgcactggttttagaaggaagcttagttgcaatcttactgatttttttcgtcattatcagtcccacacctcttgaatttactagtgcatataataggtaaatggtggagaatggaaaac

SEQ ID NO: 18543 - DNA, 1501 bp, Oryza sativa
tcaaccaatagatcatacttcctccgtattagccattaaactgatgagtatcggtaaagaagttataaaatctcattacaatgcgtgggatgcgcgatatagtcattactatattttaactcagtgttgtggaagattaagggcggttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggccaaagcgctctctctctctctctctctctctctctctctgcttcatcagctccccgtggcggcgatggcggctcagaggaggctgctcgccgaggcacctccgcaccagccgcacccctcgcggcaccagcagggcgcgccgtcgt

SEQ ID NO: 18544 - DNA, 1501 bp, Oryza sativa
cttgttacagtttctttctgttaaccagataataatgttttcttgtatgtccccaattattatcattccttctcacacaaaaattgtgccttttgtatttctgtaattttgtcataaaatgctaccactttgtatattacaaggaaataaccattatcatggtttcttattagtcaatggcatgtttccgagaacaagaaaggattaatcaatactctttctgagaacaggaaaggattaatcaataccaacttctttttgtaattttatagaaattgttggttttccttagcagtggctggtgatgaatttcactgcatcatattttatttgctttcagacaagatatgatggcaattgttccacatgaaatctgctaacacatgcatatttggtatgtacttctatcctgattatatggctttacctgcccttttcaatgccttctacggagtgtcgcctattaaaatcagtaattgacaagccacatggcatgctcatagtttttttgggttaaataacttgaagcatttcagcgtagaagctgggtaaagtatgggacaagtatgtcgctgatcatctccacttaaggcgagaaacatttttcttcatttgtttcaggaattgtaaatgttcttaggtttagaggtgagatccatgtgcatgctatctaactgatgctctctggtttaccaaatttgtggacttctatgtattgaatgatacccttacaggttgtatttgaaaggtcaaaataattgatgcatcaccatgtttcttgccctattcattctatttgagaacatatttatatattactactgccggcatatacaagttacaatttacaagttgttacctttactggaaggcatatacaagttactatatccctttttttttgaccaaaaacagcaggagaaactccttctgtcctatattaatatatatataaagaacaatatttacatgagagaactacaagattagaatatacaaaaacttatgctagagtttggcatttattctttctactcgttgaatcaagagagtatcttcaagtaatcctagctctgaatacttcaaattatcacttatcattgtagctgagatatattttcttactttagttacttcttgctttaaattatctatacaaacaacaccttcgtgaatatggtttaatgcactccaacgagtttaacacttcctttagctctataattatgtgcagatttttttagtttaaattcaccttttagagactattcttgtgattgaaattttttggatacttattttttcctcaagttcattgagtgtggtctaggcatacatggttgcatcattttgccatggattttatcacttgagaatatgcatgctagaattaggcttcttatctttcaggttttttctagggttaatttaagattagaactggcatgtacctttatatgtaaagaattttgttttttcacctcaaaccctctatggtgtg

SEQ ID NO: 18545 - DNA, 1501 bp, Oryza sativa
tttcctttcgatatagatgaggctgacagtgcaaacaacaatgagctgtagtacaagttgtaagcatttcctttttacatactgacaattgtactaacagatatcatgatatactaatgatattgctacatttgacaactgttaaagcctttgctctcatccaggaagctggctttggaacccaacacctctaagcggaaatgtgcacgcatatcagagctggctaatagtaagcatatctctataattaaaggatgctagagaatttaagattaatagctgagctatctattcccataataggagagtaactaaggatcacataaatctcagtcagtaacagtccattgtaggcactatgtcatgctctcctaagcgtgctacattgtaattcatctgtcatcctatgaacagccaatcattatctttattattcttaaggtttttgtttagaactcaacttataaaaatgctgatgtgcctttaaaaaatagcttagttagtcataggatcatgttgttctatataatgaagggaaaaaagagaggtatgccgtttttagtttcctcagtgtgaaaatagtttatttaaccaaaccactttattactgatgtttataactatcccattttattacctttcttcagtgctgcgtgcagtttgtgactttactcagaaacacaaggccgcaaccaagtcgctaaagtgattaattaagtgcatcgctattttggcctggttagtgcattttgtaagtttgccagctaaactgtacatttccagaggtagaatactatcatataggtgcgattattatatacttgtattgtgctatatacgtcctggcatcaatatatatgctatctacctatattatcattgtgctgctaatggacacatctttattttaaggcattcttcttgttacaacctgtttgatcatattgccaataccgtaaatgtgcatatgatgttcttggcaggaaatgccccgtaccttttacaatgcttttgcttgtaacataacaaattatttgatcttatttagaatctatagtcagttatatggaaaaacatgagtgttcgatcattatgtgcactatttgtttcaattttttatcattatgtctcatcagtatctggagattgttcttttcgtttggagaaatcttgagattgttcttaacacctagaatttatttatggttgttctacctgttcactatacaatgggtgcttaactatacttttcagttttctcatagctttgatcatgcatgttaatatctatactgaaagaacatctaatctactatgcttaacatcttaagacaaaattaatatgttcaagttacttgtgagatctgctttcaaccttttattcaaagaaggccttaggcttaagtttatataagatttcctaaatgttgcacttagcttgtcaaagcttaatgacctcgtgttattagttaaaactgcatgaatacctttttgttcatca

SEQ ID NO: 18546 - DNA, 1501 bp, Oryza sativa
aacaaaaggacaaaaaagagaagaagagcttctagattccaacgctacgtatccaaccgcgatcgcttcgtcaaatccgcgcgcgcgtcgtgtcgcgtacgcgcccacgcccactcccacgccttcgcgcgcgcgcgcgcgcgtcgtcgtctccctcaccactcgccccgatcgatcgatcgatcgagtcgtcgtcgtcgacccgttttctctcctcttctcgatcgttatatcgcgaccagtacgcgctactacttctcactctttgccgctcgtttcgctcggagtagccatgctccaggcgagctcggagttgcagcagcagccggcggcggcggcggcggcggccgggatgtgggtgcccgggatgagcccgcaggcggtggacgccgggctgtcggcgagggcgcaggagatcgcgcggaggcgggaggagatgctcgggatgctgcatgacctccccgagtccgagtacgagctctcgctcacggacctcgtcgagaaggccggcggtgtcggcgtggcgccgccttcgccttcgccgtcggaggggaaggcagagccgggcccggcgcggacggcgtccggcaggcagtcggagcagcagcagcaggcggcggcggcggcggggaggccggagaggagggggtcggcgaggcggtgggacagcgcgggcggcagcagcttccgcagcagcagcgacggcgtcctgctcaacttctacatgccacgctccttcacccgcagcttcaccgcgccgcgcaccactggccccggccggccgccgtcggtctccggcggccggaccgccagtgtctgctccgatcgcaacaagaggtaatcaatcaattctgactccaactaacactccatctctatgttctccatcagtttgattgcaaattaaggagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatc

SEQ ID NO: 18547 - DNA, 1501 bp, Oryza sativa
tcagtcagtctaggtccaactaatttgtgttcacctcctgacatttctagggatatgtaagatattgaagatggaaattgctaccgcctacaaggtgctcgaaatcatgacctctggcatttaaaatgtgtgaaagactgtggttctaaactttatttttgttttccgtgtaactacattgttgtgtttattcattgtgccatagctagaagctagaccggaacaactatggtagtatcaggctttttttttatcttagtgaattcatgaaaatatatttatctatagttctatccagttttcgatgatcgttcttcaagggttttttttagcagaagtgccatggaagctaatttagctaaacttgttgcataagttaataacaccattgaatctttcatttgccaaccttttatagacctgaattttggaaactaattagaaagtagacacgagctataatgagcgcgccacttggcgtgctaattttctagtgtatgttggatgtagcgtttgttctgatatgtagttgatttctattgccttcatctgaggaaaattcgttcaagctgatgcctgatatatgatgagctgtaggtgctttgagatgattttgtatgcgccttgttagctttcctcgtgacaatgctttaggctgtgtttagttctaggggtgtaaaattttggcaagtcacatcagatatatggacacacatttggagtattaaacgtagtctaataacaaaaataattatagaattcgcatgtaaaccgcgagacgaatttattaagcctaattaaactatcattagcaaatgtttactgtagcaccatattatcaaatcatggcgcaattaggtttaaaagattcgtctcgcaatttacacgcaatccgtataattaattattttttcgtttatatttggcactctatacatgtgtccaaacattcgatatgatagggtataaaatttttgctagggaactaaacagagccttaggcgcattgtatccaaacattgcagatagaatcttgaacccatgctacttttgagccggatttcagatacattaagaaagtctccaatcgacaatacaaggcatggcggtcttctccgtgggttgtgaaatctggtgatggactgatgcgtaacagtggcagccatcacgtgtccaatactttcctgaatagcttttggtaattacttgtcagctcaaccagtagttctgttctaaccatgtgtgcgtatgtgtgttgtattttgctcttcgtactagctaccttgatcagggttggccagttagcaaagtatgacaccaagatctactgcagacagactttggtcgacactttcgtagcctgtttaggaatgtagaaactttgcaagattttggtaggattagttcattttccattaagttcaggctttaacttgtatacggatataattgaaaatcatcattttagcatcttattatggcacatatttattagaacaca

SEQ ID NO: 18548 - DNA, 1501 bp, Oryza sativa
tactccctggattctagggagcttcgacacgaggaaatctgcaaaggacaatggctaacagcagttcacactgccgtcgaagagtcgaaggcttccccatggggaatacgagcatcaaacgtgcaaggataaaaatcaaaacttactacagtgttgaaggtcaggtttagcaagacaacacgtacaatcatacactctgtgcccacaaggttcctgtactacaaaagcgaaaattgaatactttaggcagaaaaagagagttggcaacaaaccaaaccaagcaacaagaacgagtcagtccatttttctgtccccagcggcctaatctagccaccgagtaactccatcttcttcactcgcagctgcaaggatctcgatacagacgtccaatacagcctacagaacatgcaaacagtaggaagctgagtacattagcttaagtgcttgcacatgggataggacacaatgtgactgtttcatttcgtggttggacgcatagtgtgctactgttttatacagaaaaagagcagtaacctacttaaacaacgttattgaagagggggcaaggggggaggagatgcatgaaataatagaaatcctctttttagaagcaaatggaaaagttcataccgatgaatttctgcaattgataagtttgcaaccctccaacaaggacccctccagcatccagctctcccaaacatcaaatgtatgacttgcaaacacaaactccatcctcctattaatcttcagcacatttaaaaaagttaaatgttagaacattagcaaccctgggtgtcgataagaaatcaaaacacttctgtttctcaacccattttactactggaaatggaaaagttgcactagtagccctataaatgttgcgcatttgagcaatcaaacttattacttttggttgggtgtatctgcttgtacagtgcaacttgtacaagtagaggtataaaacctaagcattaaatagaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaag

SEQ ID NO: 18549 - DNA, 1501 bp, Oryza sativa
ttttattgctaaaagtactctaaacatcgcttatatcttatgtatttagaaaaaaagtttaaataaaacgaatggttaaacctgtatacaaaagtaaactgcgtcatttattaaaaaaggaaggaggtgctttctaaaaagaacaatcttacagaaaagaaaataaatacggaccagctaaatatgttttagcagcccgccagtattcatggagtgcaacatcctacctgtataactatagccttgaatcttgatgtgaaaatggatgttctggccttacttagtttcaaattttttcttcaaattttcaacttttctatcacatcaaaacttttctacacatataaacttccaactttttcatcacatcgttctaatttcaactaaacttctaattttagcgtgaactaaacacaccctctgttcagaagagaaaacaggagttttgggacttagtaatgtctttccaacgccagcgccagcgtcaccatctttcttttccgatcacacggtcatcactcggtcaggttctcgtcttgcaaatccgctcgtctgctagctcacattcggtcaggctcctgccgttggaaaacgacacgacccaacgttccaacaagggggcagcagagtcgctccagttgggctgggagtctctgagcaaggcaaatcagtcttagctaactaaccagcagagacgtcaagcaattggtctcatctctttcagtttcataccaatctgttatcccccaaaaaacaagaagtttcataccaatcgagacgttttgtttgatgtcgcaacaatagtagcccggctcatgttctcccctgttggatgtttgcacatgaacatgctctgcttagcgatgccttggggagttgggatttttggcgatgtgggtttcgtacaccggcaggtgacgggtcgtgtccacccgatcgtataccgtcaccagcacgtccgcgtgccgatcgtgtccaccgaaacaacaacaactactactactactgtagcccaagtcgcagtcgcagccgcagcaggccatcgaccaccactacgccggtggcccaagtgatagtatttaggacgctttcgtcgcattgcattgcccgctcgcccctctgcttttgctgctgttgcgttgcgtgatacgctcgcctaactttggctaattctgctgatatttgctcttcttctgtcatatcaccttgccgctgcttctgatcatctcccgttcttgcattcttcttcttcttcttcttctccggcgtggtgtgctgctgacggctgacgctggctggtcgtggacatgtcgaaggtgaggctctgtcttttgctcttggattctcatcctgattactgtagtagcttctgtgggataaaatgatctctgcttctgaatccagtaaaatatacatgttgtttttgtccgttacacattgcgagcgttcgtataccatggtggtgcgtaaactaacactgatgtttcacatgttcctctgc

SEQ ID NO: 18550 - DNA, 1501 bp, Oryza sativa
atgttcttcgtgtattgatgcatatatactatttcccccgtttctaaatatttgacgccgttgatttttttaatcatgtttgaccgttcgtcttattccaaaacttttataaaatatataaaattatatgtatacataaaagtatatttaacaatgaattaaatgattaaaaaagaattaataattacttaaattttttgaataagatgaacggttaaacatgttcaaaaacgtcaacggcgtcaaatatttagggactgagggagtagtatagcctgaaccaaatcatccactaataccctaccatgaaataattaagagtgtttttatatatggtcctcaccgggagtttctagtataaaatttgttacttggatcaaatattaataccttagatatgaggaggtacgtagtcgttacctcctcaaatatcataaaatttctaaataatcatacaagtttaatttgagtagctagtttgttcatttttgggaatagtactaaatattgcgcccactgattcgatcgccgtctcgtagatgatacatcaattcatcgatcggttgccatgtcaaggtcctaccatgtcctcttgtgcttgcaaatgttttttggaaacgaatcttgtttagccatcgacctcccgttacaacgacatgtgttgttgttgcccgcgcgcgtttcttctgacaattcgatccatggcaggtgtccaactggttcatcaatgcgagggttcggctgtggaagccaatggtggaggagatgtacgtcgaggagatgaagggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctc

SEQ ID NO: 18551 - DNA, 1501 bp, Oryza sativa
gggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctcgcgcgcggccggcgctgcggcgtgcattggttgggcaaccgaattaagcgtttttgttggtggtggtccttgattttaccgacctataggtacagttcgtatatatctctcgcgatcgatcgtacaccagcaggggagtagcccagtagatcgtcgtcgatggcgctttcgtgtggttcggaagcgggcagtttattttagcctaccggcccggcatcggttgccgggggttgtgtggtcgtgtgttgtgtagtggagacagcttttatttgtactggaaatctggaatttgattgatggttcaacttaggccgccgtgactgcgctggaactgggactgcacgctatttgtatgcggcaacagcaacagtgctgcgacaggtccgcttcaaataagccacaaactactccaacctaactaatgatttaacggtgtaagaatgacttgtgtttaaaaaaacaaaaaaaaggggctatctgtttatttaggtttacaattttcgattcacaagtaagctagaccataaactgagagacagatatgtcccgtaagcatgctagccacatgacccaaattatctaatttggattcagcaaaacaaattacaccccctctgattcgtaagaaaaatataaaaaattatggattttatttctatagaaaaatcctaatgagttttttttaaaacaaaaatgttagacactatactttcacttgaaattcgaacgaaatagacaatccaaaaattttaaggaaagttagcaagagttttaacctcttgaaa

SEQ ID NO: 18552 - DNA, 207 bp, Oryza sativa
agaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaa

SEQ ID NO: 18553 - DNA, 356 bp, Oryza sativa
tgttgaaaagttcatgtgtctaaaacagcttgcatttaaaattttgcacatgtatatatatatatgaaatggtacgtggaaagcgacaattaattaattcattagttaaatcatagcagaaaatatatattaagcctagcagccaatgttgatttaggagatagctcaatatatagagtcctacgcattttccacgttcatattgattttaataaatctaaaatatatatcaatatgaatgtggaaaatgctagaatgacttacattgtgaaacggagggagtacctagctatcgccattttgcctgcggaggcagataaaattattaagttgatcgtctgtattttcttttaaga

SEQ ID NO: 18554 - DNA, 1501 bp, Oryza sativa
atatatggcttgttatatatgtatgcatgcatgcatctcgatttgaatataggatgtgattgtatgcgttcataagtgtaatttcacgcgttatgtataataaataattaacaaaaattgctatactaatataatattttttttttgagaaatatggtcttccaaaaccctgtcacctcccaatttatatataatcagtggtgaactggtacttaccaccggtatgttttaatgcacatcgtaataagaaaacaattatacgtacagacagtataacaaagacaatttagctaggagaaattgacatggtagtttgaatgttgtttttatgagaaatgagactattaaatatttatttgtggagtgttactatgcaaaatttctttggagagctctacagtttactactagtttttatagtttatatgctcctcatagtatatctcatattttttagaattgctttgtgggggttgataaaaaatctaccaaacttattcttgttagagcatctgctatatgttgggctatatggttgtgtagaaatgatatggtttttgataaatcaccatctatgtcctataatcctatatgcatattcttttcagggcaacatactggccccggttctgagctcaactgctaaagtgtgatgaagaaatcaagtcagtgaaagttatatgtcgtaattttgattcaatagttatgcagttgctcgctaactttggatggagattcacaaatagaatttaataatttttgtgatcttgttatgctgtgtgagttttttttagtttgtgtgtccttttgtttattcaggtgtgagtttttggtgaattggtgtaataattaattggctgtagctctttgagcaaaggtcgggattatattccattattaaaagaaaacatattgtattgtagttgtaaatgtcaaactacagaagagaaatgggggagagagaccccggggggtgacttcacttttttctcggcgaatacgtttatcaccatataattaacgattggtgcatcagctgatttcagattattgactagaaatattaatcatgaatatttctcaagaacacatagcaagtttgagatctttgtatctattcgttagaaaaccagaaacaggcatgtaatggaaggaaatgaggtctttgccccgtgtgttgcagcgggattttaataaaaaaaattatcattaatatgttattattatatcttaattgttgtacgtatttgatactaacatgtggacatttttagccttacactgttctttttttctttcaacaaaaagtgaagagttggttggagtagctaacatttagaccatctagacctacctgtcatttttccccttaaaaaaactaggagttggtagtggggcagtggtatgtagaaccaccaccactactctcttttataagaagcatagtatacaactaccacaaaacaccacatcagtgatgcctccttcattgcgtcatgca

SEQ ID NO: 18555 - DNA, 487 bp, Oryza sativa
gtaccatcgacaactttttaaatttgtcgttgtcatgcatccatgtaccacctgttgatctagctagctaggagtagattgccggccagcttttgaatgcatgcttgtcttagcaaggatgacaaatggttgagaatgatgtatgaactaatcactctccagctgttgcaacttgcaaacaagaagcattagtgaagaatagcgaattagttactaccaagtcataaaaacaactccctctatttcattttatattataagtcattttaacttttctctaatcaaactttatatgtttgaccaattttatagagaaatttagcaatttctacaacatcaaattagttctattacatctatcatcaaatattttgataatatgtttcttttcagttcgaaatgttgttatatttttctataaacattagtacgtatccttccatctgtggcggcctctcacatgcctggttttgccggccatcacagc

SEQ ID NO: 18556 - DNA, 1501 bp, Oryza sativa
gaatattattttgtcataagagaccaaccaacaaatgtcacaagttcataacaatgttggtttatcatatgttttttttctttttaaaatgacgaatgcttgaactgccctttgtaacgcactaaaataattgtcacatcctgataaattcacccaaattaaaaattattcgctaaaaggaataatataataaactaaaatcctaaaagaaaatgctaaacactaaaatacgtgcaagaaaaaatttgaatgtgacccaaagtatctttcataagttctcctcggtctaaaatatgtcctggatgtttacttgaattttctcagagcaccgaaatatttattaagcgataaaaaaaattaacagagtttattaaaaagaaaaactaaaaacaatcctcctttgtcatttgggctgaatccgtcccaaagtctgattctactccccgctagcccgctcggcctcttttctactcccattcccttccctctccccactttctcctcggcccacctcggcccgagtctgcgggcctcctctactcctccatgggccacgccactcaaccagccggccctgcgggcctcctctactccttcatgggccgcgccactcaaccagccggcccagccgccaagctgctccttcccctcctccctccagccagaagtccattttgcctccctcctctcaattaatttcaaaatattaaaaactttgaattgaattttattatactaaataaagttatgtgaaaaagttgccaaaaacaaagttgtataaattattgagatctaccaattttgtattttggttatttctccatctgagtttgattgacctatataaaatttgaatttcaaattatgacaatttcaaacaacattttcaaatactaaatgatttcaactgaaaaagtcgtcaataacaaatttgtattactcatcaatatctataacttttattttggttatttcatcattcgacaaaccgataggaacattgttcataaaatttacatatctcttatatgggtttacataaatttcctcgtggcggcggcggtgggcgtgggcgaggtggagcttgccgtgacgcttgaccaggtgccgtggtggagtgaccccgacaagcgcctttcctctttctcttcccgcaccgccgcgggattcgacaagaccccctcctcctgcctcgtccttcctctcgttcgccgacgacggcacgaccgctagggtcggcagccgtgcactccacctccacctccgctgcgtgctcccctccctgcgtcggcgccctcttcctcctcgccgcggccttcccagcccaccacgtcctctctggcttcatgtaacatcccggcccagggcttaataggattaatagaatactcatatcaacaggttgcaacttcttttccggaagctggtcttcaaagaattatgaggttaagcgtacttggtctggagtaatttgagataggtgacagaccggtaaattctt

SEQ ID NO: 18557 - DNA, 1501 bp, Oryza sativa
ttaagttcaacatgaagaacatggttaagctcatgtagagcatctttatcttttgctttaggcatagaagcttctgcattagattactgaattttttttttatataggtcatctcaccttacctatattgcctttttttacctatagtaattctttaaccttttgtggaataaaattgtgaattgtatgtctaaaattgaatgtaaatatttgtcttgcctattatttgaagtatttttggcgaatgtattcttattatccactaagcctcaatcaaccaagtaggttgatagttctaagtgcattgacgccatattggcatacatgtaaagttgtttacttatacacatgaacaattagaatatttatggttaagcattgaagcttaaatatatccacccgcaaccacattatttcttttagaaaagtcgtaccatgaagttacaacaaatatgtgggtttcacgacaactattttgtaggttttcttacgattggcgtgaaaagggggaggaatatgtgtatttttgcaatttatttcagaatatttgtgataaagaagcataagaaattgtggatatgtggcaggcaaattggtgtgttataggtcaaatgctagaagcaaaaatagcccaaactattagcgaatcttatttgggataattatgaattattgttacacaatgaagtgtgttatttattggccattgaaaattgcatattcatcaaggaagtatgaaattgcatatagctatttgaaagctattggtttacttgtagtatacaatatcctaaataattaatgaccttttggattcgaatgattctgaatgatcaaatgacaccacatttactttggcataatgaataaaagttagacatatcacccaattaatttattggcatattcaagaagaataaatattctcgtaggataaatgtttgggtgatttgaaaagttccatgatggttaaactatgttcatagatcaatattttagagttatagttatgttcttgaagacatcataaagttatataatactaacacatccatcttatgatcatatctatgttgcataaatataaacatgaagtttattgatccaacttaattcaagaattgaatatagtatcagtaattggatcaagtcttgggcaaataaaaagagctagaaaatagagtaattttgtcgactagtggatatttgtttgggcttcattgtcgcagaataataaccctctatgaattgggataacctacagtattagggatgtgcaatttttcatgccattgcattaatttttatgttagctcactgcatataatatatttaccccctttattttatataagtgcgtgttcaatgaatgaacatttccttcatatatcaccaccatagcatacatatatgggcctccacatgaagttggggatacaaatagaccgaattccattaatccagtgcctatgataggggatttttgtgatatgctattaga

SEQ ID NO: 18558 - DNA, 203 bp, Oryza sativa
gtagctcatcacgagatcaccatcacttgatgcaactggaaagatgtaagtgtttttttcctcattctgatacagtagagtttaagtttaatttctgcaaattttctctagtatttagacttttgtttacaatttatgtagggcctaccctcattattttccactcacaacacgcttctcatttccatctctcctcccccagc

SEQ ID NO: 18559 - DNA, 1501 bp, Oryza sativa
aatttatgtaaacccatataagagatatgtaaattttatgaacaatgttcctatcggtttgtcgaatgatgaaataaccaaaataaaagttatagatattgatgagtaatacaaatttgttattgacgactttttcagttgaaatcatttagtatttgaaaatgttgtttgaaattgtcataatttgaaattcaaattttatataggtcaatcaaactcagatggagaaataaccaaaatacaaaattggtagatctcaataatttatacaactttgtttttggcaactttttcacataactttatttagtataataaaattcaattcaaagtttttaatattttgaaattaattgagaggagggaggcaaaatggacttctggctggagggaggaggggaaggagcagcttggcggctgggccggctggttgagtggcgcggcccatgaaggagtagaggaggcccgcagggccggctggttgagtggcgtggcccatggaggagtagaggaggcccgcagactcgggccgaggtgggccgaggagaaagtggggagagggaagggaatgggagtagaaaagaggccgagcgggctagcggggagtagaatcagactttgggacggattcagcccaaatgacaaaggaggattgtttttagtttttctttttaataaactctgttaattttttttatcgcttaataaatatttcggtgctctgagaaaattcaagtaaacatccaggacatattttagaccgaggagaacttatgaaagatactttgggtcacattcaaattttttcttgcacgtattttagtgtttagcattttcttttaggattttagtttattatattattccttttagcgaataatttttaatttgggtgaatttatcaggatgtgacaattattttagtgcgttacaaagggcagttcaagcattcgtcattttaaaaagaaaaaaaacatatgataaaccaacattgttatgaacttgtgacatttgttggttggtctcttatgacaaaataatattcattacaataaaccattagactagtttatgatgatctgtatttgatcttagtgacgacaaccccaattttgtcactaatcatcatcatctgttgatgcgaaaaacacacactggcctgaaaaatctacttaacttctgtgtaggtcctaaatcttgcttttgggtttaaggcgtgccagttaatttgatcctgcaatcaagaagaaagaaagacaagaaaaaaccacagtcaaatccataaatgatagccaaatccataaatgatagccaatcggctagttgccgatgacatatcatttatctttgagccgatgttatgttagaatcgatcgacagtaataaatgaataagataagactaaatctactcgatcggctgtagatattaacgacatataatctttccttcgatgtatatttaaactatatgattgggataggtcggtcgccatgccgag

SEQ ID NO: 18560 - DNA, 457 bp, Oryza sativa
gagaggtattatgaagaagccaatgcgggttttgatcctcgttgggactgtgagtttttcagattttgctggaacgagggtatgaggctgccatctatcgaagattgtcctagatgcagtgatattgcagaaagttcaagccgatctcacaatagaagcaatcggctgaggttgacaagagttcctgttcatcaaagattgggcccagtaaatcaagatcatgatcaagaggacgaggagggcagaaaaactcaatggtgtccttctggtatttttacgaagaatcagaagagaagagttcaaagattgaggaacagagagtgttttcatgaagtggagcaagagattaatcatcggcagaagaagacaaagccaaggcaggagtggcgtgtcaagaaccaagctgctacagccgatgaagcaaaaaggttggctaaagggaagagtgttgtgaccg

SEQ ID NO: 18561 - DNA, 419 bp, Oryza sativa
aaatcttggtcgctcgtttaagtgagatttttcaaaacaagtcagtccagggttttagtaaaactgttgagatttattcgtcagtcagttgggatctgatgggtgaaatgcattaggtcatagcttaggaacatgggttgcaaggtatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatggccggccacccacccaaccaccgcggagaaggcatgatcgactttgtggcggagttggcacgta

SEQ ID NO: 18562 - DNA, 1501 bp, Oryza sativa
agagggcatgcacggcggtcggctgcgcatggccagcagtgatgatgggccttgtgagaggagctagctagcggcaacagcaaaccatgtgggaggagaggatcctctcctctaacaagcggtggagtacttgcccgtcagagttgcccgtcagagatgactatcacctctgacagtcggtcacccgtcaaaggtgactggacacaacaatgaccactgttctttgaccaggcctaaacccatcaaaggtaagggtttatggccatcaaaggtgacctgatccggtgtagtgggagtaaaggactagtgatagaggactggcgagaggagcggcggcgagtccgttcatagggaagagtctgtgtcgtcacgtggagctcagccagcggcgggagggaatgacactggcagctgaaatattttgttgatttggtgttcgttctgttggatgaatcgtttttatcttttggatattgaaattattgatccgttggagaattcttagatctgttcttggtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggtatatttctttcattgatgaatctctattacttacgtattgaatcctgctatccacgcagcatgcatgcatacaggccgatatatttcttaaaagaaaatacagacgatcaacttaataattttatctgcctccgcaggcaaaatggcgatagctagg

SEQ ID NO: 18563 - DNA, 984 bp, Oryza sativa
ttggtgaatatatttataccctgaatactttaatccattttcaaattccttggctacaatttttaactcaactggcttgttaaaacgcttaactctacttctctagatattctgtataacccatttttattctcaaaaaatcccatgcaatatatttgttgaggtcttattgcccttaaagtatctcgttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagacgaggtaattatgcctgttgaagccaaaactatctcttttcctttactagaatttattatttctaataattctttgatatagtcactgttttgtaatatcttattctgccttgtcttatattcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgctaactatggtcttcaatgtgatttaatctacaccttatattcagattatctttggtagtaattacctttccaatattagcttctgaatttgatttctctataatgactggctctgataccactcttgtgactcttgtgactcacttatgataccactcttgtgcttcggacaaaaaacactatttattcggctgaatactattcagtttactgtttattcggctgattactattcaaaaacactattcagtttactgtttaaattactgttcaatactgttcacttcgagagatattttaactttaggatctttgcagg

SEQ ID NO: 18564 - DNA, 1501 bp, Oryza sativa
accaaagcaacgaaaaaggacccatcccatacgtgcaactttaatcaaatttcctcttttctttttatttatttatttcttcttcttcttcttcttcttttttgaatttctcattgaccaagcaagcacatgtgccaaaactgcacctggagaaaagatcaagaatccgaacaaaatgcgccgaaaacaacagtgaaaagaaataaacatttgcagcataaccaattttctgaagaaccaagtaaccaatattcttatgcaccttagcctgcatagcgaaatctggctagcatctagcatgcagctggaaaattcttcctgcttcccctttgcctgctcacctgagacttgttaaccatttgttgcaagctcttttaaacttgtatctttttactcaaatattatacatattacctctgtcctaacatctaaaatattagtgattgatcccatatagttacataggaaaaattcgttatatttttttaaaaaatatattcaaacaatatgataatattgtgtctttcatcatctgtttgttgggtgcaaccaaaatttaaattttgaaacttaatgctagtggctgaatttggcgctttcttttccattcacacatagttttttccctagccttgactagtacagatacaaaatttttacctataaatatttttttcctttgttcattgacataaggtgtaaccagccttaaataataaggcttcaaataattagttagtgcgcgcaaatgtgtaattcaatttattgctagtacaacgaatctggataggtgcaagataatgtaaggtatggtaatgtcataccataacataaattcgtttattttagaatagaggactctctccgttccaaaataaatcaacttctgaaattcaaatttttgtcccaaaataaatcaacatctaccttcttatctactctcggttcgcaaatcaaaaaattttattccttcaataccccttatctatctacccaccaatactaatttactaataataagggttatttggtcatttatcctctcctttaattttgcattgggatgctaagatttgtcttttttgggacagagggtgtagtccatagaaggattagaatccttctccttatattcctttgcaacactatatcaatgtctcactctccccgtactccaatgtcttacaagcatcagtttggtagcctcgcggccgtagtaaatttaatatacatatataggatcatctgactagatgaaattcattgtgccgctaatggtgatcatcatcaagcgctacatcctcctagctctcatcctctccattcaatgtggtaattatgcatcaagaattcaatctagctacaaaatgcatactaatatatacatgtatgatttgattttgtacttgctcatatatatgtatgatttcgtctaatttggtccaattaatctagttaattaccttgtttaattatcttttgtgtgcattgtaggtggagc

SEQ ID NO: 18565 - DNA, 934 bp, Oryza sativa
gtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtggcttggaatatctttttaagttgcttctaaaaagacagataggtgaggcatacggtgagtaccgagtaggactttatatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttttgtccgaagcacaagagtggtatcataagtgagtcacaagagtcacaagagtggtatcagagccagtcattatagagaaatcaaattcagaagctaatattggaaaggtaattactaccaaagataatctgaatataaggtgtagattaaatcacattgaagaccatagttagcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaatataagacaaggcagaataagatattacaaaacagtgactatatcaaagaattattagaaataataaattctagtaaaggaaaagagatagttttggcttcaacaggcataattacctcgtctcaagctattaattcagaaaaa

SEQ ID NO: 18566 - DNA, 1501 bp, Oryza sativa
acttgatatccgaataaatattcgtaaccaatagtgtgtgtatctattttggtacgtatttgttccatatttttgcccgacattatacgagtttgtatccgtatttgacactatccttgtccgacccgattccgattataaaatgtgggttaggatatgaaaaggttgagatctgaccgaactcgatccgttttcacccctgcttattaatggataaacctttgcaaattgggtgaagtatacctgctagaatcgagaattcaacaatatatgatttacttatctaacaatctttataagttatacaccctatggtaacaaatattgtttgatttttttaaaaaaacttaataaatgcaggaaaaactaatttaatattttcgaggatacgtatatatgcaccggcgctctgagggtgtgtttgaggagaaaaaaagagaatattaagaaaaaaatagtgagtcattagcgtatgattaattaattacgtattaattatttctaactgaaaaacagataaatatgacttttgaaacaatttttctatagatttttcttaataaaaacacaacagtttcttctctttgtttttaaaaaacatggtgagacttccttttttttaaaaaaaataaataaaagttttcctctccttgtgttgctgccgaacgcagcataataattgttaatatatatatatattaagcgtcatataggagtttttatgtttcattagtacacaaacatttaaggtcaaagctgattaattatgacttaaaaactatactagctagctagtaaaaaaagcttaattattactcccttcattttttttctttgacgttggttagctcaaaaatacatttgtacaaggaggtagtactaacaaatactttctccgtattttaatatatgacgccgttgactttttattaacgatacggagggagtaatataattcaaggtctctctcctcacctctgttacaaagcgaggcggcaggacaaggagaccggcgaggcttcgagctagctagcagttggcggtggccgctttcccccccggatagaatatcacccggtgcgcgcgctttctacgccgagacctagagagagaaaggagaaagagagagaaacaaagcacctaaagcaacaaagagaggtgtagagagagagagagatgagaacatatcatcaagaaaagaagctaagagagatcaagtgatgtggtcgtcgccgtagcagcagtacagcttctctaccaacaccgtagtcctttctctcctcctccccctcccctcctcgttccgcgtgccgcgagaggatcgaaccctattcctttgttcttgaatctcttccaaatctgtaacagagagagagagagagggaggagatctagtgagtctagagagagagagaggttcttaagaggaggaggaaagctagctaggagaatagaatgttcccttcttcttctccttctccttctccttcctcctccaaga

SEQ ID NO: 18567 - DNA, 1501 bp, Oryza sativa
catttcatcatctggagtctgattacacctttcatctctgatcgaattgtctgcgaactaattgcgaatggcgtgcatgcatgcatgagctgtaatttgctagccattttactttggttatcagagagatctgaattacttgctagctacctattatagaacatacttcacatccgttacaacatataagcattcacctagccagaaatgcttatattttgatattttgaaatagatggagtatcagttcctagtactgctgatttgcaaaatgtccaaaattattagttacgtgtacttcatattcatacatgcgagtataggttgaagaaatgctgctgccagcgctatgctcgacgattgatagtttttttatttcctctatgacctatgataataattaccataaaatttacaccaagttgttaagatgaaaattacgatctttactacaacagcatttcgtggattggatttcacatatcatcaacgcaccacggatgaagccatgtagatatgtaggtcctgtttagagaagcttctaacaaatgcggtctctcttggaatctattctcacccagattctgataatgtagttatagaatgaaaaataaaagaaaataagtcaagagcgcaaccaactgtttcttagaatgttaactctcagaaacatagccgtaatatgcggttgtgggcctggacagtttggaagagcttctgattctgggagaagatacaactggtagaagcttcccaaaactatctagcttttcatcgaattatgagaagctatagttatagaatctataaaatgagtcttagggcctgtttgggggagctcctaactgctactagcatccttctagaatcagaagctcccccaaacagcccagctgtcggaccagattctaagaagctgtagttatagaatccagaaaatgaactagaaattagaagctggaaaacccagcctttctaaattttcaaaagctggttaccaaccagctgcttctcagaattttaagctccctcaaacagactataagctacccaaaagaccctgtgcaacagtgcagggttggacgaaaagcatagcatgaccaaattgggccatatacgcgggcaaggcccagatatttcttggtcatggttttctggcccaggccgagaattcagggtcggcccttacatctccgtagcacgcagcctagtgcggtagacggtttaagcgctcagaaatcaccaattttttgtcataaaaaacaaaaaagaaaaaaaatagaaacacctcgtcggcgtttagaaaggcggttggggttcggcggcggcggcggaggccggtgagtatccgcggccgcgcgaaccagtcgcctgagctcccagaagcatccggcgctgcggctcctccgtgatttgtgtatttttccccttgaatcccgcgccgtcgcggccgccgtgtgctcttgccgccggcgagaaggggggaaaacgcccgcggaga

SEQ ID NO: 18568 - DNA, 1501 bp, Oryza sativa
ttacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccatgtatgtatatacatgtatgtatatatatacatgtatatatatatgtatatatatatgtatatgtatatatatacatgtatatatatatatgtatatgtatatatacatatatatatatatacatatatatgccataagtgtggctctgataccacacttatgcttcggacaaaaaacactgttcaaaaacactatttattcggctgaatactattcagtttactgtttattcggctgattaatattcaaaaacactattcagtttactgtttaaattactgttcaatactgttcacttcgagagatattttaactttaggatctttgcagg

SEQ ID NO: 18569 - DNA, 1501 bp, Oryza sativa
gttttcagaaatccatgataagagagttgatcacttgctggttttcttgtgggctatgatatcggccgacggccaagtatctaataaaagattcttgatcagggccatgtggagtgatcataaaaccttcttcttcagtggcacttattgggcaggacattattaccagattaggttttgttggaaacatttccattacttgctaactgaaggagcactccctgcagagagctggccttgagcacaaaattccatctattgctagactaccccaaatataaaaatgaggcaggaatcagatcaaccccatggtcaattcaaaatatgaccagtcgatatagcaccttaagaacttaaaatattaacaaaaagggtaggggagttgcaatcagcgttgtttggatggcccaggaattgaagggctgagatcatagcagatctcatactagagcacccaagtaaacatctcccaaaagaaatgtacatgtttatcagtgattttatttatctaattagcataccaatacaaaggaaaagaagtgcacagactaaagaaaacctcacttttctcaaaatagaaaaaataaaccacaaaatcttcctggggctaagtgagatcttacaacagtgtatgggagttttctatttgtatagctctgaaacttcacgagcaaacttgtccatgaattggcatttcttgtcaaaaccccagcctggattgttctgcaaaagatataaggagaaacaagaacgaattcatctcaataagcagcaccttgtgtttcttcaaaggaaggtgaaacaaataggaatacataaacacactgaacagggtctccagacttctttttgtaatatgaatacaggtaaaaagttctaatggctatgaaaatattttatcaaacaagatgatgacaaccagtatggtaaattttgcacatgtgatgataacagaatctccaacatgtagagtacttcagtcaggtgaactagccaacttaaagcatgtgcacttcgccatctttgagagcaataggataagaaactatcaaatatatcatctcagatggcaagtgatgataaacacagacatgttatagaactagcttagtaagaccagaccacagggcatgtcagactacagagggactttatgccttgatggttggaacgaaccattaaattgtagatacattgcattaaaaaaagctaaattgatcatttgtgtagctagaattcaaatttcaaatgctaattgaatacagctctatttttgaaagcaagcttagaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaaaccttaa

SEQ ID NO: 18570 - DNA, 230 bp, Oryza sativa
ctcatcaccttgcttattattgcatatttacccatacttttgaacattacttgtgtttttacccctattttgtagataaaacctacaattattttgaactgagattttgtgagataatttatatctgagctgaacttgaacaaaattttgacacatgcaatttcatccaaaacgaggtcagaacaacatttattttataagcgaaaatagggagcagcacccctcaacca

SEQ ID NO: 18571 - DNA, 341 bp, Oryza sativa
aatcatctccaaaaccacttcgtaaataaattctaaataacaaaaccaataatctccgatgccaattattcatcacagaataataatcaaaaacacctttgattttacaaaaaccagtacacaaatagctagcctgtgaaattagatcgataatcttctaaaataaggtgaaaaaacatcatctacgtctcctctgcattgtataagaaatattaattggaatgtattagatcgttgctacagttttattaaaaatatataatttcaattttagaacattgcccacaaaattgcttggaaaaatttgtttagacagtctctttgtactctatttttttaga

SEQ ID NO: 18572 - DNA, 251 bp, Oryza sativa
gtatgtaaggattcgtccgtccttacctaaattttttcatccgcaacatcctgagtccaacactggccgtgccaaagaggcaagccgagcggatggagctagcgaacaaggctgagggttgaaaagaaatgaatgggactttcagcctaaaaccaaggagtattcaactaaaaaaaccaagcaagctagataatgtatatcaatttcaaaatatttttactcgttgcaacgcacgggcatttttttctagt

SEQ ID NO: 18573 - DNA, 359 bp, Oryza sativa
aatttatccagattcatagtattagaatatgttttatccaaccaaaatcccttaaattttgggatggagggagtattatttccaaccactataggagaatatattcagtcccacttttacactggaaccaatgctagcacactagagaggaagaaagaagatctactcaaaaagcttctaggtgctatattttaggacatatggagtggcacatatatgatgtaacaaacttagcttctctacactagacaggacctaaactaccaattcatcgacatatttaaaagtaactgatgtaaaacaagttcttccttggaagatttgctgagctgaagatactcaatgtttttccccttagc

SEQ ID NO: 18574 - DNA, 598 bp, Oryza sativa
ttttaaatgctgtttactgcaaaacttaacccctatattattatccccttgtactcccttgcattaattatgcatctccggtgtggcttgctgagtactgtggttgtactcattcttgctctatctctctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacgctagtatcaccatcctttggagtcaaagtccacctgaggatgcggttgcggtagatatgaaaaggcttgagtccctctgtggtcccaagtcacattttacaagtcacatttttcgtccatttgagtttattttttgtatggttggttcttgtgtgctcctaagcgtgaaaaaaaaacaaaagaaaaaaaa

SEQ ID NO: 18575 - DNA, 243 bp, Oryza sativa
tgtattgattgaatcaatccctttattacaatgatttggggcttatatttataccccgagtacaaaacctgtccattatggacgtgattcaaaactttgctaaagataaaatttgaacaagtccacatggctgactattaccatatctctaattcaaaccggtataaatatcctaattaatagataaaattaccttaaattagctcaatctctatacgacaatatcagttattccaatctagg

SEQ ID NO: 18576 - DNA, 518 bp, Oryza sativa
gtattcatgtatagactatgttttcctttttttattctgaattttaattagctttatattgtattcctatatggcctcagtctcttttttaatatttcttattttctaattccgaatttaaactatttttaaattgtatttctatatggactctattttttctttttctccgattaatgtgagaatttctaggctatgagagcgaacgtggagggttctttttctattcctttgataagttaatagatagattaacttcatttctgattatgaaactaaacaaacttttgtccatcctaaaatgtactagcaacatagtatttaattagatatcacctagtgctataaatctcaactaacgaaataagtattaacatcaagctaagtaccagtgactttatattttaggagaaagctgttgtatttctcccagtgagttgcaagcatggcgcggttggaagatatggtggaggcaaggttgagtgttctaagaggagtccaatcgagaacgaatcaga

SEQ ID NO: 18577 - DNA, 183 bp, Oryza sativa
ttccaagtcttaagtatgataatcaatgtttagcatatatgctccccctcaagaagagatccgttgaaacttccatgttccaatatcataaccacatttttattaatgtgtaaaataatgaaaataaaattaccacaatgtttaatctttcgtttacttatttcataagttctactatgaaca

SEQ ID NO: 18578 - DNA, 347 bp, Oryza sativa
actgatgttcttgttgcaaacaaaaaagacataacattttagtcttctagtaaaccagaaggaccagaaacggaaaaaaaaagaattcagtttattagtttagaaattcgaactctgatagaatgatattttctaattcatgaaatccaaaaaaatgtacttgacatacaagtcaagattcttgatttttgaaggggtgatacctgttctggaacgaagggggaaaaagggattcattatggcaacagcccacataacttatttctagattctgttatttttcattcctcttcattaggtatatatgatgatatggctgtttttttgtcttacaacacaaggtgaga

SEQ ID NO: 18579 - DNA, 1501 bp, Oryza sativa
gcgcctgtggttgtcgccctagtcttccgctgtttcccgtttgtctttgtgtgtgctgggccttcgccgcccatgtaataaattaactatttacgcttccgcttgttaaactctgaattgtatcaacttttggtgtaccttgcctcctgggacaaggaataatgcacgcacgtaaggaatgcccgttgggttatttccggtcgtgacagttcgaccatgattggatattgctctaggatgacaacagtcttggggtggtcctcttctgagaattctatcttctgctcagaccacttcatcttgggcgcagccccctgccacgtcgaacagacttcacgttccaccttcttgtattctcgttttgagtagtatgccgtggaaccaacgaagatgtgcgagacatggagatcggagtctgggtatgctgagtccgattcctaagtaaccgcctcagcgtccttctcgaccacacgtactcgcttgcctttttccaatgccatgtgttttgcgagtgattttttgaagacgaggcaatcttctagagagtgtctgtctgacttgtgtatagggcaccatattttcttcgtgtcgctgccttgtgggtctgggcgcttgggagggtccgcgtattctgttgcgagaacatccgcttgagctttccttttcccactcttgccatttttcttcttgcttgactcaggtgcgtccttgactggtttcttctcccctccggtcttcggtttgttgttcttgcgtctcagtgcatcgtccgcgtgagcgcatggatcgacaatttcgaataatctctgagtagtcgtgatacgcctcgttgccagctcctgggtagtatagcgatctctgacaccggacttgaaggcgcggattacagaagcgtcggtgatctcggggattgtattcctgcactcattaaagcgccgaacataatccctcaaggattcaaccgggttctgtgttaacgcatgtaggtcgtctttgattgcgtggcgcttgtaagtttcttggaagttggcgacgaactgttgccacaggtccgcccacgaagaaatcgagtagggggaagatgcatcagctatgaacgcgcagagcctttcaatgcggttggcaagtaatttgccaatgcgttgtcgtctgctccggcagcgtagagtaccgtggagtaaacctgaaggaatttttctgggtcggtactcccatcgtatttctctattgctgctggtcggaatctttcaggccatcggacatcccgaagtgaacgaccgaaagctctacacccagcgctgggggcagtgggttgtcggcgatcgtacgtccttcgtggatgcctatctgatgatgaggatgaggaggatgacgacgatgacgatgtgtcgcttggttccggcgtacgattacgaggacgtcggccgggttctcgagaatcctgtcgtcgtctcccgttgttgtctcggcgccgatctccatcattgtcgtcattagggtg

SEQ ID NO: 18580 - DNA, 1501 bp, Oryza sativa
gtcaacggcgtcaaatattttgggatggaggtagtagtatactatcactttttgcaagtcttcctaaaatgtcaatagatagtgaatacggagcagtacaaacccaaacccaacgagcacgcgtgaccgtcaacccactcgtgtccactgaagaatcggtcagtctcgactctaacctgccgtgctttgcccggttgcactaataacaggagaccaaacccgatcaagactcagccgaccaagttaattaccaaagcgaccctttttaccagaaaaaaaacaacatttttcacctattgtttctgatgaaatccacacaattcctgcaatatgcccatccagaagaacagactaggaagtgtgttgatcttttcccttctaccatacgcatagaattgcagaacactgctgctggatctcctctctctctcagacaagagttgtctttgaagcaagcaatgcaagtacgtactgtgtcctcaacaagaaattgaaagttcagagacggattttagttgggcatgatgtgtccattaaggtaagcaatcacccacataacaccccctcaaataatatagtttcagaacaagtgcagtgttacatctgaagaaatatcgtatcactacaaggcatatattccatatggacaatatgatcgaacttgtgaaccatcagacatgcaaaattaattaattatttttcccttgtttttccttgtttttgctgcaattacaagtaagcattcttgatgtgagcccgccccggcgtgtagcagcagttctgatagatacctgcatcctggaaaaaaaatgtttttctatcatcagagaacaggtcagggtcatgttgacctcatcttgtagatattactccaactcttaacatcatgaaagcatcatcaattaataatccccaagtgaatttcatctcaaaacagtctcaattccaaaatttccagttcatcagtttgtcaaaaaaaaattgtcgctttcgcgctcctactctatataccaccccatctgctagtagttggatgctgcctcacacctctcctcctctcaccttctcttctacgtcacaaaagttgacacctttgcccctctcgaaccaaacggatttcagtacaacccaagcaatccaatcccatttattttttcctctcaaaagatcacaattttttcatcttcttctcgtgatatcctttgttttttttcatccatccatccattcccctttgcacggttgagctcgtctcacagttgttaattaacagcaagaacatttttttccttaaatttctatttaatttatactacttgcgagcgagagccacctaatcttggtgcccaccaagcataagcttcatcatcttcttcttctttgaagtcgtcttcttccctcctcctctcgtcgcctcttggaaagagagagagagagagagagagagagagagagagaggtgatcgagttgcagcaatggcgaggagggcgccatggctcg

SEQ ID NO: 18581 - DNA, 1501 bp, Oryza sativa
ttctttccatcctccattttcttgggcaccgtgcgagcttagctctgcactgtttgcctcagttgggttggtttggtttggttgcttcttctctgcttcaacggttggtcgacttcaatgcaagaaagcatcggcagcaattgctcctcccgttgagtttttcgtcgtcgtttgaaagcgaaggagacggcgacggcgacgaggaggaggaggagggattaatgtcgtccatggcctccaacgaaggtattcttctcttctctctcaaatattctgtttctcgcatacaagtttgctcctcttttttctttcttcttctgctctcttctctcttcttcttctgtccgtcttggggaagagagagagagagagagagagagagagagaaattcagaagaagaaattgttggtgatgacgaaactgaaggagtatttggtgattgaatctgcagaggtcggtaatgaagatgggaggcaggaggatctgcttgttaaggaaggttagctgtggtgattttgattattttttttactgcttaatttcctcatctctttgctgcatgtgtggcacaattagtgcttgtctgtatcttctctttctttcttgctttagtctaagtgctccattagtcctggaaaaatcatggcttttttttccaggcatgctcacagctttgaagctctaacatgtcattttctaagagggcaacaagagattaaaaaaaagagagatgtcagctgctggattctggtcttctttgtaacttttaaatatgctattaggttgggcaggcttccattccctatcatcatatagaagatgggtagattgtcaagttcttccaatttttctcaccaaaccaaaatctttgaaatcgacatttatgttgatttaagcaccctcttgatgatctttcgcaaattgcaagcaaatcacagagatgcacaggttattttcagacttagttgtgtgtctgtctgtgtgtgatagatagaaagaaagcatcaattttggaagggtgcagagggtggtgcgcatgtcaattcttggtgcaaatctctgaattatagaaatgcctcagatactgtcgactggcagcatgtggttttcatgggaaacgagacaaacacaagcctctccccccttatcatccactgtcaagggatctgagagcctgtgtttgtgtgtgtgatgatgatgtgtttcttgccttgacttgctttgcactttgtttgtcttgatgtttgtagtagtaggtagttaatttgtcttcttgataaaattcagttttgtagcataacaaacctatgataatagcccatgctatgtctacatctcctttgctgtgttcagggccaggggagcaccaagaaaacaccatcagagattccgacgaagcgaaaaatgaggattgcagcaatagcgggtcagtaaccgaagccgtcgtatcaagcgaagaacccagtgacaggagcagcactgaagaacccagtgacagga

SEQ ID NO: 18582 - DNA, 1501 bp, Oryza sativa
gtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggttatatttctttcattgatgaatctctattacttacgtattgaatctcgtatttaattctatacaataatattgcttaatttatttttcttcccttgaaagtttcataattttgtgatatggaatacatttggccaaactacaactgataatttaattttatttctagtccattattttagtttatgaatcatttcaatttctcttgtggtttgttcttttttattttttaactgggaatcaaactttatttaattggcgtaattgtgttatgtctctactttcatattcatatgtgatttttatccctattttcagggtttatgattttgcccattcttttttttaaaaaaaaacaaagctttagcttgcacctggtatattagtatatatgttaagtcacgttgacggtgataagtctgtggcattcaccattgaatattattgtatgtttacctctacttttggtcatcactcacatgggtctgccccttatacccttaaatctaggcttcttggttcaattgaattaagagatcagcgaactatgttcaaaatagcatcaacaatggccaaagttatctactctttcagaagcaaacaagatggcaatcataaataattcccaatgtggtgctaataaattaaccaaatcttatctagctgttgctacta

SEQ ID NO: 18583 - DNA, 1501 bp, Oryza sativa
aattgtgtggatttcatcagaaacaataggtgaaaaatgttgttttttttctggtaaaaagggtcgctttggtaattaacttggtcggctgagtcttgatcgggtttggtctcctgttattagtgcaaccgggcaaagcacggcaggttagagtcgagactgaccgattcttcagtggacacgagtgggttgacggtcacgcgtgctcgttgggtttgggtttgtactgctccgtattcactatctattgacattttaggaagacttgcaaaaagtgatagtatactactacctccatcccaaaatatttgacgccgttgacttttttaaaaatatttgaccgttcgtcttattcaaaaaatttaagtaattgttaattcttttcctatcatttgatttattgttaaatatatttttatgtatacatatagttttacacattttacaaaagtttttgaataagacgaacggtcaaacatatttaaaaaagtcaacggcgtcaaacatttagggaaggagggagtagttgctgagttgagttaggaactccacctccacatacggaaaacaaatattattattaacacatgattaattaaatgttagtctaataaatttaaaaaaatggattaatatgatttttaaaacaactttcttataaaaaaacttgtgaaaaaaaaacatatcatttagcaggttgaataaacgtgtgggcggaaaaaaaagtgtgttgggaaagaaggacgaccatagccttaaaggagattttcttccttctttctcaacttatctccctcgttttctatgcgcgtgcttttcaaactgctaagcagtgtaatttttttttaaaaaaagttatatacggaagttgctttagaaaatcatattaatctatttttaatgtaagccagctctcttgcacactgctatttctaaaagtctggtctcattctaaatgttaggatttgagtttaagattaatttttagtggattttttcggcgctcttaaaaaaattctacctaaacttattctcaacaatcacatttaaaaatgttagcatttgagaaaaagcattgtcaagcgacgccaatgttctaggtatgattccttataatgatcgaatggtagatttttagatatttttttaagaatggttctaacttcgaaatttaattttaggtctagaatgaaattttgaagttacctaaacgcagctatgcctatctaatttattttgtgagagctcttcagccaactccattctatttttgagtgaagtttggttaagcttatgatctaagagtgatggagctgaagataaagccgtgcaaaacgggcctaaatatgtcttaaaaaatactacaatgaaacgtcttattaaaaaataaaataaaattttgtaatatatttttccaatttttgcaatgaaacgtggagggcaatatccacacgagccacgcatcatccagcaaccaaccaaccactactaccactggcta

SEQ ID NO: 18584 - DNA, 1461 bp, Oryza sativa
ccattagcacatgattaattaagtatctgctattttttttaaaaaaatggactaatatgatttttttaagtaactttcgtatagaaactttttacaaaaaaatgcaccgtttagtagtttgaaaagcgtgctaacggaaaacgaggagtaatagcctgaaaagaacgcagcctaagaagggtcttacttcggtagacatttcctttgatgcctttcccgttgtcaatttatctataaacatatttgagctgctaacttgtgggtcctaacccctatgtactagtacaccgctatagggccttgtctccatttgccagtcacacaatggatgatatctttgtaatgtgcacgtgcttgtagtatatattagtgagcaaaattttcctatacatagcagagatatgcatatagagttcaatgatctaaaaacttaccttctttttagtatattgtttccatttgctattagtatggacttgaccttgcatatacttctctgggttggcttgatttaagctattgcaatttagatgaagacttgtcagatctgtatgtgtatttcagacttatcatggttattaaacccaatgagtcatagaacttcacttaaatggttgtaaagttttgttctttaacaagtcaaatatcttttttattctaatttcccaactcttgaacaaagctgtgaattgaattaatcaagagatatgcacttttctagcattagcgacatggacatatatgccttcttctattctttcttccttttgtttcattagcaaaatgaatgggcctcatcattgtgcagtcaatacctcaatgagataatgttccttgttaccccatattagcatctgttttaggacatgttcagtttgattttctttttgttcatcgtatattaatatttacaatttttacgatctgcactaatctttggactcgtcagctaatcaccactgtgaaaattggcatgcatatatttgttttttcggtttttgccagtcctaatagtgtatcatccatgatagatgttacatctgatgaagttgcaatttgtaacaatgatggtgaaaatgctaagcttgctaatatctccacaacaaaggtacattaagctaatttctgatcatttttatttttcatgagaaatgcttccgataaagcactatatattgaagttaataaggaaatttcattttattcattcaggactcttcatcatcggctgctggaaatgattcaagtggcttcaaatggttaggtcctgaatcgcattccaaaaaaagggaagagctacaaatccttctggcgaaggggatttacattcatggtacgcttatcaatcatcagcgcatttttaaaaaaaatcttagaggactgaatcttaggcttacaccaattgtgttcatgacactttttaggttcacgattttgtttacatcttggtccaacatggca

SEQ ID NO: 18585 - DNA, 1501 bp, Oryza sativa
tcatggtgaaaaaatcaaaagggtgctcatggggtatccatgggtcttgtgggtgcagggggacttaagccccccgcacccacgttgaatctgcccctgagcgcggccatgctttttatataaattaagcaataatgtggtttacatgtgtttttttttctggggttttcgactgaccaagcaaagccctgtaccatcataatcatccagaacctatgcactcccggcaaatagcagcgctgggaaaatatggaaaagcacccaattaatatatatatccaacaagaaagaaaaatggttttaaaacttagtgaattttagggctgttacacccaatattaacatttgttttgatacctctcttcttagatacctgtgctttctttgtaaaaaaaaagccaatctaaaaaggaatatatatgacctctttctagtataatgaatctggattattagagtaatgaactcatgatccttgtttcccaccctaggctgaatctagacatcgttatcctagtttgagacattttgcacaactgcgaagatgcatgtcatgcacgtcaaagtaaatacaaattaaacccccttaaccaggttctaacacgaaagtcaatacaatgcaaacaaccaaattggtggtgttattgccctcataattaaacttcatttgcaaattaataacatgaatgattttgagcagatagaactgttaaaaaaataaactatgggataaggtgaagaacaacgagtgcacctcaagtagtgagtgcatcacaggagcctggaggacatgttgattgtaattggccattgccccctaaattaattatgactgcctttttgtagaaaaaaaggtgtaatgtggacctaatatatggctggctacaggtatatagcaaaagaaagatgacgagatgggaactaatcggccggttgataaacacacacgtcattctaattcagttgctgaaatgttgaaatgttgaaatgttgcttcagatgtgtgtatgagaaggaagcatctcacgtacatggctcttagatagaaaccattatagtttataaattagtatgaatagtttattgaacttggttgcactcataaagcgagcatgaaggagagcgacgaaagaagcccaaggaacagagcggttatcgttcctgactagcaagtgatcttctagtaaaccaatcttttttactgcacatagcttgataatagggcctgtttagatcccacctcaaaattttacaccatgtcacatcgaacatttgaacaccggcatggagtattaaatataggctaaaaaaactaattatacaaattgcgactaatctgcgagacgaatcttttaagcttaattgctccatgatttgataatgtggtgctacagtaaacatttgctaatgacaaattaattagccttaaaattcgtctcatggtttactgacgaattctgtaattagtttttttattagtccccgaacacactatatgaca

SEQ ID NO: 18586 - DNA, 1501 bp, Oryza sativa
aagttaagggacctcatatgaacttattcctcttccggaacgtacttggcccatttaagaaaactacaactgcgagagatctaatgccatggatgttgtcccagaaaagattttttttttttacaatgcataatcgaatctaggtggtcatgtcaagcttgaatcatactcgaaattacggtgttgaatgcaactattattacttttattcggcgagatacgatctgtgcgtaaaccagacaaatgccaaagatcttaaatgggctggggtgagagagggtttcattgtgtatcatctttctatgtttatacttagggtgtgtttagataatgtgaaatggggagtgggattgagattgtgaaatgaatgaagggttatgattaaatagaagatagataataaatagttaggatttaaagatgtcttttggtgggtggaaaatcatttcgctatctcattagccaaacattgtcttattgtttatcttagttcgaccagaacaacatgaggctgtccctagaactaagtagctataaagataataaaaatgaagtcttggagagagacaagctgctccatggtctgaggtgaatgaattggggtggacatttcttttgcattgctggatcagttatattttcctctgcagcaatacagcacatatatttgcagtttttttctcagaaaaataatagcggcaatatcttgatatgatcctgtacttgtaacttgtgctcgatagaggattactgaaatcatgtgcatttcctattgttttttatggtgaacttactgcagttgacaatggtttgtcctgaaagggaaatgcaagcgacaatacacaagttagtttcaactaagccaagcttttatgtagtagttttgaaggcaaacgcaacgctttcttgaccatactctgctctactgtggcatactaaaaatactaatgtaactatgtaatttgaaaatgttgttttagttcacactaactacttcctccgtttcacaatgtaaatcattatagcattttccacatttatattgatattaataaatctaaatagatatatatgtctagattcattaatatcaatataaatgtgagaaatgttagaatgacttacattgagtagctcatttttgccatccctaactagcatgattagcaggccaaccacatcatctgtcaaacaaaactagcaaacttaactttgagcttgaattttaaaagatagatcttgaactttgatttgtattcctacgagagaaaacaccctccaaaactgtgcgtacagtagtgtcaaacaaaactaacaaatttagctttggaaattgagtctaatctaaagagataattttttccaagagaaaacaccctccaaaaataaaagtatgctgctatttgtggcgcgtacacggtattctttagtaaaaggtataagaatagttcgcttttgtgctcaccacgcagctgcttgagttttcaactagtagcttcct

SEQ ID NO: 18587 - DNA, 1501 bp, Oryza sativa
tgatttggataaataatttaaaagaaaaaataatttaaagtagtttttgcatgctgacgtcagcatgacatgggcgtccgattttcccaccttggatcgggcgcctgacgtgtagttgcctccttttttttttagctttctttggtccattttaatacaatataacactacctatttggtgattcttgcatacacaactaactctggaaattacatttgtgtcgcattgatgctttccttttactttgattttattaattgggagatgaatgtatatttaagacgataaaagctccaacaataatgcatcaaaaccatttctagtccaataaatgcttccttcctactacattaatcaatctatgcaagtccaggacaataaattatgctataaggtgtgccatggatggataattaatgtaaatcctgctaattaatgtagcacttcattgaaagaaaatctgccagatatatatgagatatgatattattcaaggtaggcacgcaccaattctttgaagcaacattaaagccaactcttctactacttatatgagttcccaggatcaacatgttgcttgaaccagccgtcagtgaaatggaagtacacaactattcttgcaaaatgctgcaagatttgtgccttatgctgtctatatttgtgggctttttaaatcatttagctctatcatcatcctattacgcgtacccagatgttggcccaattagaggccaagcttcaacaaaaggattgaaagaaatctcatatgtaagttcactttatctcaatccatatcatgcttttcaacctcatttcttcccttatcgtagtgaagcatatgaatgttatggatcagttgcatgttcttgtatacatattcttgggtcacttctttttttatcttttctctctaaacatgatgtttctgtttaattaccaaagcgtacagtttcttatgacaatgaaatataattgattttttttcttaaattatgagtgttgataaataataattgttaaactgatatgagttgatatgacgatggaaaggttgaattttgagtcggtgatgaggggacgtttttagttaaaagttgggaagttgagttttatctttttaatatattgttcctattcaaactcgtgaatttgcagctgaactggaaaagggaatgaaaaatccatatgtactttttaaattacagagatgatttacatctcctgcctctatcattaggcacacaaccatgcattgggaggatccattcatatttattctttatgttaagatgtctatatgttcaagtagtgaaaatgccactagaataacatatatatgtatattattttttcctagcacgcgttacatcgttcaacagatgcccctgaaaatggatatagcggcgccatggcaactctggatgtttataattttccatatttgaagaaaatggaagtaagtgctgctattgttagagtttcaaattaccaagacgaagc

SEQ ID NO: 18588 - DNA, 627 bp, Oryza sativa
aagttcaattgttgctgcctctggagctcctggacgtgttgggcaagcattcataatgtaacaggagagccctggagctcaggtacttccccccaaatttttcattgctaatttcaatagagtcaactgtcgaggcaagctgttcccataatttgccggtttcaatgaggattaaatgtcttttattgacattaaagtttcgtaaaaattgaaccctattattagaaattcatatgcaacttaaattgacattgagcacaaaaattctagtcttcaatgcaacctcttttatgaacagaacaccttgggaaaaacactctcattggatgcttttaaagggaagaaaactccacacaaataattgttcacttaggtgcctaaaaattttgtcccctgagtgcttttaccattttatgttagtttggtccaagtgcaaaatttgttccttaaagtatccttgttgtactgcaaacatttattctactacttaaatttgaggttcttttctctttgaaggcttttgtaacaattaattggaatgaacgtttggagcgttgattgcaggtcgtagaacgtttggaacactgtaacatggaatgaagaagctatgatgttttagaaaacata

SEQ ID NO: 18589 - DNA, 1501 bp, Oryza sativa
ttcatgctataataggcaccctggctgccttgtagtgctgcactaggaagccaaatggtgactatggggtgtttagatccaggggtgtaaagttttggcgtgtcacattggatattatatagggtgtcatatagtgtgttcggggactaataaaaaaactaattacagaattcgtcagtaaaccatgagacgaattttaaggctaattaatttgtcattagcaaatgtttactgtagcaccacattatcaaatcatggagcaattaagcttaaaagattcgtctcgcagattagtcgcaatttgtataattagtttttttagcctatatttaatactccatgccggtgttcaaatgttcgatgtgacatggtgtaaaattttgaggtgggatctaaacaggccctattatcaagctatgtgcagtaaaaaagattggtttactagaagatcacttgctagtcaggaacgataaccgctctgttccttgggcttctttcgtcgctctccttcatgctcgctttatgagtgcaaccaagttcaataaactattcatactaatttataaactataatggtttctatctaagagccatgtacgtgagatgcttccttctcatacacacatctgaagcaacatttcaacatttcaacatttcagcaactgaattagaatgacgtgtgtgtttatcaaccggccgattagttcccatctcgtcatctttcttttgctatatacctgtagccagccatatattaggtccacattacacctttttttctacaaaaaggcagtcataattaatttagggggcaatggccaattacaatcaacatgtcctccaggctcctgtgatgcactcactacttgaggtgcactcgttgttcttcaccttatcccatagtttatttttttaacagttctatctgctcaaaatcattcatgttattaatttgcaaatgaagtttaattatgagggcaataacaccaccaatttggttgtttgcattgtattgactttcgtgttagaacctggttaagggggtttaatttgtatttactttgacgtgcatgacatgcatcttcgcagttgtgcaaaatgtctcaaactaggataacgatgtctagattcagcctagggtgggaaacaaggatcatgagttcattactctaataatccagattcattatactagaaagaggtcatatatattcctttttagattggctttttttttacaaagaaagcacaggtatctaagaagagaggtatcaaaacaaatgttaatattgggtgtaacagccctaaaattcactaagttttaaaaccatttttctttcttgttggatatatatattaattgggtgcttttccatattttcccagcgctgctatttgccgggagtgcataggttctggatgattatgatggtacagggctttgcttggtcagtcgaaaaccccagaaaaaaaaacacatgtaaaccacattattgcttaa

SEQ ID NO: 18590 - DNA, 1501 bp, Oryza sativa
aaattgggagaaaatgaccacatcccaatatccaattctaaagataagatctagggtgggcagaaaaagaccgaaccgaaaagactaagactgataaattcggtcattaattcagtcgtaggcagtgaaagattgaattttgttcggtcaattcggttagtctcctcggttaaccgaaaagaccgaattaaaaaaaaatctaaatgcaacctacaatatactaagttcaataggattaaactctaattttcacatcctacttcttttagacatacaactaataagagtatttactcatacgtgcttatgattttttttgtgattttcgtgttgaaaatttccattatttctttgcatttatgaaaatgttgctgtatttcggtcaggacctagaccgagaccgaatttgtcggtgctgacattttttgttgaaattcagtttcacttttcaaagaccgaaatggaaaaaaacgaagatcaaaaccaaaattttcggttagaccaaatggccacccctatataagatgggtggttggcaccttgttaacgtagaatgtggttggcctgcagcaggatgaccatcccatagctgtactgcggccacggcccatctgttccaaaaaaaaaacataaatttacgagtcgacgcaggctattagtagcaattcagcatctaatatgcaagaattcacacacactttacggattgtgaagaatttgagcgggtgtgagctgcagaaatgaaaagggggaaaaatccaagaaacaatggcggaagctagcaaagaaatggagggaaggatggattcaccggctgttctgccggccggccaccgcccttcctctccgcgaataaaatttggacatatattgagggattcaaagtggacttagattgcgtttgttctcctgagctaggaaccaaatcctcgaaaacggagcggttcattaacgtgtgattaattaagtattagcttttttttcaaaaatagatcattatgattttttaagcaactttcgtatagaaagtttttgtaaaaaaacgcaccgtttagcagtttgaaaagcgtgcacacggaacatgagcgagaggggttgggaaacatatgaaagaacacatgtgttcgccatttgatgttcccattcgaaaaaagtactcacggaaaatagagcggtccattagcacgtgattaattaagtattagctattttttttcgaaaatagattaatttgattttttaagcaactttcatatttttttttaaaaaaaaacgcatcgtttaacaatttgaaaagcgtgcgcacggaaaacgaggaaaagggatgggaaagaggcgccaaacacacccctataagagaaagtataatagtaggctgtaagtcgactaaatgctaagggcccctttgatttgtaggaaaaatgtaggaattttggaggatttcaatcctatggaaaaaaatcctatgaaggcctttgagacaaaggattgaatcctatcc

SEQ ID NO: 18591 - DNA, 283 bp, Oryza sativa
aaccaccatgtacttgtacttaactatagagctcaaataaacatcaaattagtactactgtccaatggatgattatataattgttgcaatgctattgaaactgttacatgaactaattagagtgtttttgtcatcaattcttgaacagggtagtacaacaagcttgtgttggagtattatcctcagcaaactgcatggaaaactgatggatggtgtaccagaatcaacaacaaactccattggaactttccattctagcattatagaatatgaaattgagaac

SEQ ID NO: 18592 - DNA, 1501 bp, Oryza sativa
tataaacaagaatatcatcaatgaagataagaactcctttgcatagcaaggggggtaaaatagtgttcatcaatccttggaaggtggctggggctccggtcaagtcataagacatcacacggaattcatagtggccattgtgagttttaaatgttgtcttatgctcgtcttcgggtctcatacggatttgatgatagcctgcccgcaaatccaagctagagaacagacttgagccagccaattcatcaagaagttcatcaataatgggcaaaggatagcgattcttgactgtaatagtgttaagatgtcggtaatcgatgcagaatcaccaagtaaggtccttcttcagcaccaataagacaggagacgaaaaggggctagaactgggctgaatgacaccctgttttcagcatctcggccacttgtttctcgatctcgtctttttgggcaggattgtatcggtaagggcgcaaattcaccggctgtgctcctggtgtcaaaggaatagcatgatcaaattcacgagctggaggcaaaccagaaggctcatcaaacacagaagcaaaatcctgcaatacttgagcaatgactgatggaacaaccggtcatagagtctcctgttcaataaggcagagttccactgtttgtaataccgagtgatggtgcaataaccccttcacctgagaggccgacattccagcacaatgagagacgtctgagcgaacaccccgaagacacaccctctgctgattatactgaaactgcaaggttttttccctccaatcgacttgcatagggccgtgagattccagccaatccattcccaagatggcgtcataagttccaagaggcagaatcttcaagttggaatgaaaagagattccctgaacccaccaaatgcagtcgaccaattcctgagtgcgttgcaaaagaccaccatcggccactcgtaccttgacagcaacaaacccttgatggcgtcctgacagttgggccgccatatcctcagagatgaaactatgagtactaccagaatccacgagcatgagtacctcatgttgctgcacccatccttgcaaccgcaatgttcccgttgtttccaaacccagcacagcttcccttgagatctgacaaagctcactgtcagcagattgcacaggttcagatgactcagcttcaggttcaatatccgagtccatgatgtgatcatccagcatctcccaaagctcttcaagcacatgcaattgcactgtcggcccacacttatgatcccgactccacttttctccacacgtatggcacagccccttcgctcggcggtaagcacgaagagctgccaatttttcatccactgccggcgtttgcagttcctccatctgccggcgatcatcaacacggggacccggccccgctcctggtcgcggatgaacaggaacactaggtttcgcaccaggacgcccattgctagagaaatccacctggcgtgcctccctccagttgg

SEQ ID NO: 18593 - DNA, 469 bp, Oryza sativa
atgtatcagtagtagcagcaacaaccatggatggatcttcctagctgcaaacatagtttcttctatggatcaacatttcgacatctaaaatttagaggtcagatgataggcagagaaatctagatttcaaaaaattaaatatgttaataaaaaatagcaatcaaattaaaatgtacgttgatggttgtattcattgttttatatcatacaatgatgaataaattcctcaaactggcgacctccaatgctttcatactgtcacacccagaaattcactaacccaaatttcaagcagaatgtgtattaaaatctctgtccaggactagccagagtacacagacgataattgaaaaaatagatctacatcttacaaaaataataaaataattcttacaaatgcagcagaaaaataaataaactagacttaatcttcacgaccaaaagcatagcttcctccataaaccacagg

SEQ ID NO: 18594 - DNA, 1501 bp, Oryza sativa
ttctgcggccatgcgcattcaaaattgcagacggcgacggtcgcgagttggcaaattcctggaacattgatcaattacttaaattctatgtataagtcaatagtatccatacttgtaagacatcttacagcttcaataaagcgtattttcaggtccagaccacaatcaaagtgttccttcccgatgatcccttacccagatgacatctagcgttgaaacctatcctcatgtccctttacgccgtcttgacaaggcctccgaggaacctaagggaacttcggctggggacgcccagagccgataaggccttgtcggatcctgtagagacgaaagaccatgtaagatctggtcgtgtaagagttctcgccgtgcgtattaaccaagccgtgtaattggaaataaactttccaacttcacggttgggggctaggatcagtgcttgttcaatcgaggcaggtcaaaggtccaagagccttatcttccgagaagaattctctgataacaaggctgggggctaggaagagtgtataactcaaacgactgattgaagtcgcgaagtgagaagacactcatacacgctacatccagagtaagaaagcttagttagatagatttcttttctatttcacaagtactttttacaattccataaaaatccaaaattatattacacattttccctaatatatttgtcacaggacacagagactaccaggaaggccaacgccagtccatggactggaagaccttctccgccagcggcgccatcgacttcgccaggccatctatctccgtaggagttctccgagaacgacaaaacccttcgcggaggaactcgaggtgcagcagcggacgatgatcttgaatgcaagccaacacatgccccccggcatatcggcttgatcgacgacactcctgcttcaaggcctcgtcgatacgttgaccgatgccttcgagctgggcgcaggccccattcagccacgagatgtatccggccgtcgattcctcgggatccccacggggtactcggagctctctacagactcttgacatggacgtgcatcaactcttcagatacgagttgaaccacacctcacgacctcggagtgtctctacggcctggtccttcttcacttccaacatagtcctctcgagttccgcgacctcaaacttcgtcctccaatactgaatgcgacgatcctggttagcaagcgcactctcgatgtctgctcagcatggaaacgattaagtcaagctgctcttctctcccgagaatatagcaaatcaagtcaatccagacggaagggtaaaggaaatgataacaaagacaaccaacctaagggagtcgttgccatgctcgtttccacaggcgaactttgatctacatggccccccggcacatgtggctcgaacgcaagtgccggaacgatcactggcaactcaggctgtccgcgctgctggacatcctcgacaccaacatatctacaaacaacaacaaagt

SEQ ID NO: 18595 - DNA, 258 bp, Oryza sativa
catattaagtcgattatcccgtacggttaagttataccacccgcatggaaaaaaaacggacaaaaaaaataaaatcgaaaaaatccgatcggatcgccgtcgtctctctttagtccagtgtccaaccccgcacaggcagccgtacctgagcgcatagctagcctttctcgatcctaatcccaaagctaccatttctcgagcaaagaaacggcaaccagccgatccactgtgcgacgcaacacaaagtttgcaaaacca

SEQ ID NO: 18596 - DNA, 1501 bp, Oryza sativa
taactgatgaaggaaaatgaagaagcagaagctgagttgatggcaggcaagatcttagaagctgtgcaacttctatctcctcaaggacctcaacacaggagtacaggactggcgtgggatgaaaaaagcaagtagtcatagatattgccttttgctcactggttttcttctcctgtttggctctttagatactgtgtaaggccattttttggctagaatgcttcttgtaaaagctggttctcccagctgttgaactgatgccgtaatcattatctagctttctataaaagctgggccttctggcctcttatcccaaaagaaaaatgacacacagaaagacaagcttgtaaatattcctgacatgtgcatgcataatcggaaggaagatttgagatgccgattggtgatttagttgccactatctgctttgattattgaatttattacgaggtataaggtgcatgagaagaattggtgtttattttactcaactagaaggttacatccaaggaggggagcttacattctagtttaacaatgagaacaacttcctctccttctgtcatagtctccacagcacgtgcaaaggcaggacaaaagaagcctagattttacaattatattagaccggcatagtaaaatggtacttctacaattaagtgcattcaatcatggtaaagggaacttattcttaccttctgcaaggttgaactcaacaccttcagacatggacactgacatcccatcctccaggcaagcattgtagttcactacaaaaaaaaaatgtaaaagtattagctcaataaacacacaagcactgttgagctattgcagaaataaatgaaaaaaatattggtacaattaatttctcaaattcaaaactaaagaaaacagagagatgaagggaggaactaatgtactatttcataccaagcacttcatccaaatcacaaggtttatcattccccactccacgcttcatagtctttttcaatatgccttcattgtcgaggatgtcagttatggtgataagagagatgagctcaacatcaaactgtagtgcttggttaggaggaaggttcgctgggatatcagcaggacaccgagacttggtgcctgctaattctggagggatggtgaatacagctttctcccctgcttgcattgagctaacagccatactgaagccttgcattacattctctataagcagtatttagttttatttcatcgaagtgtaactcatttttgagaaaagtatggttacagtggtacaaacacccaatgagccaggttttttaaacacacacacacatgaaagatgagccatgtaatcttgttatctacattctagtagaatctttaatggcttgaaacaaaaatgtcagaccccaaatcactaaagtcactttttcattaaaagattcagtccttaacacttgatagaaatcccactgcatcatataggtctgttgaagtttacgcaatgcagaaatcaaca

SEQ ID NO: 18597 - DNA, 1501 bp, Oryza sativa
gcgccctcgccgaggcggctgaagaaccgggccgcctcctcgtcgtcggccagcaggctctccaggacgccgcgccggcggagcagctcgacgtcgcgcgccgtcacgatgagctggcccatcagcgccacgtagctggtgaggaggcgcggctcctcgcccgcctgcgtctgctcgaacgccatgaggttgacgaggagcggtcgcttcatgtcgtcgatctctctatggccgggatctccatgacgcccctgcggcggtcgaacgtcacgtcgaacctgtcccgcgccgcgctccgccgcacgagggtgacacccgcctcccgcagttcgctggcacgcagaatcgtccgcgtcggcgccgccggtgccttccgggccgactcgggcagccgcggccgtggccgcttgggaacgaagcactcgtagtacaggtggaggaggtggtggacgtcccagtcaccggacggccgcctgatgggctcctcgtcgctgatgtactcgatgaggaggttgaagagggactccttgtcgggctgcatgccggcgacggcttcgtagagcctctcgaggacgaagaacgggatctggttctccatcaagagcaggtcggcggcgacgagcgtgaggccccagccgacgtcgcagagcgagtcggcctccttggtgtgccacttgaagaagaactcgaggatgaagaagccgtcgaggaggagcatccggacgaagtcgtcggaggagtccatgcccacggggcgctcgctgtagcacgcgcgcgcccggggctcgagggtccgcatttccgcgaccaaggcggacgcggtgaccacggcagcggcgccgtcgccagcgcggcgggatagcaggtcgtggaggtagcgccacttgtggtcctccatggcgcggagcgcggcgccgccgtggtggtaggggccgatggataccaggcgcggctcgtacgcggtgcggttgccgtcgcggacgtaggcggggacgcggaagatggtgaacggctgcagccgcgcccgccattgatctccgctgatggcgtccaacgttgcctccaccgaagcttccaacgacgccaccgccacgggttggcaaatctagcgaaatagtggtggcacgaattaaagaaagcgcgcagacgtgcagggagtcgaagtcgcaaaaaatagtttccccagacgtgcgtggcaaaatagtttccccagatcgacgtgcatctgcaaacttgcaaaaaccgaaatgcatgtggtcatcgaagtcgcgtcatcgtcgtttgacatatatggttgttttcatacgttatgtggtcgatcgagcagaaaagcacgaccaccaacgcgttgatgtttgggtggatatcattatcatatcattcacttgcccgcaatttcatcgcaagtttcgtgcaacaaaacagcgttaccatggcgtgaagttgggagttgggaggaagtttggtgtgaactaaacagtccctctgtttaatagccgat

SEQ ID NO: 18598 - DNA, 163 bp, Oryza sativa
ccggacacgactattatctctaacaaactctaagatacacataagtctttacggcagacttttgcccaaacatatctctaaggaaactatttaaaatatcctaattaatagatacaattgcctatctgggagcttatctctatgatggcaatcctttcgtagc

SEQ ID NO: 18599 - DNA, 1501 bp, Oryza sativa
taaatatacttttatgtatacatatagttttacacatttcacaaaagtttttgaataagacgaacggtcaaacatgtttaaaaaagtcaacggcgtcaaatattcaaggaaggaggtagtatatagtattaaatatagataaaaaactaattatacagtttgcatgtaaatcgggagacgtatcttttaaatctaattatccatgattagttataagtgctacagtacagtgaatggtgaatggtgaatggtgtggcctgtacggggaacaggacgcatcagttcggcgcaggtaaaaaactgcaagctgatcaatgtgacttgtgctccatctacctgcccttaattaccgcggctttgacagactcaagaacgaaagagacggctcaaattcttgtggtttttgcagtcgccaggccaccgtacgtgcatcatcttgctgtacacagatcgggaacaagaggtcaaacaaatacggagtatattttactgctcgaatcgatcgaatctgggacggatttttttagcaattgaacacaaacgcgacgaacgagtatacatgctgatgtagtcatgtttgacgatagtgatttcgatccggctgcgaataaagaggtcttaatctgtttgttagtactccttctttaatctgcaatttgtttatctgtttgtgtctgcctccctatcactcattcactcccttgaaaaaaaaaacaagttttgtttgctctaaatatctactaactatacgtatacgacagtgttgtcaacatcaaatcgttcatagtaactggacatcagataatatcaactggggctcattatgttgtcatgaagaagcttcagtgctaagcctagagttgttggttaggctgcttgaccaagtctgtgagtcaatagctttcaaaatctcccaactaaaggattagacttcagaggttctctcttatcttaaacttttagtcgtactttattatatacaaatccgaactaacaattgcatgctgatggtaattataaattggtttctctgagaggtcattaatggtaaaatactccggtgggaggcgaccaagtgtgtcggtttcagacagaaaccatgttctattagtcactgtagtctgtccaggaggcatacagaagcagcttcagcttccggcttgtcaattggtcaagaccatgcaccaaattaagctgaaacttcgagtctatcgagggtgtgttttgttcatgctaaaattagaagtttgattgaaattagaacgatatgacagaaaagttgaaaaatttatgtgtgtagaaaatttttgatgtgatagaaaagttgaaagtttgaagaaaaattttgtaactaaactcggcctgatcccagtaaggtagcaaatcctgatttttcatttgctacgtacgacggcgatactgttctgaggacagtagacaaagccctatttcatatgacaaaacaataataaaccaaattaagcattcacatttacttttt

SEQ ID NO: 18600 - DNA, 1501 bp, Oryza sativa
ctcgtcgccacgaacactcaagtcaaatgatggaaaagggcgtcatgggaatgggagtaagatgttggcaaacagtaggttcaggatgactgatgcgaagtcatcgaggagaccctgccgcgccctcaccgaacgaagtcggtccccgatgtggtcagcaagtcggttgagccggagcacgaaggcggcgaagatgtcgacggatggccccccgatctcgccagcgagctcgatgatggtagcgccgcgtccacgaaggagagccacggcctgggcatcgcgcacgtctgacctgatccttggcaagttcacctctgcgatgcggttgacgatgacgtacaggtcggcgagggcacgcagcctggtgaagttggcgacgcgccactggtaggcctcggtcatgtgcctcagtatggccgccatggcgacggcgtcgccgaaggtgcacgaggagacgatgacgttgatctgggaccggtgaggccccgccgatctccttcaccagcacctcgagctgtggcaaactggtgacctcgaaggcggtggtcgccattgcgatggcggaggagggatgggtttagggttttagcagatcggaagagggaggagggggggaggggggggattgcgtgcggattgcggcggtttggaaagggggggtgttatagcgaggggcggaaggggagcgagcgccaaattcaaaatttccgaaggcgcggtctccatataccaaaatggatttgtgccgaggcttgcgggagacgagcagctcggctgggcccgagagaggaggagaaaggaattagagcaaggttaatacagcatatttgttggctataagtcttttttttagctttttttacccacacatacaataattagctattacaattaatatagagcctacttgtctctctcacagaattttttggttcttttgttcaagccggttgtaagtttacatcccgtttctcctctctctctctctcttctcttctctctttcaccttagggtccctttgaatcgtaggaatgaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggcccttagcatttagtcgacttacagcctactattatactttctcttataggggtgtgtttggcgcctctttcccatcccttttcctcgttttccgtgcgcacgcttttcaaattgttaaacgatgcgtt

SEQ ID NO: 18601 - DNA, 1501 bp, Oryza sativa
attttattcatatatcctatgcagttattcgtagctctcttgcatggtttttttatgcataattgagttgatccaaactggaaagcctagagagaaactgtaagatgctgtgacagtgttattgatttggagctgtaaatctgtaactacaccaccacagtttcaccatttcattatggtgagctgttcctactttaattttctctttgccttttgttcagttatgtttatgtgtttccttttatggttgggaaatttcatgctgcgttgtaatctttcaagttccaaatggtttgtttcaggtaaggaacatgttggacaacatgttagagaaaaaccttgaaatagtcaaaactacctgttcgaacttggccgatcctatggaaacagatggagggataaaattatttaaaaaggctccacctggcatcagaatggatgccatgggtaagtgtcgaacaacaagtattattttcaacaatattattgggtaagatctcttgtgttagcaaaacatacttaactgtatatttccagataaataccatgtgcaactgaagagaccaagaattctgcctggaacagatatcgatgagaaatccaagaaggttggatagccattatcataatataattataaccatgcttgaagtttttttgtttaacttataatactattgttccgttgaccatgatttcagttcaggcatatgcttaagtctgttgctgttgatggcaatgatatacttgtttccgcaaagaaatcatcagaaagatcattggctagattggaagcaagagaagctgcagcgaaggcagcagccaagagggaagaagaaagggtgcgggaactgaagaagactaggggagagaaatggcttccttcaattgctagacaaatgaaggtaagaccaaacataaaatgcatactgtaatatgttcttccagagaaaggcccgggggtcttccagctagccggcccgggttcgatcctcgctcttcttgataaattccaatatgagagtccctcattttttatctagcgtaacatgttcttccattgatagtttggtgggattaggatgggaatcaattgatatttgagcggctcttctacacagactatgcaatcacacactgaattgctcctctttcttttccctgcgcaggaagaaaaagcttgggagcaacggaagtgatgatgccaccatcatatcaataggggtacctgtgctaatctctgatgccatcatcggcacttcggcagtgaccttcttcactttctgtctatgacaagggacagtagatagatcatagattaatggatgattttgcgtagctgataattcagttctggatgtcagcattgctctgatccctatatgggccttctttgtagacaattttgtattgtaacattccaggatcttgtgtgatgaaagtagcgtatgtatgcattatttggatatgaatctaaaaagcttaaacaactatagttttg

SEQ ID NO: 18602 - DNA, 1501 bp, Oryza sativa
aaaaagtcaacagcgtcaaacatttagggaatgagagagtatatattatagtcaaaaaaaccaaataatgataaatgattaatgatgtgtgcattttgtttggagctagcttacatgacacgctgcgccggccgccgccgccgctatcgtgcatggtactgaaaagcatatagtgtacgtacgggcaaattaagaaagaaattccatgctaactcgcaccggaaacgcattgcgtgaggccgataatcgtaataattaacatatcgcgccgccactcccgcccgtgatatagctattgtcatcccaatcgagctagcttttaattgttaatcgcgagattaattgctcgctaatctaagcaggaatataattaatttctgtcgatgccttaggccggccaacgatacattcgtcgataacatgtagcagatgaagtactagctagtgtacagtgtgtactacgactaacagttacagatcatattagagaacgacttgcctcaatgcttgatgagtagtcgtaagaaaaggatttcaccatgcagcaacctgcagacaaattcagaagtagcttaatttatatatctcagtaacgatttacaacagagtatagtgatatataataatttaagtacatgaccgtgacgctcagtaaagttccaaagcatatatgaaaacctctacaattggtgtgacatgatactgcacttgcaagctaattaaacagggcaaaggaatagttaaaagaactggtattattaccttgcaagagagtaatccatgcaagcaagaacaacagtttccccatcggatcaaccttcatatctatcgtctctcccaggacactgcagggtaagcatcaacaacacaacttcttaaacaattctatgcaattaataatccacgtcaataagttgccgaaaataacggcagaatgcaaagcaacaaaggtagctagcttaggtcatgtcttggtgcatcatgtgagcatcttaaactgattacattagcagcacattaccctgcagaatcgaacaaaaccagcacactcttgattagctatagcttgctaactcctctcagtagttaacagaagcagctagctaggtcgaggagatgaagagaccatatatgcatctgctcttcctacgttggactggaatgatcttagcgtggctgtgccatttatataggaaacgaagaggtgaaggccaactgaggtggtagtaggatatccgttgcatttgcttgtttcttgtgctcaccggctaactgctggcttgctgcatgcctgcacgggagggagacgcgagcgagattgccaagcaagcgtggaagagagggtcttgacttggcgatcgcccacacaagacacttgccgtttcatatcattttctactagtactactagtatattggttattttgctactgctgcctacggagtgtgacttgctgctgccaaagctaggcatccggccctggtgatgctttggtatttg

SEQ ID NO: 18603 - DNA, 1501 bp, Oryza sativa
tgccgccaccccggcctcgccggctggccgaaaggtgtcaactgtcaacggtgccggcgagtccccctccccctccctctcctctccttttcctcaagccagtggcggcgagctgtcccgcgcagctgtcttccctgtcgccggtgccggagaagaagaggaggacgccggagttggaaaagaaacaactgagcacgaatcacgaagcacattcagtgatccaaaatcccgaagatttggggatgtagtattttctatcgacggaaggatagcaattccgttatctttttgcaaaagagcccctccactttacgcctcctcgcggaacagcccctcctagaaggcaggagcggggtggggcccacctgtctgtgagacactgaggcagagaccctttccccgcgtcgggctcggatgatatacagtaaaaccgtctttttgtttagtggtttgactagtcctctctctccgggagaaattttgctccggccgcctcggcgtcgcgctccgcggctcgtaatctttcgcggtggccggcggcgggggagaggaggaggaggaggaggagggagatgaaggcgtgcgcgagggcagcgggggagaggctccccctggtcggtgctcccgccaggcaacccctggctcggaggtatcccctcttcgttactctgggttcttgtttgctcgctccctagaaatatactaagctttcgtttgttcaaacatcttttatttatttgtgaaaaaggctagaatttgcacttctcatgctagtaattctaattctagaatcttgacattgttccacggacgttgaattactggctactacttatttacttcgcccaaacgacttgtgtttgtactcttgtttttcatccaattcattcaaaaggagatagtgtttgtatatttaattgaattatcttgtataataccttttcatgtgggataatccccgcgaattgtcttttaatactaatggtaagaagtgaacatctaggatgttttgatgattgaatttgctataatcagagtaccgacttcacaatgctacttactgtaaattgtatctgcacataagattttttatttttcttcaacaaatttggggctttcttggtttgctaaggactgtggtgcaatagtaatgaggaactttggggtttatacacaaattccatccgtggttctcccaaatttttcatatatatgttaatgcaattgagtgatgctctcaatttgacatggttccttgagacttgatgtatatattatcttgttcagcacacttgttaattgctatgtaaaatttcatactgtatggaaatctcttttggcacatgggagaactgtgtatttctttggttaaaatgtttattcagattactgcactgacacacttgtttttctcagttttgttaaggtcaacagattatcatctcaacatgagacgaagtctgtggtatcctgctcggtaagggtgtcagatgacaagaca

SEQ ID NO: 18604 - DNA, 1501 bp, Oryza sativa
cctatcactaattcgctatgttccattgttttatctaaacataacgacgactatctcatctcgagctattgtaagttcactatgctaatgctgtcttagtgctagattactgcaaggacgtccatgaaatccacgtccaccagccaccatgtaggctgtttcaattgacaagtcagcgatcctcaatctgcaaggagaagaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgctcgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacggttatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtctgattgatatattaagttctaaaccgattccaggacacattcagtcaattcagttcaaatacataatcatgcgtttcaacattaattaaagtatcacattcatatatcagtacatggcttggcaaaccacaaagctgaggctgccttaatctaagctacaacaaaatttcttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaagtcatataaaccagaatcgccaagaattttcttgcttgatgactgtaaagagatgaaagttcaaactggtcattaaaaaa

SEQ ID NO: 18605 - DNA, 1501 bp, Oryza sativa
ctgcgacctataccaccttaacatcgagctcgctgatgtggcactaaaaattgccacagcgtgtcaaatgcataaatggccggccacccctagcctcgcccctcgcagactcacagtggcaactggcaaggcagaccgacacggcagctcatcgaattcatccccacgcgggtgacgtcgccctccctctccaatcaacaacaatccttccctccctcccacctccgctctcccgcaacgcagcgcctctgcggctctgcctccgcactccgcagccgccaccgacgggatcccgccgccgcctcctcctccccccctgcaatgccccgctcgtgacccatgccctcgcacgcgatcccctccccgcttctgcgagcgcggcccccggcaccctcggcggcggcggccgcggcgaccgggaggagggccccgtcgcgtgtggtggcggcattgggcggaggcggcccggccgggagagggatggagcagcagcagcagctcgccggggacggctcccgcagcccaggttcgtcgtcgtcgtcggtctactcctctcctacttccagctcggtggttagttggccgtgggtcggcgtctcgatgggtccagaatctctcgaggggaatggcgtggtagataatgcattggtttgttcccgctgcttggatgctgcttctgttggtgacctccacatatttagtgatcacgactttttggtgagaacaaatacgtgctgtaacagaattcaacaaatgggacacttgaccgtgatgtgtttgggcatatggtttttatgcctgatgctctttctttttgtcctttttgctgtgtatggggcctttgggtggtgaattgctggttgaagtttgatggaatactctattttggcacaatgttgaatggttttgcttcttttttttttgtgacgaatctgagagaatattggatgtttttgctacatggtggagaagttagagcttttctttttttttttttttaccatcataggtagaatcttctactatattgggactttgggagtagtttatttacatactaagttggtgacggggcaatggaatgacgttggtgatgttttcaaatatactttgaacgtgagtacacaatttgcgaaccctcttaagaagttatgataaagagaacacatacttgtctggttgatggatgatatgattagcaacaagaagagaatgttatgagaaaatcatagtagtacttttcagtgttctttcgggagcattgagaactctggaattcatgtgcatttaatcagagtagatattacctttttgtattatacaagtaataatgtgaaggaaaaggtgtcaaagataatctctcccttatattttatatagattatcctttttcatgttgtttgtactatatgcaaatatgtttgttcaacaacaggaacagagttgcgctaagccactaaccatgtcttggttcccattgcagttaaagagaagcctctag

SEQ ID NO: 18606 - DNA, 1501 bp, Oryza sativa
aaaggatccatatcagtaaattttggaaggaaaaaaaccaaaaagagaagtcacgtgcttttcttgtgaagcatctactacacattttgtgagcgactcatgcattctgttgtaggttcttcaagaacttcgtatgaccatggacatttaaaacttcgtatttcttttcccttgtgttcgagaatatttggaaggagttattgctcctttcggtgtatgaaaacagcaaagaataagaccaaaaacctgcatatattaaaagcgcgaggtttaacgtgggcctacacgaataattgcacagtacctttcacgaatctacggtttgtttggtttcggtcaggagacggatcaggcgtcgcgaaacgtttcgttgcatccgtccgatctgaggcgaggcgagcccggcccggcccggcccaactgttcgtcggagctacccgcctgggggcccaccctcagaggcgaatatgccaaactttgatgcggacgagtccttccctgtgtccgccgtctccatcgacacaccccaaaggcccaaaggtgaccccaaatactactctacattttgaaactgtggggtaaatcactcaatgtcttcacttagggcctgtttacttggggaaaaaaaaattttaggtgtcacaccgaacatttgaccggatatcggaagggattttcgaatacgaatgagaaaactaatttcataattcgtctggaaaccacgagacgaatcttttgagcctaattaaaccatcattagcacatgtgggttactgtagcacttatggctaattatggcctaattaggctcaaaagattcatctcgcaatttacacgtaaactgtgtaattagtttttctttttattttatatttaatgctccatatatatgtccaaagattcgatgtgatatttttgagaaaagtttttgggaactaaacagggccttaatcagactatagaggtcctgtttagttccaaagtttttttttctaaacttccaactttccatcacatcaaaccattcatacacacacaacttttctatcacatcgtatcaatttcaaccaaactttcaaacttcagtgtgaactaaacacagccagaggctcttttttttccctaataggtccgctagttcaatcccaatagctatgatccttccttttaaaacatggtataaacacacgtactcacaacacgagcgcactttataaacacacagagacaaaacaggatgtgaagggagattgtgaaacgagacgaaacgatggtcgggtaggcaggcgccaggcgcgcgggagaacggttggctagttgaggagggtgtgaaataaggatgttataatttattattatattgtttttaaatatacatgtaggacgtgacgtttgactatttattttatttaagattattaaatattgaaaaaaataagtcattgctgaagtatctttgatgacaaacaacggattaatacttaaatagattttcaattag

SEQ ID NO: 18607 - DNA, 1501 bp, Oryza sativa
gtgaattaagtgacacagagagtcagctgcatgcgtgagaccatgtgatagatcgatgttagatgcatagtagcttgcaagttggggaaatgagcaccacatgaaaagaggtaaagctagttagcatgtgtagcttgaatgcttaattagatgcaagagtacgtaaaggcaacaaaatgtgagattatcatattatattcctagattatataatctgttctagtgtagcatttgatggattcatcgtcagtgagccaatgatagatcgatgggctctacacacaaatcttgtcggatctcttgtcacctatgtttatctagtgtaggtttacatacagtccggtggctttgttaatttattcaatgatgagtagtagcctttatctttaagcaacaggacacttctctcggcttcccgctggtgttctccagttgattttaaatttgtatacgtctacgagtttttagctagctcgtctgcagggttcagtattttgattgagcgccggatagaccttgaaacggcatggagtcttttttaaaaaaaataataataatcaaattttgatatacttcgacttacttcgataacattatggtcaattatactgtttcaaatttgaattctcgaaaaccatttgaaattttaataggaatctactttcggacggtgtcaaaacctcaaaatttcacaattttcgatcacaacgtgaatcctggtcatctgcagactgcaggcatatggtaaaaccgtgatgacaacaaaacgtactacatagtttatggtgtttctgcaaatgagccaaataatgtgtgatcagctatagttaattgttcattatcagtgtgccaggatttttattaaaaaaagatgaagccaaaaaagggatcagaatgttgactagggccatgagtcatgctgccgtggtagtagactggtgagttggtgagtcgcaagtcgcaactgcgcgtgcatgtgacgaggcttgtgggagagcctccaaaaaccatgtgatccctccactgttcccacatggcgagcacgcagatttaaaacgctccgatgagatttaaaacgctccaaaatgtttgtgttgttccgtggagcatgttcttctgaccggtcaaatcgtacgaaaattcactagtttttgctgccaactatgggtacatgtgtggtttgcacaccacagcagaggactgtgtacaaccactagtaagatgactttattcccgctctaattatgatttgtgagcgttttcttgtttcctgaactaaacaaggctagctaggtaggagtaggccggattattcctccgttcaatttatttttctcagaatgttgggggttcctgaaacatctcaatcaaacaaaactaaaggaaacttattacacagtgacatatgtgcatgcatctcatctctctatgtctatgctgtgttttccgaccgttgtcaccgttgtgggccacaatgctcactctttgtgggggcagaatc

SEQ ID NO: 18608 - DNA, 646 bp, Oryza sativa
cggagttcttttgttgcttccaagaaaatagattccttcttcaactcaggtcatgaccgagggtgggtatctccctcgcatatctagagcccagcatctctcctaaacgacaccttctgcagactctactggtggtattccccgaggcgagggtaaatatgtgcattcatatcggtcaggaaacgacaatgactcttcttctttccgggaagctatgggcacctcacaattcttagacgacattagtggaagcgaacattcatagcattcattgtcaccgatcattgacaaaagaagaaaaagaagccgtacgacaacttaaggaatctttagatttggcggctatagactcaaagggcacagacaggctgctggtattgtttttttagctaactaaagtccaacttcctttgccgaaagaggatgaaatggaccacccgataccaatgaactcaccaaaagtttactgatcagatcaaccactgattgctgagaattccaaccctttctatcccagcttctactccacacagttgttctcgacttctactctcgatacttatcgtagtttatttttctacggttccttcgggctagggttagtgtcatttccactacttttgggagtgttatgatcagccaagct

SEQ ID NO: 18609 - DNA, 1501 bp, Oryza sativa
ctagctgcttctgttaactactgagaggagttagcaagctatagctaatcaagagtgtgctggttttgttcgattctgcagggtaatgtgctgctaatgtaatcagtttaagatgctcacatgatgcaccaagacatgacctaagctagctacctttgttgctttgcattctgccgttattttcggcaacttattgacgtggattattaattgcatagaattgtttaagaagttgtgttgttgatgcttaccctgcagtgtcctgggagagacgatagatatgaaggttgatccgatggggaaactgttgttcttgcttgcatggattactctcttgcaaggtaataataccagttcttttaactattcctttgccctgtttaattagcttgcaagtgcagtatcatgtcacaccaattgtagaggttttcatatatgctttggaactttactgagcgtcacggtcatgtacttaaattattatatatcactatactctgttgtaaatcgttactgagatatataaattaagctacttctgaatttgtctgcaggttgctgcatggtgaaatccttttcttacgactactcatcaagcattgaggcaagtcgttctctaatatgatctgtaactgttagtcgtagtacacactgtacactagctagtacttcatctgctacatgttatcgacgaatgtatcgttggccggcctaaggcatcgacagaaattaattatattcctgcttagattagcgagcaattaatctcgcgattaacaattaaaagctagctcgattgggatgacaatagctatatcacgggcgggagtggcggcgcgatatgttaattattacgattatcggcctcacgcaatgcgtttccggtgcgagttagcatggaatttctttcttaatttgcccgtacgtacactatatgcttttcagtaccatgcacgatagcggcggcggcggccggcgcagcgtgtcatgtaagctagctccaaacaaaatgcacacatcattaatcatttatcattatttggtttttttgactataatatatactctctcattccctaaatgtttgacgctgttgacttttttaaacatgtttgaccattcgtcttatttaaaaacttttataaaaatatgtaaaactatatgtatacataaaattatatttaacaatgaattaaatgataggaaaaaaataataattacttaaattttttgaataagacgaacggtcaaacatgtttaaaaaaatcaacggcgtcaaacatttaggaatggaggaagtatatatcaatatatgtagttatatgcaccttttctctttggtccattcttgtgctcttcatcattttattttcttattgtcattagtttgatgatcacgtttaggtatgcttcagatgtgtctgcagagcaagcaaagcatctctatgttgccgagattagagcagcatgcacttttatgcatgcttagacaaattaataa

SEQ ID NO: 18610 - DNA, 1501 bp, Oryza sativa
ctgtagcccccgactcactactcaatggaagaccaattggtgtagtgaggcagaggaaaagggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataatagatgacgatgcccatcaacggtggtgtgaccaaccgaccgtataggcggggacaccagtcggcggcgacggaggcaggccggcggtgaagtcgtagacgcccaacagcggcggcataataggccagctgtgtaggcggaggcaccactcggcggcgacggaggccagccggtcggtgaagacatggacgcccatgaacggtggtgtgaccgaccaaccgtataggcgatgacaccagtcggcggcgacgaaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcggagacaaaggatttagacagattcaggccctctcaatgagaggtaataccctactcctgtttggggatttgaatccgccgagtgtgtattgatctgacgatcaggttgtgtcatcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgt

SEQ ID NO: 18611 - DNA, 1501 bp, Oryza sativa
tttcagggtgtcattactatggagtagatcatttttttcttattttttttaatgccttgtaaaataaccaactagcagggatgttcataaatttctcccttttgtttggtttttttcagacatatatatataatgaaggcatatatacacaaaaggaggagctgtttgagggtctaaaggacaatagctcaattgactgggaagctgttgtcatatgctgagagcaatctgctaaatgttaaagaggtgcatctaacttttgtacccagtgaactgcaaatctgcaccttcatttttgattaatagtttctttggattcagatcaaaatagctcaacatgggaatttttctagcagaggatgggcaattcttggaaaatactatatatttcttgtcgttgaatatgatcatgtcccattattttggcacttgctgccttgattctgttgcctgtcccagcccttcagctagctctctatcacacatgaatgcgtgacccttgatggttgtatgcagttgggatattttggtgagttcatcccccttccccaccccacctctctctctctctcaaaaccatcatttatcttcactattgacttacaatttcacttctagctgatgatgatcaatcaaagctagctcatatgtattagtgagtttatgaaaaaaaggatcagatattcaataacagagtcagctccttccgaacgatggcaaaatggtacctttataattttacttctcaacacgcacacatttttttatgacgagtttgaacttttgttctccttgtcagattttatctgaagcaagtatcatatacttctgtattagaatatggacgcaatcatatatctcctaaggtttagtgcatactctcatatttggaagtgaataccaaacgtgtatgaaatagtgcattcgatttaatctattctctcttgggcatttattcgcaaatgcaaagatttttgtaatttgatcgtagcatagattatggcaaccttggctttgtggtttgccatgtcatgtactgatatatgaatgtgatgctttaattaacgttgaaaagccatgaattatgtattcgaacgaattgattggatgtgtcctgaaatcggttcagactttcgttctttgggtactggcgtgagacggggaaaaagacgctgaagacatcaagcataacatggagttgataaaacatcgtcgactgaatcatgatttgtagtttttttggattgccagatttttttcagtgttcaacaaattttcactcaataattatttaatatcttttcacttaatataatttgaaattgatatatagcatttcccgttgcaacgcacgggcaccttactatacttcaaatatgtatccgtatacttaattttttttgaaatggaactaaacacggcctgtattcgttgctgctagcaaaaacgacgttcccaataatttgggcagagcttttgcaatagtactactctctccctc

SEQ ID NO: 18612 - DNA, 1501 bp, Oryza sativa
aagaggcagctccggctcagggcggtgacagctagggacgtcgtgtgaagaggcaggttggctgggggcagtgtgttaggagggtgacagatgtgggagttagaggggagagaatgacggtaggtaaggatttaggaaaatttaaggttttgtttatagtccttcactaaatgggctaaataggtctttgaatgtaatatcttttgacttgtaactcatatctctgaggacttgcgggtcatctgcggtaaactaccatccccatctccgcccctgcaattttgagggccccgtacccactctcttgcggggaagaattttcttcatccctaaccccgtagggacgacgggtcctcgctggatctccagaaagagaaaattgccacccctaagtccgtcctgctaaggcgtcaacctcgcgcaaaccacgatcggcattgatcaaccctacttgttgcgcccgcatgcacccgcaggccgtcctcacggcccgcttcgtgtccatgcacacctcccagctcgaaccatgtgcctggatggggaaaggctagtcggagcatgcgcgccagcggtgcgcattttttcggacgaaagtagttagactaaccaattagtcttagtatttgatagataagattttctcaacttattataaagtagttagaccaactagtactggaggtacacgttaaattttggtataaagaagcttatatgcctataaaagtttaaagaggataaccatattacttctcaatgttgtggaagaaggaatatggttatcggacggaaatggtaccgttcaccaattaattagaatatggacaattaatcggaattatacggaaatttaacgatcgtgaatatatgtacaaattttacaagagtatatacttttcgaagatttagatgtgtacaactatataaatcaaatatcttcattttgttttttaattaaacagataagtaaaacattaactcttctaacaccgatttatacatcacatggtggtagaattggttgcattaaataagtaaaacataaaaatatatgtaacaaaaaaaattaagtaaagaaaattactctaaatcatcatcaaattcaatgtacagacgattattctggtgatttaacgaaaaacaaccaactaatcgctaaaacggagttttaacgttcgtgaatgataaatgtacaccgtatcatgttaatgaaacggttttactaccgttaacgtatatgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatga

SEQ ID NO: 18613 - DNA, 273 bp, Oryza sativa
ctcagtttaatgtggttcaagttgcaaaagttgtgtaaaataaagatctacatattaaaattgtccataaattgaattaaatttatttaattctttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagt

SEQ ID NO: 18614 - DNA, 1187 bp, Oryza sativa
ggggtgggaggggaatcatggagcgagttaacatcagcacacgatagaaacgggtttaattaatcctgacgtgtgaggtttcaattggatcgtttcagttggaattaagagcaggtacaatagctggctatagaccagctgcagacatattttaaagagataaataaggagagagaagagcagcgggctacagatttgtagccagttatagtacggactccaaaatacaatatgtgtatgacagatgggaccaggtattaatagtgtagtatataactattgtatggataagctattaaattaactatagatgaattgaaactagcagttggctatactattaaacttgctctaatggaaaggggcaagcaaaggatcagaccaatgaggcatatgctttttctttacaatgatagatgccacctttaatagctcaacccaaaatattaaagtattcctctgactatatccgatactaccttatctaaaagccgtcatttgtgtcgtttacagttgattataagtaaaataatctaaagataaaatttctatatatattccctctgagttaataatacttgtcgttttgaacaatagtacggtctcaaaaaaacaactttgatcattattttatttataatatgtactccctccatcataaaatatttgacgccgttgacttttttaaaaatatttgaccgttcgtcttattcaaaaagtaattattaattctttcatatcatttgatttattgttaaatataattttacgtatacatataatttttacatatttcataaaagtttttgaataagatgaacggtcaaacaagtttaaaaaagttaacggcgtcaaacatttagggaaagagggagtataaaagtgctaacaaatatatgattttattaaattattttttaagactaatctatacatatagttacaatatttaaaagataaatatttaaaaaatgattcataatcaaagattctaaagtttgacctcatccttatctaaaatgaaaatattacaaacccggatggagtacgtttttagtgatctaaaggtcaatgtaagaaataaagcatgatgaaagataacaataatcaactttaatggtgaaattctaatatttcaattttgtttgcggctggtacattgattgaagagcaaacagcaaagagtt

SEQ ID NO: 18615 - DNA, 1501 bp, Oryza sativa
aatagaccatctacacatgtgctgtttataggattttttttgtgtaaaatattgcattctttcactgttgcatatgcatatattagttatcggttgatcttgcattattatatgtatacaattatttagattagataatgattacttgtttaaactcaaaatttgtgtatatttatttcgatccatcacaactcatgggatgtgatgctagtttatcataatttaaaatgtgcatgattatccttgattcagatatctatatccattgccatcaacttcttatttgttttgatgcgtgctcatattgatcatgcttttagatagcaatatcatacaagtatggtactgccattattcaaatgtttttgagcctcagcctttcccaccccttgtcactgtcttggggcaatatttaactattgaagaattaactatgctttgcagggcacctgtggggcctgtttgcaataagaaaccccgtggctactaatgactactaatacaactcacagtcttaatcgtgtgtgttatcatacagggaggctttcagacaaacattgaaaattcttgctgaccatattattttctttttcataaataaacactatcaagggtcaccttttgtgggcttgcttatttgcactgaagatgaatttggaaaggtactaaagtactagtggcttagaatttggctatgcaaggttagcaggagaaccggtattgctaatttgtgctaaggatgaaattggtaggtgctgaagtactaaatgatgggagtttggctaggtaaagcttgaaagagaaagtcttcctaggatatgatagataaatcaaggaatttgttgctcactgtgcccaaaatcttaatacaatgatacacaaagcttatgtgtattcgcgaaaaatgtgcccaaaatctaaccaaccaactgctaaccttgctaggcaaggtaggctaaggaaccaaacatggttgctaattgctattgctttctgatcaaacattctgttcgatgattttctcctgtagactttattacaagatccttttagttacacttttgtgatgcatcatgcatgcttacagttacttatatctgcaattttttagtatgtctactaatggctgatttcttcaattatgaattccctgctctgctgctggtacataaaactgatgctagcatcttatgtcggatgactatttttcagaacaagtttagacattgaacttaaaagtaaaactatagcagatcgattcatctgcacaatttattagtttgtaacatgggaggctaggactattacctaatcgagaatgcaactgacaatgtttgttattcttattttgcagtgttggaaatatcataagttttgggacaagcaagagaggacatggagccatcatcacaacctcagccggcaattggtgttgttgctggtggatcacaagtgtaccctgcataccggcctgcagcaacagtgcctacaggttctgctg

SEQ ID NO: 18616 - DNA, 1501 bp, Oryza sativa
atctctcgattttccaagggattcaaacggagttttgaataattggcatcactgttattgctcttaccttccatctctcaatatcttgtagactcctggtgttattaggtccacaattgttgaaccagcacgcccagaagggaggattccaccatcaaagacatatgaacaatgtggccacagatcctcaaaatctttgacgttgacactactaggatgcccgcttaagttggcgcttgtaagtgcaagcgcacttccagcaccacgggaaatggctcgaatgaaatcaaaatctggcacacgaactccaatgctttccaaaccaggattaagagatctctccaatatactgttgttacctaaatgtaaatgaatgaagagttttattagacacattatgctgcttaagaaaggtgcaagatagaagttttgaagcataggctggtgtccacacctcgttttaaaacaactgtgacaggcccaggaagtagactatcaagcaggccatgaggtaggtgatccacaacagcaaaccgtgatatgtctgggacatcagcaacacagattgcaagaggccgtgtctgtacgcgtcctttgatctcatatatacgattaactgcttctgcagagctgtcatgaagattgagagacccattttaaaaataaccaatggatgaatgcagccaaccagtcagagaatctccaaaaaagtaaacctagcttaaaatgaacaaagtcacgaaacattgcttccaaatctaaatgaaagtgagattcaatagtaactaatgaaagtttctgaactgtttgtgaatattttttgtacatgactaatttagatatgagcacacaaactcctcataactagaatctggatttactgatcagagtttcttttcaggggttggccttgttagacatctactcacatcattgcagaaggtgttaaattggagttaacatgagaacaataggacaacaaagcaaatgagaagaataaaattcttggcacaaaatgtacttttagtaaaactaaccatgcatcacaagcaaagccataaatcgtatcggtgggcaccgcaatcacttgccccctgttaattgagtcaattgctttcatgacatgatcatttgttgctggaaggatgtgttctgccgtggcttctattcggtgtgtcttgtcatctgacacccttaccgagcaggataccacagacttcgtctcatgttgagatgataatctgttgaccttaacaaaactgagaaaaacaagtgtgtcagtgcagtaatctgaataaacattttaaccaaagaaatacacagttctcccatgtgccaaaagagatttccatacagtatgaaattttacatagcaattaacaagtgtgctgaacaagataatatatacatcaagtctcaaggaaccatgtcaaattgagagcatcactcaattgcattaacatatatatgaaaaatttgggagaaccacggatggaatttg

SEQ ID NO: 18617 - DNA, 422 bp, Oryza sativa
tttttctcccctcttctgcaggaggcggacgagctgatcgtggggctccccgtctccgccgacgggagcgagacgccgcagtccaacaaggttcggagcgtcgtcgggaggctcgccgtccaagcggccgacaggtgcgttgcattgcgtgtggctgcaaagctgcagactgcactgcactgttcaatgttcagtcagtcagtgtggttgccctgcatcaatatattagaagaaaaagagtttttgttacacaacgcaattagccggaccggcttatgctaggggaagggagaaaaggcaaaataaaaactgaaactatgaaaagacttacgccggcaaaatgcaactccgaaaggttgccctgcaatgtgcaatgttcagtgtcgtgttcataatcatgcgtctatctgaaaatgtgcagg

SEQ ID NO: 18618 - DNA, 1501 bp, Oryza sativa
cactaatcactgggataagcaaagaaaggcattgcaacttggctagggatcatacactgtccaaatgaatgtaacagctctccaagcccggtcaaaccataatcagatgctggtcggctacattggcacctgatgtgagacgttcatttcctgattgctttgcggctcgttgtctcagactgtgagtgctctttctgctttgatgctcatgattgcaactagagttcatgataattcatcacacagagagtttgtacacttgaaaaatagcagcagcaagatcaaaagaagatagccaaatgctcgaaatatcttatgaatatgacagtcactgagacactgactaccatattggtgtaaaaaaagacttccatttactctgttcccatacgatcagcatctggaaggtctttgaaacgataacttgaaggaaactgtgccacaattttttccttggaagtttaaacagtgagagcttaaactgcacaatttattccaaataattgggatccagtatcaaattatacattactaagaataaatacatctcacacatttttaaccggaatgtgcatgcggagtcaacaaattacagctatgctagaacagtacacaactacacaagagcgagtaacccatgatgataggccacatgtattgattgcaaattgatgcatcttattctggatcaaatggatcacactagtgtccacgagtggaggacactcaggaatcaaatcaatcttcacaaatatatgctaagcttgcaaatatccgttctcttcaaggtagcacagaacatgctgggccattgctttgggtgaaggacattccccatctaccatcttaattactatctgtggaaggccagaaaaaaatctattcagctatgttcaacaagcagataactttgcattttacatgtgggtaatgtcattcaatgtaatagataaatgatgaccctagttctttttgtctaaagtaaatgatcaaatcagaattcagattcatttatgtttggcaacatgtatgtcagattcaaaaaataaattaataagaaactccgacacttgtttagttgttttatccagctttaatcaaaccagccaaagcagagaaatcggaattgtgtatcccatcacaagtctgagatcaaaactaaatatattttttcctcatgccatcaattaaagcaagctacaatatgtgcatcaataaatgataacactactttttggttaaatattgccaattcttccgtgaatgaggttgctggatctaatagtgatagatatgtacacatataaacattaggaaggactataaatgaataaatgttcatagtcttatttctatggcaggagcatacaatgtaaatagttatagctaacagcggaatgatgatagtcagcactcggcagtaaagcactttttcagtagtgaataccctacacttagacttttagtttaccgtagtccgtatggaatggtaaggtgtggc

SEQ ID NO: 18619 - DNA, 1501 bp, Oryza sativa
taacaaaacaaattacagattccgcccgtaaactgcaagacgaatctattaagcctaattaattcgtcattagcaaatgtttactatagcaccacattgtcaaatcatggcgtaattaggctcaaaagattcatctcgcaatttacatgtaaattgtgcaattggttttttgtccacatttaatgctacatgtatgtgtccaaacatttgatgtgacagaatttttggaagtttgaaggaaactaaacacaacccaaatctactatttaacattcgaaattacaatcgaaacttaataccgagccatgttgaaacatcgaaaattcgtagaattcgactggttttggtcgggattgtaaaccctggctatcactttatcaaccaaaaaactagggcatcagccttcactcgcgttctctgtgggcccaagcaatggagagccatgggtgtgcgactgccactgggcccaggtagcactgtcaacagcggcgtgcctttatccacctctgacctctgcaatggaatgaaacgttgccaccccacctacaaatcaaaaacgcgaaggcgatggatatatacacaagctttgctgcattggttctagttagaacaaagaacaaaaagaagaaaaaaaaggaggtagaaacactgacatacacatcagcttccatgtcaagtttttgtattttgatgtaaaaaatccatcgttcgaatgcgacgtggttcttttcctcctccttttttcgatgatgtgttcacaagctggacaaggactttacacggccgcacgcacacctgaatgagacgttcaaatttatttttcgaaaggccagttcaatttccttttgacgcgatggaagtgataacttctggtctctgcacatcgtaaactaaaacaaagtttatgttaacatcttggtctaattaacttgatcttggttacttgaagtggagattccattaggcattcaacaattgataacttaagacatttttctcttgactctgactctacttttatgcgtgatcatgatgaactgacatgtcgttgtcgctggcatatctaaaatactccagtggacgtatggaatctcagaattctatagagaagagtagtggagtgctaaggtttaatactaaatcctttgaatcttttttttatatatggtccagaaggcactttcatgatcttctccagcttgttttcttttttttctctctatacatatgttttctctgttgttttactcttgtccatcttaatgtaaatacacccctacaagaaagactttattatatactctattcattatggcctcatgatatcggagattgcaaactaatgcacatgttaccttagcgcgcactctttttttgaaacacaatacaaacgtagggcccacaaatcgcacgcacttacccctatgaatgcacacacgcacacctcgcatactctgataggctggttccatcacaagaaacctaatcagttgagctacac

SEQ ID NO: 18620 - DNA, 1501 bp, Oryza sativa
cctaggaatccccatacactatcgaaaacctcagaaattctgattggaaatgtgtggaggataggtttcaaagaaaacttagcacatggaagggaaaaaataactcctatggtgggagattggttcttcttaactcggttctttcgagccttcccatgttcatgttatccttttttgaaatacctctagctgtacttcaaatactggattactaccgatcgagctttttctggagcagtgatagccagaaaaagaaatataggttagcaaaatgggattatatatgccggccaaaagatcaaggtggactgggtgtcctaaatcttgatatcatgaatagatgtttgttgagcaaatagctattcaagcttcttaatggtgatggcctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgcttggcgatgtgtcttctttgccttcaatattccccctccccacaatgcaaaagatatttttggtaactggctaaggggagtgcctagacacacaaaaaaatgattttatttggagctagtgctctatgttggtcaatttggcgttgccgtaatgatatggtttttaaccataaaaaaatgcctaacatcatgcaggttatattcatgtgttccaattagctccactcttggtgtatgatgctttcacaggaacaacaggatactatgcgtaatggtgctacacgcttgaaattggtagccaaggaacttttactccggtttggatggcgtagtacctacagaatttcgtgatagaatctacgtgatttaaaaaaaatatgattttagtatatcatattatcggcagaagttggggtttgtcctatctcgtttttttaagctcttttctattcacttct

SEQ ID NO: 18621 - DNA, 1501 bp, Oryza sativa
cctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgcttggcgatgtgtcttctttgccttcaatattccccctccccacaatgcaaaagatatttttggtaactggctaaggggagtgcctagacacacaaaaaaatgattttatttggagctagtgctctatgttggtcaatttggcgttgccgtaatgatatggtttttaaccataaaaaaatgcctaacatcatgcaggttatattcatgtgttccaattagctccactcttggtgtatgatgctttcacaggaacaacaggatactatgcgtaatggtgctacacgcttgaaattggtagccaaggaacttttactccggtttggatggcgtagtacctacagaatttcgtgatagaatctacgtgatttaaaaaaaatatgattttagtatatcatattatcggcagaagttggggtttgtcctatctcgtttttttaagctcttttctattcacttctggactttttggctgtatgcctgcccggagatgtaacccatttccattatcttaaaaaaaatgttggccggattatgatttccgcagggtgtatgaacaattttgcttggattgtactcgcaataggtgcatcgacctgattacagagccaaaataaaatgggaggtgaggatatacaatggagatagatcggtgtaaaaagtctgataagagaaaagtatagatgccatccaaaattagatgtatatgattgctacattatcattgtattcattttaaggcaaaaacagaaagtggatgttactgattttaagagccatagcacacgattggtccactaccatagtctgttaaaattaattgcattttgggccacatatttctac

SEQ ID NO: 18622 - DNA, 1501 bp, Oryza sativa
cccttctcctacatctccgataacctcgacgaatggcagtggagtaatggtttagggtcccaagttaggattggttgggggtgggaggaggaggcagatcatcgggtgggtttagagggatggccgtgagagatgacggtttgacggtggacggtgaacctagacaagcaaataggcacctaattaaaacggtgccgataccatggggatggaggggcagtgggccaacgttggatgtggggcgctaaaataagtacaaatatatttatttattatatataatattaaaaatatagttaaatatatattttgaagattgtgttattgtttaaataacaagaattgtaaaactagcaagtataagctcaagatctagtttaaatagtttaatagtaggctataagtcaactataaaacttacagggaggggaggatagtggaaaaataagttgtgttagctctaatgtaatagttaactattcataatttaagataactaaattaaatacataggtgagagaaagagaggagaaaaaatagagataaccttattattcatctattataaacgttatctgtaatattagcttatacttaatagttgactctgctgttaaaactagttcttagatggtctgacatctatgaattgtagcctagctggattgcacacttacatgcatgtggcaaccgattttccttttggctctatataagtaggtcgctaacgaacaaaaactgagttctgattccgaagaaagtacaccagctgtgagtacgttcttgatgatcgataccacgtactgcctctagctagaaacaagaagacaagaaattatgggcttaattgagctagctgcttgcatcgggagctgagatctgatccccaggatcacgttacaggattatattaattaatcacaccatcagaatattaatcagatcagactaccatttatgtgaatacgattagagatgatgaacacacacagatcgatcgttgtgtgaacaaaatggctggaagagagtactgcaaactgcaaagtccgcaccagataagttaaggtagcgacgtaacatgcttacattcatgatttaggctccatgatttaatgtgataagcatgctgatttctttaaccatatatggattaagttaattattaatgctagcctgtcgaatcgtcatcattccacagtttattcgcaccatgcattacgtacgttctatccgtatttcagctcgattacagtataaaatgtacaaatttaagtcagtgatgtttagatgtttatttctgaactactcgtattaaaattcgtatctccatatgcaatagtgacctggaagaaggcggcggcgattggacgctggagcatccggcgaaccatgacggaactgtggtattggcccactcaatttcggccggatagtgcacaaacctgacggcctaattaggcccatataaatttgggccgtgaaaatgttgggctacgtgaca

SEQ ID NO: 18623 - DNA, 299 bp, Oryza sativa
ggacacatcatagtacgtccagattcgttgtactaggatgtgtcccatcctagtatgaggttgggtttttttggacggagggagtaactattataaacttaaaaaatgatttatttgatatttttaactaacttctatatataatcttttttttgcaaaaagcgcaccatttaacagtttgaaaaccgttttaacagaaaatgagatggagttgaagaaaagagcagtacctaagtcactcttaacgttctatcaactcttttttggctcaaaaaatatctatacaacatcaagtgagt

SEQ ID NO: 18624 - DNA, 1501 bp, Oryza sativa
atattgtttattagggtcgcagactcgcaatgcatactccgtttcatattgaaaaaacattttgactttttttaagtcatactgctatttatgtctcattagttttttctataaatttagtcaaactaaaagaagttgacttttagaaaaaacacgatataaaaaggagggagatagggaatagatcagacaaagcaaacaattgtaggataatttctcaggatatgaaaatcactaggatgcttgatgtagtgagagcatgtctaatgtataatttctcaagagtgtaaaggtgggatccacttgtgtcatagcaactatagatgaaaagtccatcaacgtataaaatccaccattgatcatatagttcacaacatataagatagcttctttgttggtttagcggtaactggtctggtgttaggtttctcttaggttttatataggcactatcgggcttggtgtggtggtggtggtttttttctttcctggttaatgttttacagggtgctagccttgcaatttttgaacctaagaaatcaaccatatgccagcaatttttgacagaaaagtgaagtagagacttctagctaaatattgtggctaagtggcttactcaaagtactttaagttggcaagtcaaatattaaagtaatggagtatatgttagtcaaacttacttaactgaagtgctactacgaattaaacacgtctatatcttactctagtggataatttattttaatggttactagaaaggcatgcccaaagccatcaatctgttataaaaggagtataatttgttataaaaagagtatgttataggtagcttctttgttagtctagtgatgagttttgtgttagttttcttctaggttttgtatagacgctgctcgggtggttatttttcttttcttttctgattaatattttatatgatgttagtctagtaattttttttaactcaatcacttgctgccattattcaacagttttctattgagatctatcccgtaaataaatcatggcaccgtctcatattagttgttaatgaaaaaaattgttcaaaactccagtacaatctgagtcgtccactcgtccataccagaacaaatcctttcatccaaaacccacggcgccgaaagcgtaaaccccgaaaggtccaaaacctttgacgtgcagtgggacccacatttcgtctggctccacatgccactggcacacgtatcaaggagcctgacaggtggcacaactgcaggcaacgacgatataaagaaaagcccagcaccttcccgtgccttcctcgtatccaaactctcctttaccccaatctcgtgagcggcgacgaactttgccaccgatttcgatccttttttttggcaggtaaatcttacctcatctcccctgatcgctccgatttatggattgcaaggccgtcgtgcgaatttttgagattttcggggtcggatttggtgcagcgtgtagtgacgcgagagagaaa

SEQ ID NO: 18625 - DNA, 353 bp, Oryza sativa
tatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatataga

SEQ ID NO: 18626 - DNA, 1501 bp, Oryza sativa
tgaattccacgttctttgcaggcgcgaatttcagcacggacgttgatgaatacccagcaatcttgaagggtatgtttcttggttttgtggataggacaccaagacctgatagcttcggaagtcatctttgtcggcccgtgatttatgtcggtgggacaagacttggccgcatcagaatccttcccgagtttggatgtagtcggtaatccgttctccgtttcaacgggtggatttttcgacatggagccgtcttggtttgtggccactgcgttctcgttttcagtcattggaggaccggttgagattggcatcgtggtgtaaaccgggaagacgatttcaccgacttgagtccataccaacattgttgaagttgagaatgcttggctggagctggtgttgacattgttatcgacgaagcttgatggcatagtagtagaaccttgagtaccaagtccccctacctggcgcgccactgtcgacgggtgatacccgtagaccagatatagagggtattggggtacgctggtacaaggatctacgtagtacgacatcgagcaatcaaaagacaagaattatactggttcaggccccttgacaggtaatagccctaatccagttgatgtgggattatatggtggaaaacacaggttacaaaggaaaagatggaacttgtcagatccggcgagattgtagtcgagtcgattcgactagctctcgacgacttggctcctcataggctccggcttcgtaggctgtgtggattctgagattcgatgatctatgccctccccggggggtcccttttatatcgcaagtctggtactctccgagtaggactcgaacatatcagacctagcacgatacgtaggtaacccagttcttgtccgaaaaggactttttcccgtatattgatttcgtgaaaggtttccttagatcataaaggaaatatccgcatgcgcgtgggtatgccatgtcgatacgtatcgtatatcgaagggtaggggatatgcctgacccgtaaccctgacaagcaccattgtgcatagtatcatgctctttctgtggtaacatcgtaaatcaaaagtggagccagtaggaagacatgaagataagctgtatagggttagatagttatttaccattaaaactttatcattacaacaatgttaaattgaccaacatacaacactagctctaattataatcatctttttgatggacctagaaacccctctaagctaattacaaaaatatttttgtcgttacggtgtggagggatattaatatggagtattagattactagagcaacggcgaataattcgctcgtgtgttcgaaaagtcgtgggttgttcttgacttcttgccagtgctgttgtacatctcaatccatacatacatagctgtgttcgacactctttttcccgacccaaacagtgtacatggaaaatggaccgcacacgtgattaattaagtattaatttgattttttaagcaacttt

SEQ ID NO: 18627 - DNA, 1501 bp, Oryza sativa
cgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggcccaaatttatatgggcctaattaggccgtcaggtttgtgcactatccggccgaaattgagtgggccaataccacagttccgtcatggttcgccggatgctccagcgtccaatcgccgccgccttcttccaggtcactattgcatatggagatacgaattttaatacgagtagttcagaaataaacatctaaacatcactgacttaaatttgtacattttatactgtaatcgagctgaaatacggatagaacgtacgtaatgcatggtgcgaataaactgtggaatgatgacgattcgacaggctagcattaataattaacttaatccatatatggttaaagaaatcagcatgcttatcacattaaatcatggagcctaaatcatgaatgtaagcatgttacgtcgctaccttaacttatctggtgcggactttgcagtttgcagtactctcttccagccattttgttcacacaacgatcgatctgtgtgtgttcatcatctctaatcgtattcacataaatggtagtctgatctgattaatattctgatggtgtgattaattaatataatcctgtaacgtgatcctggggatcagatctcagctcccgatgcaagcagctagctcaattaagcccataatttcttgtcttcttgtttctagctagaggcagtacgtggtatcgatcatcaagaacgtactcacagctggtgtactttcttcggaatcagaactcagtttttgttcgttagcgacctacttatatagagccaaaaggaaaatcggttgccacatgcatgtaagtgtgcaatccagctaggctacaattcatagatgtcagaccatctaagaactagttttaacagcagagtcaactattaagtataagctaatattacagataacgtttataatagatgaataataaggttatctctattttttctcctctctttctctcacctatgtatttaatttagttatcttaaattatgaatagttaactattacattagagctaacacaacttatttttccactatcctcccctccctgtaagttttatagttgacttatagcctactattaaactatttaaactagatcttgagcttatacttgctagttttacaattcttgttatttaaacaataacacaatcttcaaaatatatatttaactatatttttaatattatatataataaataaatatatttgtacttattttagcgccccacatccaacgttggcccactgcccctccatccccatggtatcggcaccgttttaattaggtgcctatttgcttgtctaggttcaccgtccaccg

SEQ ID NO: 18628 - DNA, 1501 bp, Oryza sativa
tgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggaccatgcaactgacgggagatatcgccgtcatcgccatggatgcgggagccagtggtcgggtcgtgccgtgcaacggacgccccccgttcaccgaacaaacgctaaccctaggtaccccaaccccgtggattacctgctcgaggcgtcgccgcggagggggagacgaacgaaccgcacgacatgacggtaatcgcaggttgtaatcgtcgatgccgccatcggcggcgggtggtgggaagggggacggtcatggcggctcgtggtcgtctagggttttcgatggcgaggcggatctagaagggagggggcgatgccgtcggtgcgagaggaggccggaggggaggaggaagaccaaaccctaggaaggaaatcgccgccgaatccgcctcgccgcgccgcgccggccgccggcgagaaggggggagagagagagaggcggatcgatttggggattttttccgagagggatgattcgggaaaggattaatgggcttcgttgtgggtgggttagccttgtagcctcggcctgttgggcctcgaaatgctaggttaccccatctgggccgtcgatgttagatcggacggtcgtcgagtcggatacccaccactatcccagcacgcggcctgggagccgcacggccgcaacccaccaccactcccgaagcttctctcatggcggccatggccgcggcggcgaagctcacggcggccgcctcctctctcctcctccggtgagctctcactctctctcttccttcgagtccggtctactgcagcagtgttagtcaagcagatattacttctaaatatctaatccaatctttttcttacatgtctcttgtgcacaggcgctcacccttgctgcggcctcacggtctccgactctcccgccgcttcgctccccaaaggtgtggccgctttcatcagagatctgacttatgcccatgtttcttttgcgaatcatttttggaaatttggaccaaggttgggtgttactactggcattcaacttttgggcaactttggagcagttttctcttgtacttatggatgcttaggagacttcattctatctttagagcaatcaattaccagatgattattaacagaatcaatagactctctacatgcccattggcctgttatatgtgcatgattctagatttagttagccatgaagggtcaatcaacggagtgtagtgtgctctattgtttccaacggttggtactaaaaaaagtataagcaatgaacaaagggttgatcaccaaatagcaattaccgaatcccaattagttatattgctatttgatataaactcaagtctgtaaaacaattaaatccaaaat

SEQ ID NO: 18629 - DNA, 237 bp, Oryza sativa
cggagcgccgtcgccgtcgtcgacccgaagagcttcgccgcttcctcctcgtcgccgccgccgtccgttggtcttccgccgccgttttggtcaccggtgagttcgccgcgtcgtcctctacgtcctggtgctctccgttcgcgtcgccgcgccgtcgttcgccggcgagcatgcgagcccgagccgccggtggtgacgtcatcgctgacgtcatcgtccccgtctgccgtgagccgc

SEQ ID NO: 18630 - DNA, 744 bp, Oryza sativa
gcaaacaggccataacaaaggaataggttcacaccacccagtgacattcgaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtccgcggctagggtttcggtggaccgggcgcacgggcggcggttcacgcgaacggacggccgagatcgaaccgatccaagatggacggccgagatcgatcgggtccacggcggctcacggcagacggggacga

SEQ ID NO: 18631 - DNA, 304 bp, Oryza sativa
tattttttgtgctcttggaattgtaatgccaccgggcatgacagtgttgaccccggtaaagaaatcacaactacacaactacataattgattttcgtggacgaggccaacctccagcctctaggctgaccataacatcatccacttgcgataatatcgatcccgaaggaaaacaagatccacatgcaaaaaatcaattttctcatgcgagccaacttaataggccctccagcgaaaataacttatttcacaagcgggcctgttaagtggcatgcctatgccactagcccaccaggccgacgact

SEQ ID NO: 18632 - DNA, 1501 bp, Oryza sativa
gcgggcttgttaggacatccgccggcaaaaagaattttctgaaaaaaaattccaaagaaaaaattccgaagcggatgcagctcccctgctcagcggccgctgccatcatcactccatatccggtgaccgtcgtcgttgccgatgccctccctatccttccagcctcctattgctgccattggcggatccgcacgctggcgtggaggaggagagcccatgtccaccggatccatgcgtgagggaggagagtcagcaggatctgcacgtcaaggggagagtccgccggatcttcccattcaccccagacatagtcactgcagccgccgtagtcgtcgccacccctccctgccattgatgtgtgccaccagatccatgtacgagggagggggcgggagaggtggcgggatccatgtcgaggggaagagcctggcccaccggatccatgcgtggacgggccaacaaagccacagtcgccgctcctcttcccacatgaggtagccgtcaacacaaccgcctttgccacctaccgagcgcccgatgctgccgccaccacctttgtcggcctgtgaagtggagaggaggtaagtggggtgaggagaggagaagacgtcggactgtgaagtggagaggaggtggagtggggtggggtgaggagcggagaggatgagagaagagaggagaggataagatatttttaagggaaagaggagagtgggttgttgtcagcgttatggataccacatacctaatagtagtttactaaatctcggcaggacccaccacataccatgtcttatacggaaactgaccttgagggagttccggataaggaaagacaaccagagttctacatggaaacgacaaggactactcgatcggattgtattcatattggttttcctagttctatttggacaaggggacacctatgggtataaatacaaggccccctaggaggagaggggatacgaagacacaatcaacacccaccataatctatggaacaacagaagccacaacatacaagccaacatacgccaagacaaaatgccggatatcgacttcagggataagcacggctagtcccctacagtgtctcggatactgtcaggagagacgaaggcgctgtctctgatctcgccgggcacggattcgagaaggaagaataccctgttgtcgactacgagtcagaccttcagaccgccatgtcgacaatagttagataggctaccccaaatattgtactggtgtgattatggtgaataagagcaacgaccggctccatccaataggatgtagggctattacctgacaattcaggggctcgaacctatataaaaatcctcgtctccgtctcttttacctcagtctcgcatatatcctagtaccaacgatccccatactatgcaaataccagaatcgcgacatcaaacgtcgacagtggcgcgccaggtagggggattttggtgcttcagggtttcgacgagatgggttcaagaga

SEQ ID NO: 18633 - DNA, 242 bp, Oryza sativa
cgtagccccgtttgctatcagggattaaaggttgttgcaaaccggggctacaaagggtttgtgcagcagtggaggtttccacctgatcagatttgtaggactaaaatatgtcatatcccgtactatatcaacttattttggatggatgaagtatcaaagatctttgaacaactcccaagtataattttcagtttttcacgtttaaatttaacagtacaaatccaatcgtacgtgtggtgtga

SEQ ID NO: 18634 - DNA, 322 bp, Oryza sativa
cgtcacgttgtatcatatgagcatttatatgagcatcatgcggtggcttagaatcgtttataggaagtttaatggacatttaccgttgatatattttagcgacacatatttgttgaattatttaaggtgacataatatatgttatcaactattttataattaaaaaatatttcattgttatattttgttgccatgtaaagaatatggcccatagaagaatatggatcttgaattatttatttattaattataaataaaataataataaaaaaataagacatgtaactattgaaattggaagattagaaaagggaagagaata

SEQ ID NO: 18635 - DNA, 322 bp, Oryza sativa
aacatattagctgtgagacaccacaaaaacgtgtatttgctataggacaccatgaaaacctggtaattagctgctggacgcccgtgagattattttattatatccggagaaattggagagagaaacaactgtgtaagtacggttctacccttagatttttttttctttttgtttttctctatccttctctactccttcttccttattattttctctctctatcaaattctttctctctttgctctttcttgaagtgaacccgacggggagggagagcgccggtgaccacgcgacgaggcgcgggccggtgtggcgccttgga

SEQ ID NO: 18636 - DNA, 1501 bp, Oryza sativa
tgaaatggcctgctggctaattaaccaagtgggatgctttctgtactattgcctaagttctcttgtagtaagacaatatgatcggttgaagtaatacccgcattggtgaatggtgttttctatccatctgtaacgtctttgttgtcaatgataccttcacaacagagcccgtgagaatgctcaaagaatctgttagtgagattgtctggtcgttctgtaattacttgattcgagcctctaaagtttacataatcgttcggccacaatatttatttgcaatacggatcgagggtaataagctagattcttcgtgctgtaatgtagttttgactttctcaaggcaaaacgatcgattgaattgaaagaacagagttatcgacttgtctaatgatgcttgttttaatgttttataaatctgattttgttattcaaactggaataatatagctggaaaacgggtggatcacgtttcatgcagctatctccagaattgaattcagaagataaacaaacccacaatccctgagctgcaatctcaatacaatcaagtcactgtcacttaatcaaagtttaaacaaacccaatcctccacctgtattcagatgataagcaaatcaagagctgaatttcaaatggagcacaaacggaatgatcaggacactacaaaattttcatgtctgatttgcaagaaaaatgtttcagcttattacattccttgggactcctctatccagaataatataatgtggtaggagaggcgagatggctcattgtcatgatggtgagttgctgcatagtttcttgaaatccagcagttaggggattgatcagtgtttgccatcttcttcctcacaaaacttcttgtacttctcatcatccatcagcgagtttaactcacttggatcacttatcttaaccttgatgatccatcccttctcatatggacttccatttatctgtgtaaaattgcagaagcaaattgtcaactgaacatagcagtgattactcaaaaattagtctagcaagggtagcaattgcgactcacaaatcctggtttttcacttagttcatcatttacttgaataatctctccagatactggtgcattgatatcactggttgctttcacactttcaaccgcaccaaagttcgttccttgtgatactgtggaaccaacttctggaagctcaacatacacaacatcacccaaatggtcctggaattgaaacaggacatattaagccatcacactatcacagaaaattctattttgaggaaaaatgctgtaatgcatgtcaataacacgttgaagttatcaactcagcaagagacccagtaatatagcatattgaaggctgataaaatgctggtgcagcttgcaaatgtatcaaactgattacctgagcatggtctgtgacccctatggttgctgaatcaccctcaaccttcacccactcatgagtatcagcatattttagatctttaaggactgccaagcagg

SEQ ID NO: 18637 - DNA, 1501 bp, Oryza sativa
atgcaccggaagatagcttaatcattctttaggccccttcaaagaaaatttataggaattttagaggatttcatttctatagaaatgtttcctacaaagtcctttgaatcaaaggaatgaaccctatggaatcctatgaaattcctatggaatgcctcttcccgtacaagttttggaggaattttaataagatgtagaacctcatagaagaaatcctttgagtttttatctctccttaaattcctgtgtttttcctgtggtccaatcaaatggtcattcctatatttttcctgtgttttgcaatcctctgtttcacacttacattcctgtcagaatcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagtcattcgcagcggcagcgatggatgttgcggccgccgcgggcgtcgttggtgggttcttgcaggtcgtcttcgacaagtactacggctccaagctcgagcagtgggctgctcgctcgggcctgcacggcgacttcctcagcctcaagaaccagctccacatggtccgtgccatgctcgaggcaggcggcggcggcaacgccccccacaacgactccctgcgcagcctcatcgtggagctcaaatccgctgcctacgccgccgacaacgtgctcgacgagatggagtactaccgcctcaaggagctcgtcgaggacaccagtggccgcgacggcggcgcaccgtcgtcgtcggctcgccaggtggtcggccgcatactggtgcctgcgcctctcctgtccaatccattcaagcgagccaggacgggcgccgacgaagccttgcaagggcagggcgctgacacggacacccccaacttcgatcaggatgcaatgtcctccaagatcaaatcgatatcctgctgcctcgagcagattgctggcatggtgcggaggatcatcgagctcgaca

SEQ ID NO: 18638 - DNA, 1501 bp, Oryza sativa
tgcatttcatgttaggacctgccaattaattatatgaacactactgcctccgtcccataataattgcatttctagaaaattagagatagattaacaacaaacacaatttacaacaatatccctatttaataactacatgcatattccatatgtatacttgattaaaagcaaggttgaggaatacacattccatatgtaaacttaattaaaagaaaggtttgggtacatattccatttgttgcttcccatattattagaaatacaatatttttgagacaaatttgaatggtagaaatgcaattattatggaacgggggtaaagacaaatttgaatggtagaaatgcaattattatggaacgggggtagtagctacgtttgcagggccaggggcatatgccttttattcacggtgatttaattaccacatcgtgagttatgagtagatggtctttttacatgatactaaatccgtccaaatgtctatttttttatacggtcttcaatgatatactttgactattaatttatcccatgttatgttttcaataaatatgaaattagtatcacatgaaagtaatttaaaatatgagtaacatgccttatatatatatgttcatttcaggcattgatgtcagttacgaaccgactctaatgttattttctgcagtagtaacacaaccctatctcagacagtggttgttactttgtacgtatcaatcttgtcccaaaaatagatgtatcaacctatcctccgggcaacaactctgaagcacgtgttagacataattctatgcctttgtatattttcataaatttctgcttcctcagccaacttaatttggacttatggacttgcacccataaatattgtgcaagatataaaatgaatctctggcatgtcaaacgttcactggtcgtactgttatttgaaaattctttgcagtcatggtcgtcctatttatacaccggtatccgtcatcccacaccttcggttttggtttgggaggcattgggaatcccagagattccaaagaattgaaacacaggtattggacacaagcagctaatttgctggttttactggcggagactataacaaggttgtttagggtagcactagctgctgcattgtttacaacatagccagacctagaaagccaacagtactagaaaatggttttttttaactgtcaacgtttttttatggctaggaaattgctttcactgaaaatgaactttttgacatctgggagcaatgcttcacgaaaactgctcttttcgtggaaggaatgatattccagaagtgaatatttatccctcaagggaacatccctgttccctccttttatgtatgtcacctaaaaattataaaaaaaattgtatgacagatatgatagaataatatgaaatatgtttttccacaaacataaaattcaaattcaatataacaagtgaaaaaaataacaaatattactgcgaatagtacacagtattcacagt

SEQ ID NO: 18639 - DNA, 178 bp, Oryza sativa
taaatgatttcaaatggaaatatggtcaacaaaaaagttgatcctctcatcaagatatacaatttttattttggtcatttgtctatataactttgttcccaatagcttaaaattgattttgacaatatgacaaatctaaacagcatttgtaaatactaaatgatttcaaatggaaata

SEQ ID NO: 18640 - DNA, 1501 bp, Oryza sativa
ctagtacttctgaatacatctgtgccctaactaaatttccacaacttattcatgtgggagaggatgctctcttcagcatcattgatgatttggacctttagtgccactaattgttgcaaatttgacatggccataaacaacatgtggttgttggaaacaatttacttgttttattcttctgatggacgtctgctgtatgggtttcttcactgaaatctctagtaatcctacaactttacctggtcatcgagcattcatataactgttcaaccctgatggttttcaggttcagttggttcgagtgatactctggactgccagtcacctatcaagcctgataattcagaatccaggcatttgctgatcgacctgaatgtacctcaagaagaaagtctacatgttttctatgctccatctcaaataacttgtccaactttagttaattcttcgtcatcacaccctggagaattttggaatggctccagcaatgtttacaaaaaggaatgtggttctggtgttggatcatcaaaaggatcttccattacggtggttgcacccagctctgctcctgatagttcgagggaagttgtggctgcataccaatttcatgatcctaagaatttgcatggtaatatacatgcaagagaaaacagccagcatgaacatgcagtggataagttatgtggatcaagcagtcaatatttcttgccacagcaaagattttctgtcagttcctgtggcagaaatgactcatctttggccttacaaaaatcaggtgacaaccatgttgcctgccaatcaggacaaccacctctggctgtgcatactgagctccaacatgacacttctattgtaatatccagtggtgaagagaaggtcctttttgaccttaatgtgccagctgaaagcattgacatggaatcaacaataaccagtaatagttttagagataagctagtgaaaaatgatggaagtgaagaaacagtaaccgatcattctttctccaagagaaacggtgtgcatgctgaaacttctatagaagaacgaactgttggagaacatcatatatcagtcagcaaggatggaaacaccacatttttccaagaatcaataaataatgaaattgataaggcgcagtcttcagaccttataagtgttagcagcaaacatttgattgcagaaactcctcatgttgacaatattgtgtgtccagaactgcgagcatctcctgatggagcatcaagtcctcaagagaccttgataggcaattgtgacaaaatggtttgtattgcagctgagacactcgtttccattttctcaagttctgcatgtactacagattgcccaggaactgacagtcagacagcagctgaggatgtaaacgatgaaccgcagcactctttggattcctatgaggaaattgtattgaatgtagaagagatcagagatgacggggaatccatccctgtgattccacctgataaggatggaccgtcttgtg

SEQ ID NO: 18641 - DNA, 1501 bp, Oryza sativa
tcaatctcttcgtgggcagacctgtggcaacagttcatcgccaatttccaaggaacatacaagcgccacgcgatcaacgacgacttacacacgctaacacagaactcgggggaatcattgagggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattcgatacagcttacaacgccatcatcggaagaactgcacttgcgaagttcatggccgcatcccactacgcatatcaagtgctcaagatgccgggaccgaagggaacaatcactatttaggggaacgcaaagctggcggtgcagtgcgacaggcggagcctcgacatggtcgaacaaacgcccaccccacccgccacgtctgagccaccggagaaagtgagcaagccaaacaaggcgccgaagccggacggcaccatcaagatcgttccgctctccagtgctaaccccgacaagactgtcaaaatcggggctacactagatgagaaataggaactcgcgctcatcaccttcatccgcgataatgccgacgtgtttgcttggcagccgtccgaca

SEQ ID NO: 18642 - DNA, 1501 bp, Oryza sativa
gaagaataatgacaactatgggctaacaactcaggacatggatattacagtactggcttgtcatgaaaaaagcatcaatcaattaatagaaatcgttatagcattaggggatggtctcctgttcctgcacaattaaggctgtcaacttctgatggtcgtgtcagatctttttaagctttggtgttaattagcatcttataccatgcgtgcacaagatcttgcagagtttccttttagctcttccgaacaatgaaggtttctcatgcaagcaagtaatgttactgatggggattttttttgttgtttcctacagtagttttcagctgcattgtcaagcaagagtactcctttctgttgcttctacctcgcacattcaatccgtattaacatctataaccaatctgttggtagttaacacagcagatgtactccatccttatcagaagaaccctcttatcacaatcaatgattttttttctttaacttggccatgttctttcaatatttatccttccagatttttctacagattatttgctccacgtttctaaaaatacaatttttcaaaaaaaaaaaactttcttctaccatattgctatctattctaagctatttgcaaactttttttaaaaaaataattaattgtgttaatcattgaacaatccgtgtcaataatctagggaaaggttgcatcaaaatagttgagcaaggccttttcttgacgcgacactttttccaattcctacgaaaattgaattgattcctaaaaaataccctgcagagtggaatttcctgttccataaacattataatcattggctgtgtgcgcccgcagaggccggaaatataagattttccattatcaaaaaaaaaacaaatacaatgcctgaacattatgcacaatatatcactattatatagtatatactaaagtcagcatcttgtacagcaatgcatgagcataaggtagcatagcaagcaaagccaaaacaggggttggaagaggaagacaacaaatacaatagcaagggtccaagaagctagcatccaagaagtacattttcctcttatctcccccctctccaaaaaaccagagagagcagccacgagaccggaaacttttgctgcggctggcttctcaagatgttgccaacatccttttataccctacctgccaaaaaaaaaatttctctgcaattgcatgcagatgcaaacaagcaagccctcccatggcattggcaatcatacattcataccagtacatgtttccattggttgagaggagaagagaacacacatgctgtaacaagaacacttcaaacctacggcgacaaatctctctgcctctctgtctgtctctgcctgtgaggggaaaaaaaaggaaaaagagaggaaaaaagagaaagaaacaacatatattttgctgcactgacacacaaagatgaaattgcagagcagaagcaaagaaggcatccagattacagacatgcatgcaggacaa

SEQ ID NO: 18643 - DNA, 1501 bp, Oryza sativa
gaaggtcctgaacatggtgaaattgatggtttattctctgttgtgctcaggaaaatggtatgtgaatttttttttgttgacttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttattgcttataatcttgttttaacttatcaatgaaacggagaattaattcggtcaaaggaaatttagtactaatgaagtggatagttattttcagattggaattgttctgttttttttttgcaaaataaaattttatatttgttctgtttggtccatgtgtacaatgcggtactctgaatcttgctaccatgctattacagactactgttagttatgttgaagatgtgagtatttttcaggttgtagttgtgactatacaaatttgtatctattctctcaacacagttcagtgcagccaacgttgttgagttttttgttttttcttctctcgttgtttggcactaataccttctttgttttctttcacatatcctgcacctaagtatccttggtagctttgatgcatgcaacgtcatattcatgtttcccatgtaactaattcaatctagtattatgcaaacatagccaccataacacgtgttatggatatgtttttttttgtgtgtcattgtgtctaattttttctcaagtatatctgttttgatgtgtgatttgtgttagtttgcttggattagttttctcaagtgtttttttttgttctacacgcagcagcttttaatatgatatgagcttaaactttttttcggggctgtgcaaatttgtaaggttgcaaaataatagtctagtagtgatggtttcttcacttatagcttagttcaggtttccaaaattttaccgacaatttctactaaaattacagtacacttacatgctatatgcattgaatttacaattgtaattttaatttcaaatcactgtaatttctacttctagtgtttgattttgcatatgtatggcagcatggatagtgctattaagattgggtgctatctcaagtatatctgttttgatgtgtgattttgtgttagtttgcttggattagtttcctactagtaaggtttcagatatattatgattttaaatgttaggctatacagccgggaccaaattttatataattctggtcatgagtgtatatggttgcctcttagcctttataagggtaccccctcactccctacctccctatgatttttttttgattttattcatgctaatgtgctgatctggtatatggtaatgaaattattatttctttctcttttagcttttaaatattctaatttagtaaataagtttttaacacacttctacacttgtttttaagg

SEQ ID NO: 18644 - DNA, 1501 bp, Oryza sativa
ctggccgccacccgatgatctccttggcagggagaacgccgtgcgccaccatctccttcaggttctcttccgttacgtcagacggcgcccactggccttcaaagctttctttctcttccgccatcgattttccccgaatgcgctgatttgattcgagggatggcttgggagaggtgaggaattgaggcggtggatcacgggaaggattttgatgcactttttcgaaggtggatttgagtggagtggtgaaccctagttcgccagcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaagaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgttaaccactcggatttcttttattatggctaaaaagcagtcggcaagaatgcctctttaggcgccgcgtatgctattgtcatatgatgcatgattatgctattattttgttctcaactatatgattagtttgttaactaatcacatagttgggggctacacctaattaggtgcatctattcgatgcaccatattctttatcttttcgccctttacagtcttcgtcttcgctactcggtaggccttggcatgaaaagtttgaagcactcggattattatctttgggaaggctacgatggttgactgcaaaggtctcgggggctactgtggagattatggatatcccatatctacaaggcgacaatatttgggctgaatataggataccgaatatagatagaatatcttacttgtatctcgggtttgtttcttaacttgtacatcaaggaaacaccttgagacttagtcggtcacgactgtatttgatctgtatctatgtattccgttagggatatagattatcttttgtaacccggactccttcccatatataaggagggtctgggcgcctctaggggcggatgttgattttctctaaatcatacaatcaataatacactcggcggattcatccccggacaggagtagggtattacttcttttataagaaggcctgaacc

SEQ ID NO: 18645 - DNA, 1501 bp, Oryza sativa
acatcatagggcctagagatatctctccataggagggacaaatcccatcatcattattcatatcccactacatgtttctagcatacccgaaaactacttttataactacccaattacgcagtagcgtttatcatgttgggaaccatgataatcttaggtctaaggattcaacaccaacgctaaatgtgatcactgatgacacaacacatgcatatagctcttgcaatgtctcatgttgggtctatccaacaacatgttccccaacatgtgtccacattattaattttgtatctcgatactataatccatgagacatgatcatcaattaatacatgtgctgatcatttaaacatatttgttccacatatgatatttgatcagggatcctttaaaaatagtaacgtacaacataaagagtctcatgaaagaatcacatattcgttaaccaataatgagttatctatttcaagcaaacaatctcggataaatatgtaaacatagtatgtgatacaatcatctctatgattgcctctagggcatatcaccaacagcacttggtcgggttacggagtcctagaagggcaaaagctagggactggttgaaccccgttcttcactcaggggtctgagccgggtgaacatgcaacggagtgagagggcgcggttcatttcctatccgcactgtgctgttgctaaccctagagtttacaaacttgttttttttcttggtgtatgtggagccaagacaaatactgcaataaagacatactagaattcctaaagcttcccactcctaaatggcggtgagaaatctgaggtgactacagttcatgatatggcctctcgtcttgggagctttacatattttttgcttgctgcagcaaagacggaagcagactgcctttttatagttatgtatgtctcatctcttcatttataattattataagtgaaacatcttattaatgacaaaatataatttacatgtaaagcttttatatgcgtgtcctttattgattttgaaaaaatgcgggaaaacaaactacatcaaagaaaacctgaaatcaactctaaaattatgtttcaaaattcgaatttttacttatccttataacctgaaggctaagtgaagaaaacctgaaatcatctctaaatttttttaaaactcaaattttcacttatccttataaaggcagaaggctaaacgttgcgagccgcatatgaaagctacactgtacagacttcactgttgcaactttaagctaagacaaaagatgaaataaaaccactgcaaggacttgccattagtaaagtcttgaagggaaaacccttgggtgggagctgattatctttgatacgaatggcaacgataactagctcgtcttacttgagatgcccacaatgttcacaatcatatgctccatatgcctgaatgtttgatagttgaaataaaaattgttcattgttataaggagatgtgtcacattggtcatacgagcaa

SEQ ID NO: 18646 - DNA, 505 bp, Oryza sativa
atgcattatattgatgtctttggtgactgattcaatagtgatttgtggtcatttgatgtctagcaattttttctttgttatttatgttgtactccatcatttttttatgagtgcaatatcggtaggtattctatggaaatgtgttactactgatcatttggaaatattgggtcttgttgaatttactcttacagaaaagaaaaaccacacctttcctttcgcagtgtgctaaaaaaattgggtggagtattaggtccttgtactttgaagccaacatatcaaaattcgccatgctgtgatatatcaaaaaatctgtaacttgtacatgcatttggaataattcagggctgcattgaatgtgtttaattcttagtatcatagttagggatctgattacaaattgcatagttaaaggattatggttgatagtggtgttttttaattgtgacctggagtgccactgatgatgttgtttgcaccttttattacagctatgttgatttgt

SEQ ID NO: 18647 - DNA, 1501 bp, Oryza sativa
tttttagccttctctatagggtccacttgtctctcttatagaatttttttggttcttgtgtccaagccggttgtaagtttacagtccgcttcttttctctctctcatctcttctatcatttgcctcggcatttagctggtttatagcctactattattatacttgctcttagtactgtatgctttttttttcgtttctataattttcaattttcaactttcgatgcaatgaatgatgatgaatcttggtgatgatgatgatgatgaacgagctgaagttaggcaaagattcaggtactaggagtagtaataacaaaaacaaagttcgcatttgattggttttaacttccgtgtttgagatcgacactgcttcagttacgacttacgagttggagctatcagcgaagtaagcaagatggcaatcatgtaaagacacgatatttggtttgttcagtagctaaaacctgggatttacaaaaccgtattatcatattgttatccctccatcgtttcgttaatccaagactgatattacatattctatatttagatttattgtattagaatatatcatattcagtactagattggttttttatgggacggagggaatatgcggtaaccttttcagtttcaaaatcatggtatatcttgtggtaaccgctaaaccgtgggatgatgataacataaaccctgctaaagcctaaaggaaacagcagcttttggatgatgatgagctctcggcctcatgcagtgccgtccgcgctgcatctcactggcctcgccatggatgctgcctcagcaagcacacgcccagtgattcctgactcacaggtcagagaatccttcaccaccacttctgatgataaacagtgatctgagacataaatctttctgtaactgcagctcgattattagtaccggtcacttggtgctcaaatgttcagtaaaaaagttcagaatgctcaaaatgctcagtcacaaattcaggctgctgaaataaaattgttcagacagattggttattttcagtaaacggtgttgatttaaacagagatacctttttttcccgccaaggggaaaatccaggggccagatgaatcctgtgggcgtgcaccaaaagtcctggtgattcgatcgaccagatcaagagtacgaccaccaccaccatacttatgatgcttcattaattaatcacccattagtcctatctctttacgattgtactagtaataaataatcatccacggcttaataatgaataagtgcaaacgcttgttaggtcaggtgacgatgatatcctcctatatcatgatttagtatactccatgttgtagcttagcatgttcttcctggaccatgacatctaaattaactactagcttgatatccagctatccatgcatgcatcgattgtgccatttgtgcggttcctgcagacagacagactgaacatgtcctaactcttaaagaacaggttacaaaggggcagcagaaatgtc

SEQ ID NO: 18648 - DNA, 1501 bp, Oryza sativa
acagcgggcagcgtgacgcggcggcgaggacgacgacgcccaagcccgctctttgcgcggagaaggagagctaccgtctgggcagagagctaccgtctagattttttttatgtttgcgtgtgatcaaggctagacaaagagctagatggtagctctctgcctagggcccaacctcagcgccaagaaaaatggtgttgagacttaagacctcggcgccaaatcaagtggcgccgagctctgtaacttaaccgtgtgcttgcggccgacccaacatcccttttgtgttggccgtcaacttggcgctgagcctacaaacgtcagtgccaggagtaatggcgctgaggtcctcaatgccaaggcaacgcccaacataggagctatgttgggcgggcaggcctcgcgcggctgttgacagaaaatacgaggcctgggagatctgcttaactccagtgcaggtccaaagctcgccttcggatgtatgagcgtgccatttgatttgatattgcaatcaacaagaaatagaacaaagaaaccacaattaatcctataaatgataaccgatcggctaggtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgggatagatcggtcgccttgccgagacagtataaatcacttatatcgaaatatatattaatagtaggattatatacattcatagcatagccgatcaggtggatctagcatgtatctgctaatactccgatactactctatactaagattttaaagtaagtagaatatactaaacataagcttaatatacttagatgcgacaaaatcttaacataaagggcagatttaacatatagatcaagcatatagaataaaagtagttaaatcagataagatcggctgaaactctgatactaccctaatcagcaaccagaaagcaggctagagattgcaattttaagcacgacttaatagatcaaactcaactgatgcagcattaagtatgaaaagaaaaacaatatctggacaatcaagccactggaagtttcatagagtggtagatatatcacatagtctaagttaacatcattgtctaacctaatcggctgccttccattaacagatgttagccgattacagattagatgaagatattatcgaagattatgtgagatatatgataactcgacgaattatatagacaagattagagtgtcataaagatggaagcactaatcttgagaacataagtcgtcatgacaagctttacctcttgttgaagatcgaaaccgatgcagctcaacccgagagcacgaactcgtcgaaataaaagtaaagcataaagggtggcgatgcgccgagattgtattggatgtcttgttttttttacataggactcggg

SEQ ID NO: 18649 - DNA, 1501 bp, Oryza sativa
gacgttgcacagtgaaatttgtacggacagaaacatccattagcttttgattgtttgtcatcagttttcatctctgctcactgtcacacatgtacttcagagactagatgactaaaatagaatgctgaatgtacatatttatagcatgaaaacccttcggacaaaaagttactccttccgtcccaaaatataacaaccttgtattggatgggacacatcccagtacaacgaatctggacaggggtatgtctaaattcgttatattaggatgtgtcccattttatacaaggttactatattttgacatggagggagtacaagcatcagatggcatggcacgtatgtaacacaggcacaactatatataggtcacaaaacgtaagtccatgaaagagaggggtaaaaccgagttgcagactggttgtctgctctcggttgtgcctggcaaaaccacacccagattctactcaattctactcaaatcatttgcacaatattgagtttaacaatagaaaagctaaaatgtacgggaaaatcatttgcacattatgagttcaatttctagctttgtgactaactagcttggaaaaaaaatattttctgaaaaggtaaaatgtacgggaaaataatttgcacattatgagttcaataaaagaaaaggacgtcccgcaaaaaataaaagaaaaggacgagatcgatcagtgtctaagaaaagattaattggctaggtcgaaagatcgttgtatatacagtttgccctcggtcgtcagataccatatacaaatagggttgtggtttaaactagctatgtctggtaggcatcaggaacatcagcttgctaccccaggagcagagatgtaggtagcaagttaaatcctgctagcctgcatgatccgcaagggatgttctcaatttggaagcggcaattttgcggtatacaggaacacttccctaagcaagagtgtggtactgtggtatgtcatttagaaaaataaaaagttattgcttccagtttgttctaatcaaccaaactagtagcaaactgtgaaataattaacatatatcaggatttgctgaaagcacaatttaacatggatgatggatgacatttgcccacaagtcctctactgtgattccacatgtacgcttccaagtcagcccacgtgcacgattggggcgtgagccaaatctgacttggaaaatgcccaaatttggccagacctttcggtttgaaagggttgaaatggattgaagggtttgatagggaataatttcacaccacaataaattttgaaataaatcctctccaatccttctcggaacatagccttagccaaattgggggaagatcttagggtgggatcctgtgagaattaggagcccacgctgttttcggcgtaacaaataacgtgctggtccaacacaaattatgtacaaacaaactttataaattaaaaagttcatacataaaaggtgtgcataggaactacgcattcgtgtg

SEQ ID NO: 18650 - DNA, 1501 bp, Oryza sativa
agaaccgagaccatgataaccgccacaaccaccatgaacgcgatgatcgcgaacagcggatgccgggcgatactggtcccggacgccgccatgacgatgacgatgacggagatcggcgccggaacaacaatggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgccaggtgtagagctttcaaccgttcgctacgtgatgtccgacggcctgagagattccgactgggagcaatagagaaatacgatgggagtaccgacccagaagaattcctacaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccactcgatcgaagacgatctacacgcgttgacatagaatccaggcgaatctttgagggactatgttcggcgctttaatgagtgcagaaatacaatccctgaaatcaccgacgcctctgtgattcgcgctttcaaaaccggtgtcagagatcactatactacccaggagttggcaacaaggtggatcacaactactcgaagattgttcgagatcgtcgatcgatgcattcacgcagacgacgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcagacagacattctctgaaggattgcctagtcttccaaaagtcgttggaaaagcaactggcattagagaagggcaagcgagtacgtgtagtcgagaaggccgctgaggcaaccactcaggactcggactcggcacacccagattccgatctgcatgtctcgcacatgttcggaggttccacggtgtactcctcaaagcgagaatacaagaaagtggagcgtgaagattgttcgacatggcagggggctgcacaaaagatgaagtggtccgaacagaagattgagttctcagatgaggaccatcctaaggctgctgtcatcccaggacgatatccgatcgtggtcgagcctactattcggaatatcaaagtcgcgcgagttctcatagatggcggcagctccatcaacctcctcttcgccagcaccttggacgcgatgggaatcccatgaagcgagttgactcccaccga

SEQ ID NO: 18651 - DNA, 518 bp, Oryza sativa
gcagcttcgaaagatccgtttttcgtgaaagttaagccgacgtttgggaaagcgagcaaggcaagtcacatcatccttgaacatattgaatcccagtttgtaaaattatgttgatttaaattattgcattaccgctttatttaaattcccgcgttatcactgttttatctagccatacctacttacctttgttatgaccttattattcttgttattgatattattactttgttcaccctaggttaaacaaaaccccaactagtgagtactctatttatggttccactagtatgaatttaggtagatgcttcgctgattaattaggcaacattaggtggttttataactttagactttgggaattctcatatcatttggacactttggaattgattggattatggtggaattggacatacacctctcttcctctttcaaaacccctaaaacctgttttcggtggggtttgggtgcatgccagttatgggaagtagcaccccggccactataaggattaa

SEQ ID NO: 18652 - DNA, 249 bp, Oryza sativa
tgtacatctttacccagaagacacatctttactccgcattccatggccttggaacccgtcgtaaagatgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggaga

SEQ ID NO: 18653 - DNA, 214 bp, Oryza sativa
catgcactacactacataaacgatttttacaaaccgctgaaacacattttcacaaatggctagacgacctgccaagaggcgtttgcgaaaatagtattttatcaaatgggtggcacaactgcgtgcaaaatccgattttcacgggcggtcaagttaagccactcacctaaaaaaaacccacaaaattcaaaacctagcttcgattcaccctagc

SEQ ID NO: 18654 - DNA, 218 bp, Oryza sativa
gcgaatttaggcgacgtacccgtcgacacgtcctcgccagcgaggcaatggcagtggtaggttgtactgtgtaattctaaaaaaaaaagaaaaagactttttttttatttttagaagttctatttcttttttcaaatccaaatgaaagcaactattactccatggagtacatttgcaagtgaaaagcacacacatgtggaatcgaagcagaggtgaaa

SEQ ID NO: 18655 - DNA, 177 bp, Oryza sativa
ttattactcattttcacaattcattattcatcaatgttttcattattcagatattagaaagtattgatgatttgacactaataagatatctaattaagtggattcctgcccaaccttgggccgatggggagatttatctgtattctccagatacacatagttggtcttctcaaggca

SEQ ID NO: 18656 - DNA, 382 bp, Oryza sativa
atccaatccgtgaagatctttttgggggactaattctaatgcctaattactcctgtattgttctacccctagtaacaaattcttatagctcaccaaaatgaattattttaattgattcttaagaacaacagatggagatttcgtaataagctgagagctgcttcaatcttttacagaaactcttgtttgttgtaatcttgttttcaatctgctatgcacagacttgatttaataagattatggctttgtgcatcttttgatgcagagcctgtgagattttcttctatatctaaataatatctcaccaaaatgtttcaatgacccgattagtgatattgcgaccttccaaaggatcattttctctttttctttatcatctaca

SEQ ID NO: 18657 - DNA, 1501 bp, Oryza sativa
gtagaagctctcccgtccctccattcaagtactcccttggtcccatgtaaaaaaaaacaatatattctgataatctagataggtatacaatatagcataccctttaacctaaaaagaattaaatcctaagtacgaatctggataatgcttattcatgttaatagctatgatttaagttaagacatgtcttaaaaaaatatcattaactaaattattgattagaattatttacttgattataataataaaaataattttaaaaatagattcaacaaataacttctagcacgtggtctaagtaatgcagccgaagaaaatttgttaacaaaacttatttttaaacatgtgatgctggaaataatctatggcaataatttgatgaagtgttttattcacccattcattttacaacaagccacataaaaatttaaattttagaattgactcagagctttttctctatattttgtagccttgatttttggataactaattagaagttaaaaaaagtgtcgaagttaaaagtcttaccgtcattttttttgttgcttcattacttttttaggtttataacccatagctcaaccaataaataatttgttgcataacacaaatgttgtagtagtaggctggaatctccaaggcatggtactagtttcaattaaaccaacactagcttaaactatttcgattttaaatagtaatctgaagtcaaacgataatttagaataattctcttgtttctatacgggacccttagagcaagtataatagtagactataagccggctaaatgctgaggtggaggagagaagagaggagagagaagaagcgtgctataaaattatagccagcttggacacaagaaccaagaaactctgtgagagagttaagtgggccctgtattaattataaagagctaactattatatggataggctgagagaaagctacaaagaatcttatagccaacaggtcagcttaggcttgctcttaacatgccacctggtctgaaaattcccgtgccacaaaacggggaccttgtgtcccttttggtcccatgcatcgtcgttcttaacaagcaagatcacgttttggtcccctttcactaatcatgggaactaacaatcctgttgataagatgttcattaggccactgtttattcagcacggtttctattttataggtccttttccatgttcttgcatagccaaacttaattgataaatgagaataggccatgtgctaacacagagttctaaacaagacagcacggaaacaaagccagtttaagcgtgacaagacatgggagagagcagcacgtaacaacttctccaataataccccagtcctattttaaatacagttgtaggttgtgtctaatatttaatcatctatcttatttgaaaaatttataaaaatatattttaaaaaagtcacatataaaataatatttatattttatcatcaaataacaataaaaatattgatcatgaaaat

SEQ ID NO: 18658 - DNA, 1501 bp, Oryza sativa
ggaagattattacatcagttcatcagtttgcataatctgatggactctcccttcttcacacaaagcaaagtgatcagttgattaattagcatgatcgcatactagaagcttccatctgtgtacgtagttcagcagacagagtatctatgtacgttttgctgtgtccacatgtccaaagtagaagttaattacgatactcaagcaatgataatttattgtggtaataattagttagtggcattacatcaaatgtctccctgaatcaacggctacctgcaggacattctggatgaagaagagaggctacttgtttttgcccccactgacgagctagctagcatggtggtcactgtgttcaatgaaaaagaccaaaaagacaaaggtaataaggtaataaagtggaaaggattagaaagagctactagctattactctatatattctgttcacttgaggaattaggaaatgaaagccacactcaaagaatatatgtagctgtaaggtcagctgaccaaggacaatggctagctagaagtccagaacaaattgacaaaaaaaaaaggcgcaataccttcaatatagtagaagcaaaaacaaaaggagatgagtttgatctgaataaatatatgtaaaaaatgccattttttgggataaggcattgaataggaggatcaactctcccaaatgggagcgccactctcagcaaacgagcatgacagtatatataccacctccttttttttaatacacaatgtacttgaatttttctaatttatttaactattcgtatttttctaaaagtttttgtacaaatggacaaacatattaaatatgtttaaaatactttcgataaaagatctagtcatacccttttccaatttacatgtggtatatggttacactttgacgtatcttaacttacgtagttttgactaagttatccatacgtttgatttattgtcacatttatgacaatattttcttttcaacgtcttaaatccgcacctcattgtctaaaaaaaagattgtagtttgctagcaaaagtgtggtatcaaatttgactatctaactttaggcaatcttaaaaagaaaagctatggcatctctaggcaatgttagtattggaacccgtacgcaactaaataaataaatattattgatcaaagttcgagaaaaaaatcaattgtgtcatatatgaaaaaaaaatagaggttatatgtgtcaaacatgtaaaatcacagcacaatataatggcatatcgcgtaataaataaataaataatcccctaaaagagatgatgaagaaaagaaggccactccaactagagctaaatttacaacctcgcaaatacttcatccgtttcatattataagactttttagcattacccacatatatatgcctagattcattaacatatatatgaatgtggataatattagaaagtcttataacctggaacggaggtagtacgtatcaaaagtatagtagatcgtgtgc

SEQ ID NO: 18659 - DNA, 1501 bp, Oryza sativa
tctgtcctactactactactatttactaaaaaaaatagggtgcaacaaaaaattaattaattaatttattaacatgcatgtcacgttttcgcaccgctgatgaagcccaaacttaatttgcagcaaaggacatatatatatgtgtccagtgatgaagcccacaggtaaaggccttcttaatcttgagattacgccaagaacggcccatgtatcatatcgtcggctgtgttgctaagatgcttgcgtgctcactttcagcttggaaaaacgcaatgaacagttgccggggcctaggcttcgtccatccaccatggaatcacctacgtgagagcagtattgcagtaggttataccacacaacgaatttctgattaagataggttacataattaacataatcgttcaattaagatgcacattctatctcgattttcattagcatgtttttcaaatcaataaacagcttttttttaaaaaaaaaacttagtagcaccctatatcacccgttggttcccttagtcgacatgtatgaatcgacctatggtgggcgggacctcatgtaagacgctgggcctcaaagtatgggtcaaagcctaaatcatagagagtgatatccccatatacgaggagactagcttttgggatctttcttggtcaggctccgattaagctcttcttagtgaaataccatgggggtggtttttcccaaccaactaggtttatgtgaaaactttatatttgtaagttgccctaaaattttaaataaatttatttttaaagtctataaaaatttatactcacttaattatataataatggcttaactcgttttacatgggctaaaaaatcttcgtgtgctagtgagaatttgggtgaatagccaaaatggtccttcaagtttcatctgatgctcggtttagtccttgatgtttcaatctatctatattagtccttcaagttttcattttagttcaaacttatccttgaaccaacaactctcttcataaatgacatttataccctcatcattcacatctataagagaaaaattgcatgcttcaatttttttatagataatacatagtatattatgtaaaacgaaaaaaaattatgtactaacaagtgtatacgatagcaattgcttaagttttatgtgcacatgttgaaataatgggaagtatatctgtaatgttgtttattcatgttgcctttctcttttctagtatatagatatatacaaattaagggtaaaaaggacattttctaatagaaatattgatagaaatagccatatggcatattaagtgcacccaaggatgatttcaagtcaaaacaaatatttgaaggacctatgtggacaaaatgaaacgtgaagaaccaaattgagccttagctgaaacttgagggactaaattagctatttacccataagaatttcagtgtggttggtgtttttgaaatccatttcatgaaacaatagagatgcaagtgggtagtctcac

SEQ ID NO: 18660 - DNA, 1501 bp, Oryza sativa
aaattagatgtttgtttaaagaaaaagttagtgttgacagtcaaacttgatgttgacagtcaagatagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatctatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagtagcccccgagacctttgcagtcaaccatcgtagccttcccaaagataataatccgagtgcttcaaacttttcatgccaaggcctaccgagtagcgaagacgaagactgtaaagggcgaaaagataaagaatatggtgcatcgaatagatgcacctaattaggtgtagcccccaactatgtgattagttaacaaactaatcatatagttgagaacaaaataatagcataatcatgcatcatatgacaatagcatacgcggcgcctaaagaggcattcttgccgactgctttttagccataataaaagaaatccgagtggttaacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcacctcttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgctggcgaactagggttcaccactccactcaaatccaccttcgaaaaagtgcatcaaaatccttcccgtgatccaccgcctcaattcctcacctctcccaagccatccctcgaatcaaatcagcgcattcggggaaaatcga

SEQ ID NO: 18661 - DNA, 1501 bp, Oryza sativa
cggggatctgccctacctagctcgctttgccgatatggcaagtgtgggatgtaactaataactacccaattgtttcctagctagcagaagttactggctaaatgcagataatgtttttgtgttttggttacttctagatgtaagatatttttgtctgataaagtagtacatgttctcttattttcactgtttgtcctaataaaatataaaacgtgttttttttacacagtgcagggagtaaataaagcacaacatatcgagttatttgattgtttttctggcccatccgtctccagaaaaaaaaatcccattttataagaaagacaactcgtccacgtatatataatccattaagtgataaaataaacctgacctctgcatcaactaaacatatattcaaaggaaaaagaaagggaagaaacataagataatatgaatgtatcacgccctgaaacaacgccttcaataaggatccaaagtttgttcgctgatattgttcgaacctaccagaacaattggtattgaatttttatctagtgacatatctagaataacggcttcaacaaataattgacaaacgcttacattgtcaaagctagatatataaaccagataagggattgatcacctcgaagattcttgccaatggatcacgatgcaacctaccgcaaaatactccctccatcctaaatatttaacgccgttgatttttttaaacatgtttgaccattcgtcttattcaaaaaatttaagtaattattaatttttttctatcatttgattaattgttatatatacttttatgtatacatatagttttacatatttcacaaaagtttttgaataagacgaatggtcaaacatatttaaaaaagttaatgacgtcaaacatttagagaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacatatgggtataaatacaagaccctctaggaggagagggggacggaacaatagatcaagacacgaaacaataaatcaac

SEQ ID NO: 18662 - DNA, 1501 bp, Oryza sativa
atggagccaagatcgggcggaatccgctaaagccactggtaaatagttcgccatggccttgttgtctcctcctgctgcgcggattgcgagaccgtagacggtaagccatgattctgggttagtggtaccgtcgtacttctctattccagtcggcttgaagccggccggccaatccactcgacgcaggtcgtcggtgaaggctgctactccatcaaggtcgtcgttgtggcggtccggtgaaggatgatagcctcgagctgctcggcgttgtatgattgtgtcgcgaagatcgatggggcggcgacgaggtggtgagcgaggccgttccactcggcgctccctatattggtcgggaggtgagtgaatggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacggaacccattgcactgatcggcgaaaagcttgacgctacccctacctggcgc

SEQ ID NO: 18663 - DNA, 1501 bp, Oryza sativa
gataatttggaccatagattaatcatttaagcactaattaagtgaggatgaactatataaatatataggatatatcataaaacataataaaaatatacattgaaacattatgtgaattatattggatgataatttaacatgtttatatttgaaaagctcttaaattataaaaactataaagatatagcatgtttgtatgatgtttaaatgtgatgattgttagtagatgatgatgtggcatcttgttaattaatggattagtggatgatgatgtggcatctttgcatgcatgttaagtttaaggagttggtgggggataactttatagtaagataggattagtaaggcgctaatcacccgattaaagtcgtaacatactactccgtgattagccgcgcggaacacgtgctccggaacctggccaccggcacgcggattcccgcggcgaaaccgctcgtctccttctctcctcgcgcggtcgctctgaatttgtttgattttttttttttgcttcgattgcattttgaatttcgatatgatttgggtgcattttgcgatgggtttatgaaatttatgatgggggttacattttggcagaatgggcgttggttttagcagtggagtggagtgcctgcatccgcaaacacagcgacagcagcgtaagaacaaagcttcactgtcagagcgaaacaaaaatgtcgctaacctaatgttttggactttgtaaagggcatgttggtttagctcaacttatcccaaatcatgctaatttcaaccaaacaaagcccctactatattctaagccaaaaatgtcagaacaaaataatcacaacaaaagctcacatataaccaagcattaacttactacaattacgaaagcagttacgctatagtagaccgtaacattggcttccccaacacggtgatatcatgtactctctctgtcctaaaataactgcaaccatagtttttcgcgctcaactttaatcattcgtcttatttaaaaaattttaaaaaaaattaaaaaaattagtcacgagtaaagtactattcaggttttatcatcttataacaacaaaaatgctaattataaaaaaattttaaataagacggacgattaaagttgggcacggaaacttatggctgtacttaatttgggacggaggtagtaatactagtactaccaaaaagttcagaattcgaaaacccggtcagagagattttcttcgaaccatctgagaagaagtcaaaaacgggaaagttcatatggcgaaatttgcctctcccagctaaacgcacagataacaatttcgagcatttgactaatccataatttacaaataacctcctaaaaaatgcaaaataattccactttgccccctgcgctttaacttttttttccctctccgtttatataatccgcctcgccccattctccatcgtttcgtctcctctctctcttccaccaaatattcccacctcgcgcggctactctctctct

SEQ ID NO: 18664 - DNA, 1501 bp, Oryza sativa
gattgctcttagagcgattgggcattcagactgcttgctgatcaatgaatcctcctttcacctgtggctttgcgacagccggagaaagatgatcaaggaactccatcaggggttcgataccattgcaaccttggtagcgtggacagtttggaagaaaataaacaatagagtctttaatcagcagagcagaacttgggcggaggttgtaagggccatggcaggcgaatcagaactctggcgtttggccaaagcagtaattcctccattgatagttccaacggatggagcggggtcgccaaatttatctagagaataggcttttgatctttggttttctttatgtactctacctccctgttgttttcttttttcggtctgctttgtacataaactttattccttcttaataaaatggcacgctccttacgtattccaaaaattaaattgctaatataaattcagtctacatttcacacggaacaaaatctgtcccttaattaaaagattgcctccatttcttcaggtcagatgatgcaatctttagatgtgattttaaagttcggtttgaatcaaaatctccatgatctctcctagtatatctacctacagctacttcctcaagagtcaagccacgaccagagatcgtgcatacgttgatagctatatctgacagggttgaatctaagaggatatagatatagatgaaggtcgaacaggtggagatggaggtgttatcgcaggattggccgattgggttactgatggatgtgacggcgagcacagcccggcccggccgggtcgccgtcgccggtcgtcacaggtggttcaattctcccctgtcgcctactctctccgtgtaaaaaaaaaaaaaagacaaaccccttccgtgttcaacatttgaccgtccctcttatttaaaaaaatataaaaaagtaaaaagacaagtcacgcataaagtattaatcatgttttatcatctaataataatgaaaatactaattataaaaaaactcatataagacggacagtcaaacgttggacacaaaaatttagggtttgtttttttttttttatagaatggagggagtacgaggcgaggctacggatgatgacgcagcgcgcgtggcgcagtgggagcgattgcggcggtcacccggtgcgccccaacgcccgacactcggcgcgtcgctgagatagtatgatcttggcgtgtcatcgccggggatctgccctacctagctcgctttgccgatatggcaagtgtgggatgtaactaataactacccaattgtttcctagctagcagaagttactggctaaatgcagataatgtttttgtgttttggttacttctagatgtaagatatttttgtctgataaagtagtacatgttctcttattttcactgtttgtcctaataaaatataaaacgtgttttttttacacagtgcagggagtaaataaagcacaacatatcgagttatttgattgtttttctggc

SEQ ID NO: 18665 - DNA, 1501 bp, Oryza sativa
taacaaatatcccattcaattataggttctatattttgaaacggatgagtatattcaaggttcatcggacccacgtgtcagctgattgcttattcttatattataagacagatgaggacctgtttggtagaactctaactcctaaatttaacttcagaagttagttatggagtggagttgtggagctgcctaaacctagcttcacttctttagtttattttgtgagagagctacacctagcttcgcttctatttttggtggagctgaaactgtagatgtgcccggagtatattcagggttcatcggacccacgcgacagctgacggcttcaagggctctcgtgggaaattgagggtgctataaaagcagccgccatgagccacagccacacccgctgtgggaagggaagagccagagaggccacacacacacaagcacaacacaaaagtggccatggctctcctcctctcctaccccaggcgccacccatccatccacctcctcatcctctccgcctacgccctcttcctcctcccaatcttgggtgggtcttggttcttggatcatccacttcattgccatctatcagaaattgcttcttctttctgattttgtttctttgtttgtgatggatgtttttttgtggtgtctgattgttagatggattggagctgggaggagatgggctctacagggagatcctcagggatgagacggtgctcaggctcaaagaacttggcaaggtcaggttcttcatgtcgttggaatattcagttctttgatccactttttaaggggaatctcgtccggattgtatagattgtttgggctcctgcatgctgctacctctgtttgttgctaattcagatagcttcataattggaaatataaattaattctaggtgttatatgtggacagctattgacacccaaatgaccatatataggtttaaaaaaatatctgtggggttcatgtgtgtacacttctttgttcatcagatgaacagtgtaaatttcatttttaggatacaatttcactctttcctcggagagaatacaatttcattttgtataacttaccagtacagaccatatcaagacagctagctgcaggctactcgaaaattatgcaaaaggattgcaaatatattctaggcttctcatctcttcttttttggggtgaatttcattttactaggcgttaaagcatcaaacttttgtaaggcttttgttccttttctctattagttatgtttattggtcattccaaagaatcatatccatctcctgtattcgggtgagatgaccttacgctatgaaggttgctcaatttttacgttctccagttgaaatattaaatatatataaactgaacaaaatcctggtttcaaagatccgtgctgcaccttatttttactctattgcctaacagtttagccatgcagtcctaacacggcgtcgttttgtgtgaatcagatatctgatggggaaggttaccttg

SEQ ID NO: 18666 - DNA, 1501 bp, Oryza sativa
aggaaaaggaagagagcatcagttgtgattaactgttgcgtgatttcttctgcgttgttcttgtaaaacctttttagattcaaacttggtgactagtgtactgatagcaaggtataagattagattattcttagcttttctttttcaccccttttttcacgctcatgggatatcaggtggttgtacattctctggatcatcttgtgataatagttcatcatcccttattttgttaactccttcagaaatcacaatgctgttttatcgcgtcaccttgagacaaccttttctatgagcagcaggttgctttcatgataatagtttccagccaccatgaattcaatgatgaatcaaaagtggcctgtgaagatgatgattgcaaaaatctgttgaactcagcctttgtcagcatcatgctgtttacatgattatgacagatgtcaaccaaaattgggggcagcatgaaacggtgaagccgttgtgattgcatgcattttgtgttcaccttttcagttgatgcatctgttgctagtttggtgcggcacgtggttaactggttcctgcgctgctcagcgtgcgtaccaacgctcggtagcgaaactatgaaatctgaataaccaactagcatgatcagattaccgggaaaataaataatttaggatgtcttggtggaatatttcttcagggggtttgagagatttgtttatgtttgttggtttgatcgtttctcagaagtatgtgtttcttttggcgtgtcattttcgtaatcgtgtcacaggaatgaatttagaactaatgcaaaaaccgtgtcatgaattgacaggattgcattggagcaggataaaatgagtttatattatataatggatttgtgttgtttactgctcgtgaaacgtagaacatcagagtctctcactatagtctctacggttttcttttacccttcaaacgtgaaaatgcatgctcccgttctacagagtacagacgtctcaagcaaaaatgcacgtcactctccacaaatgtctgggttccctcaacaaatttcgctgggttatttcaggtttgtttggttctctaccattcctagccttgccattttatttggcaagatttggcaaggcaaaaaatttagggctgggctagtgccaaacttaaccaagccaaataagggacaaatttgagcaatgccaattatttggtaatgttaagaatggtgtagaaccaaacaaccccgtcaatccttcatgtacacagggccatggaagaaagcttcaattggccataaccaatatttgtctaaatatggtttaactggaatataatgagttaatgacataccgatatactattcagtattgtccataaagttcagtgattcatcagctatctctctgcaaagaagacatactgctgcctcaggatgattggatcccctataacccacaaatccacaatcaattcaagggtgctgatgatcataacatgttagtatactatattt

SEQ ID NO: 18667 - DNA, 1501 bp, Oryza sativa
ttatcttgctagtgtcacaacactagagttatcacatgtttctctgatttgtttgaacagcctgattgcaaacttaggtggtagtattaagctagattatctggttttataggaaattcggagatcttttttagctttccttttctattatgcatttttttaagctactcatatgtggcatagaacctattttttgacctataatttcccaagtatcacaagtaactctttgtttgtcttcatggctaatttaaagataacatttctgttatacagtcaaaagatccaaggttccatgctctacctctgacatcacaaagagttgcggccttctcagacacagtaaatgaactcgtctatgacgtgctcatatctaaagtccgacagcgtctcaatgaggttgctcgcctcccaatttggtcatcggtggaggaaccaggtggccttccccttccaagcttcagtgcctacccgcaggcatatgtgaccagtgttggggagtatctcctaactttaccccagcagttggagccacttgcagaaggtatctcaggcggtgaggctggcaacgaggaggctcagttctttgctactgaatggatatttaaggtaatatattcaaagcattttttttcatcatgctgtgtacattcgcaacataccatcgacaaaaccattcatacttcacactgcgactttcgcaaattccgtacagaagagttgaccatttagaactacatgcattgcaactgaatacaacattacataaaaccccaataatctgaccacaacataaacaccgaacccaaatcttttgatgaattaatctagaactgtctctgatctctgtttccatgatgaaccaggtcgcggaaggcgccaccgcgctgttcatggagcagctgcgagggatccattacatcaccgaccgaggcgcgcagcagctggcggcggacatagagtacctgagcaacgtcctctcggcgctgtccatgccgatcccacccttcctcgccaccttccacacctgcatctccaccccgagagaccaggtccgcgacctcatcaagtctgacggcggcagccagctcgacctccccaccgcccatctggtctgcaagatccggcgcatctcgtcatcagattagtgaaacacaaaggttgccttggtttgttcacgccctgtaacatcgtgtgcatccatccctccaccgttttcccacatcctgagcaaactgatcctgccgacgagtggttgacagtttgacatgtgcttgtaattctttaccattctgcatcttggctacagagttttgcctgtgtaatcgtattccttacagatagagaataatcattagtatatcatcatagaagaaaattctacactatgtgtaaattcgacgaggaaaaaaattcagtcggcaggtcgtgcaagggaaatggacggctctggctttgtttacccaataactaatgttggcagcaacttagtatgtcatat

SEQ ID NO: 18668 - DNA, 665 bp, Oryza sativa
gggtaagtataaaaaacattatatgtcataatataacaatgcattatattaattccaaataagtttaattttagaaattaatttataatgtcataaatgtttgattctaaatgtgcattttttgagtgattgtagatatgcaataggaaacaggtacatccaattgagataatcgaagaaatctggccaggtgctattgaagaaatttatgagcttagtttaaaatctgagtggctcatgacttgacttgtgaatggtgagagtgaaaatatcaggtaaatgcacagaactatctatgtgttgaaaaattctgcaggaactttcaacatagtacctacagatcttgatggcctaattacaactatgtgttttgtcccacctagcatcttgctatacccaatagcagttttcattgcaagtaatagtattcttgtgttctttttgtcacttaaaaattaaaattagttttggggctgattacaattgacttcttttagtacgtacaattgtattctttttatactacataagtgattttacatttaactgcatgtgccttttggggggcaacatacgatttgctttagtagcccttataaatgcttgtaggagtacgcagaagcacccataaatttgtttcagggtgccactaatttgaatggttc

SEQ ID NO: 18669 - DNA, 1501 bp, Oryza sativa
ggtcattcttgtccaccacgtgtcagtttaacaatctgcatgttcgcccttcttcatacaatatcttgcctgtaatggttaggatgaagcctggcatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgtggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggccccccccccccccccgagggggttaggccacgtgggtgatcgcgtctgcctcaagtctttaagtcatgatactcccggtcccatgtcaccgacacacccctaacccaaagaccaagaaaatatttattatcatattgtagtttggatcatcctaataaatataatgcatgtatctaatagaattaaagaacatgagagtggaggatttaaaaaagtaataatttaatgaagaaggggtcatagttaattgcctacatacatgcatgccttatattatggaacatctaaaaaaaagtggttgtgccttatattatggaatggagggagtattagagattatatttagactatttgtttttatgaaacttttttaaatatttaaaaagatcagttgcctgagtgttttgtaagcatttactttcgttcgttcatcgtagtttaacagttcaaaaattgttagtgggccgagtcaaaactattactgttaatagtttctgttagtagggacaagcatttatggtttttgagagggactaaaataagtccccctaaggaatagaaagaatgtgcggtttaataattgtcttatctgaccaatgtattcataatttgttaaaaaatatactcctatcctaaccacatgacagtaatctttttgaccaaatcacatatatttttatacataaaatgatttaaaagtttaaggtttgattgcatacacatcctgtttacattatatttgtcaagacaacaccgttttacactctacagcaacaaagttgatgctaaatcaatctattatactctatgctataatatactcccttcattttctaataaataacaccgttgattttttatatgacgtttgacaattcatgctattaaaaatatataaattttatttattttgttgtcacatgttttatgacttacaatttactccctccatccctaaatatatgacgttggttagttatattaaaaaacagagatagtagcatatttacaatattttttta

SEQ ID NO: 18670 - DNA, 1501 bp, Oryza sativa
tggaccgattcccttgacccgctgacgtgtggggcccgcctgtcggcgccggcctcacttgatgacgtcagcggcagcctttttcctttgaaaaattaaataataattgcgcaataaatcgagtttaattatagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagttttttctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttactgtttgcaaacaaatatgcatgttttgctaattacatggggtcagggttttacctatctgctcgcttgtgccatgtttacttgatatctgtcctttgtcatccttgggtaataaatcacctagcttgtgttactttgatgacctagctagaactttatgcttagccatgcttaattaccactagctcagttgatgggataattgcagtattagacctttttagtatcagagtgagctgcgtgctcgagacatctggccatgcttcatggtcgtaagtatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatacactgtagtttaggtgggttggttgggcctgttcaacgtggtgtagcgttgatcagtggagattcaatattactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaa

SEQ ID NO: 18671 - DNA, 1501 bp, Oryza sativa
gtaggaggcggcgcgggaagcccacagcaacctggaggcggccatggccatgatcggacgacgaggtcgcggaggaatggattggaattggattattgctcctctcctcctcggcgccgcactctgtctgtctctctctctcctctgatctctctctctctctcttcttttctctgcgggttctgggtttggtggctcctttctctcttttttttttctttttttttggcaaaaatataagcaagatgcagaaaaggttggtagtgcaggttgcaaattgaagaaaaaaattttttggtgggctcttggccttagtggggcactttcctacatttttttgtgtttgcagttatacccttaatattctctatgatttaggaaaaagtatcattcaaaaaaatggcaaccatttttcgagccatatctggtttacttttcgcaatcatagaaaagatttatatcacttacgaagtataaactgtttgtaaaacgcctgtgtttcaaaggggaagttaggaggtctcaactctgatggacatattcacaagggcgaatatattgcagatattgagaaatatttacaaaaatactaactaggttagggatgaaaatgtcaaataacactacagttgttacagtgcgtgttgaaccacaatgaggaaggatcatttattaaagaagattaagcatcagatgctgtatcgccaagaggggccattggttgcaaaaccaaaagctctgatgagaaaaaaatgtgatcaccaaactgattggaacgctgtctgtcagggaggccctaaccaacaacttactaccaaccaaacccacaaatcagatgagttctctgtttcttaatctgctgtctgcttggccatcacgggcttggagatgtgtactagtatatggcctaggaattcgtgcgtgagtaattaacaatctggcatggtgctgttgatgggcctgatggcgagtacaaatactgtgtgactctgaatctgatctctgatgccaatgaggggttggtggctgatgcagacagagtgcagctaggcacaacagcggcaacaattggttctagtgggcagtacgtcggttcctaaataattttatttatttatttgcccatcccacgaactagtagtatatcagtataaaagaaaaaaaaagagagtataatatcttaattttatcaaatcctagaataattgttttcattttatctatttctaatatatttgttcccaaatttataaactccaatacaataattacttaaaattaggtttattttgaaagaggacaaaaataatttttttttaaaaaagtgtattgtacttgctcttagcgagattaatcactccgttcttattatttggcgtctttaatattttctcgatttccaaatgctatatatattcatcctattactaaaacatgatcatttttacccttttttgttcttaaaataagtttatatgattatttttactttttttaaaaa

SEQ ID NO: 18672 - DNA, 1501 bp, Oryza sativa
aaagtatgcaatttgctcgcgaaaaaaattccagctgcattgcgccctaaccacctgacacgtgtccccgctccccgacatttaaactgtcgcgcctgccacccctaccctcgttgtataccaaacggcaatacgcgcctctctctctctctctctctctctctctctcccctccttcccttccctctctctctctcctcaattccccattccaccaacgcacgcaccaacccgccattccctcccaaaaccaaatcccccgtcgacgcgagaggaatccaatcctccgaatcgtctcccaatcccgcgcgccggtgagctcccgttccgatcccgcctcagttttttttttcattttttttgcgctttatttggtgatccagcgcgcgagcgagcgagcgagcgaggcgatgatttttggtgttttttttggatggggagcatggagttcatggatgggatcgacggcgttcgtcgtcgcgtctagtctcgtggtggttcggcgaatgcggttgcggctgctgtttgtttgttgcgggtggtctcgctggacgcggaggcgtgcgcatgacgctatggtgttttggtgtgtgggcatctggttccgtgacgcggcgatgctgctgctgctgggttggggtgaccattcaatttgtgtggctatcggattctgcgtttttttttttgggttgtgtatgcgttgcttcatcatgcaggcatgcggttgtttactgcctccaatcccatggtcgatttcatgattccggtacttgttagtgtcgtgggattgtgcatacatgtgattttgaggtgcgttgcggtggaaggcagtgatcatgatttataaggtgtcatgcgcctgtggagtggaagtagtttttgtcaattcggtcgtaatatgaatagttcggtgtaacatggttgagaaatttcagagggttgtgtatacagtgcctctggagttgattctgctgatttgtttctggggtgaattgccccggttatatgtgcttcatgcgtctctgatgattggtttggttgtgttgtggtttgatcatgaaccctgtttgcttcttttttgggtgatgagttcagcatgcagttctggggtgacttatcctgtaactgtgattgaagcaattatttctgtcacttttcagtgattactccatgttgttgctatgagctcaaattgaatgcatagttggttgtagaagcgcggatgcttttcgcatctattacgatgcaatcagaacatattcttattgtttgctcacttcttttctttttttgtttttgttttggcaacgttcccattcctaattatttgatggcttctaactgttcaaaattccatcaccctctatgtcaaccctgaacaaaatgcagattggcacattggatttccttttgctttaaggaagttatcctattgcatataattttcatatttgttgctcccagtgtagatcgacagatacaattgctaattagtacaaaa

SEQ ID NO: 18673 - DNA, 1501 bp, Oryza sativa
acactcaggcaactgatctttttaaatatttaaaaaagtttcataaaaacaaatagtctaaatataatctctaatactccctccattccataatataaggcacaaccacttttttttagatgttccataatataaggcatgcatgtatgtaggcaattaactatgaccccttcttcattaaattattacttttttaaatcctccactctcatgttctttaattctattagatacatgcattatatttattaggatgatccaaactacaatatgataataaatattttcttggtctttgggttaggggtgtgtcggtgacatgggaccgggagtatcatgacttaaagacttgaggcagacgcgatcacccacgtggcctaaccccctcggggggggggggggggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccacatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaacgatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggacccccacgctccgtcatctggcgcgccaggtagggggttctgtgtgtgttcttctaagctctcgcactctttcgtgtgcgccaagcttttcctgttcagcccaa

SEQ ID NO: 18674 - DNA, 1501 bp, Oryza sativa
agttaccagtttctgggtaggaattgatgaacatcatcatctcttcaccagtcaggccagaaaatatacaaattcttggcattgactttgcaatctgccaattgaaaatgagtgttaaccgttaacaagtgctcaatatcctgatctaaggtcagagattaattgattggcatttggtatctgtaacatcagcacaatagtgatgtgtcagctgttagcagattaagactgaaaagaaacgtgaaaataatgagaatgaatgattcagaccttgacagcttctatactaggttgctcagtgtgcatggcatcccacaacgtttgctttgtcatttcttctgtacaatgaatcacctgaaacaaagccatatgagcatataactgacctttcagattatccatagattcatataagcatggttgcatttcgtcctttgaatgatgcacttgcacgctatgaattttctccctgaatttcatcttagatgattcttgccgatgagactaaagctgagtccccatattttatcccttcttctagcttctatttgctctcatcagaagtcagaagatacatttttgttcaagtttactacatgcgcaagaacaaataggaaaaactgttctatgttttgatgtcataaaaaccaatatcattacatgcgaatggcatcagacaactattttataccttgagaaattctccgtcaagctctctcaggaactcctgaacctgcacgaattatgcatttcaggtaagcttatcgaacattcagaacaacaagaagcacacacaccaaacatacaaatcaatgcaccatatgtctggtaatttcagacaaacaggaccgttctgttctgcgtgaacagttcattgactgcgtatttaccttgttggtttcgccttcctcgaatccgatgagcaacagcgcctgacgaacacaaccaattcagatggagatcagcacagaagcagcaaatagcaaggaagaggagccgcagctagcaactcaccggcggtccgtacatgggatcctcggcgttcagcggcacgaacttggagtcctcctcctcctccatgagttcgccggggacccctgcggcggacgtccatcagatcaacgcaaccaaaccaatcagctaaccgtggatgcatccgcaccttcgggaggcggcgacgatcggagcagccgccaccttctccccctcctccgctgcggcgccaagacgcaagcggaggcgcgcggagatcgagatcgagggagtaagatggtggcggaacggcggaggaggaggagtacgggggtggctgcggccatggccatcgtcgccggcgccggcggtgaggacgacgacgaggggagctatcctcctctgtgtggtctccgcttcgtcggcgttttcccgccaccaccacgcaatctcagccgtccgatcaccatcctgcgtctgagagtggaggaggcagagcctgcgagaaatcgcgcggttcgtgttgggc

SEQ ID NO: 18675 - DNA, 1501 bp, Oryza sativa
tatgatcatcagcacccttgaattgattgtggatttgtgggttataggggatccaatcatcctgaggcagcagtatgtcttctttgcagagagatagctgatgaatcactgaactttatggacaatactgaatagtatatcggtatgtcattaactcattatattccagttaaaccatatttagacaaatattggttatggccaattgaagctttcttccatggccctgtgtacatgaaggattgacggggttgtttggttctacaccattcttaacattaccaaataattggcattgctcaaatttgtcccttatttggcttggttaagtttggcactagcccagccctaaattttttgccttgccaaatcttgccaaataaaatggcaaggctaggaatggtagagaaccaaacaaacctgaaataacccagcgaaatttgttgagggaacccagacatttgtggagagtgacgtgcatttttgcttgagacgtctgtactctgtagaacgggagcatgcattttcacgtttgaagggtaaaagaaaaccgtagagactatagtgagagactctgatgttctacgtttcacgagcagtaaacaacacaaatccattatataatataaactcattttatcctgctccaatgcaatcctgtcaattcatgacacggtttttgcattagttctaaattcattcctgtgacacgattacgaaaatgacacgccaaaagaaacacatacttctgagaaacgatcaaaccaacaaacataaacaaatctctcaaaccccctgaagaaatattccaccaagacatcctaaattatttattttcccggtaatctgatcatgctagttggttattcagatttcatagtttcgctaccgagcgttggtacgcacgctgagcagcgcaggaaccagttaaccacgtgccgcaccaaactagcaacagatgcatcaactgaaaaggtgaacacaaaatgcatgcaatcacaacggcttcaccgtttcatgctgcccccaattttggttgacatctgtcataatcatgtaaacagcatgatgctgacaaaggctgagttcaacagatttttgcaatcatcatcttcacaggccacttttgattcatcattgaattcatggtggctggaaactattatcatgaaagcaacctgctgctcatagaaaaggttgtctcaaggtgacgcgataaaacagcattgtgatttctgaaggagttaacaaaataagggatgatgaactattatcacaagatgatccagagaatgtacaaccacctgatatcccatgagcgtgaaaaaaggggtgaaaaagaaaagctaagaataatctaatcttataccttgctatcagtacactagtcaccaagtttgaatctaaaaaggttttacaagaacaacgcagaagaaatcacgcaacagttaatcacaactgatgctctcttccttttccttttcttcctcttttttttctt

SEQ ID NO: 18676 - DNA, 1501 bp, Oryza sativa
tggaaataggaaaaagttactactcgcaggcaatcgagacccagttttgtaccagcttatacggagtagttctgaattgaacagaggctgcgtgttttgttgacagtttgaagagaaaataatggtgaattacagattactaacttgtaagctatctgtactagtgctactccacacagagatagcgtgttttgtttgacataactttaactcgcttatttttagttggattttcttatggccttttttttaggcttttaagtctttttttcaatgatctataagtcggtggataaagttttaagtttaagggtgaagttatacatctactttacattaaaaaaaacttctccaatttagtttgtggcttaatagtgtaagagtgacttataagttataactttgaaaagccaaacgaaaaacctatttttttgctttggattataagtttaaacaaagagaacgttaacgctagaaatccttaaaagttgagccgatggtagatcaaagtaattgagacatttgttttgttagagacgagacattttgtttatatcatagataaaaataacttttatttcatatataaattcattcatagtaagaatctcacaaacttgaagcaatacaaaagagggtcacgtagaaaaatcatcggcattatcttttcgcttatgcttatacttattagccaaaaataaaattttcaacttaaatttggagttgttttgtcgaagtttattttccagcctttgcttttagatcactaagaatacacatataaaaaaatattcacaaattattttccgtttacaaatatgccatttggcttattcccatgataagcaaaaacgatggcgccgcatttctcacaaacttctcagacttcaaccaatcttgcatgttgtttagttttgggcccaaaatttaggcccaattatggccttgttttggccggcccatgaacaacccaggcctgcctccgagggaagagaaaaaacgctacacagagtagtcaaccaacctgcactgtaccacacaggacacgttccaccgcagcagcacaaacaaatcattccgtgtgacactacgtgggacgtgccagacctgcacaaaacccaacccaaacccaaccaactccacccctctctctactgacacgtgggccctccacgtcagcctcacccccctcttgtggccagcaacgaagcgccccgaagtataaagaaacatccacatcgcgcacagcacagcgtcgcgtttcgcattcttattttctcttcgcttcgtcccccgcatcgacacgcacgcacaccagcagcacaagcacccaaaccctagctcgcggccgcggcgaatcctgcgcgcgcgagagagaccccggctgatggtttcgatgagcgcgacgcccaatccgatcgatgcctccgtcgtctccgccgccgccgccgtcgcgggcggcgggggaggtggggatgggggagggggaggaggagggaag

SEQ ID NO: 18677 - DNA, 1501 bp, Oryza sativa
aacaacaagtagcagctcattaattttgacaacacatgatctgcaagcttccaaagttcatttatatgatcccagttaagtgtaataaatttcacagtttacataggacaatcgagttaccagtttctgggtaggaattgatgaacatcatcatctcttcaccagtcaggccagaaaatatacaaattcttggcattgactttgcaatctgccaattgaaaatgagtgttaaccgttaacaagtgctcaatatcctgatctaaggtcagagattaattgattggcatttggtatctgtaacatcagcacaatagtgatgtgtcagctgttagcagattaagactgaaaagaaacgtgaaaataatgagaatgaatgattcagaccttgacagcttctatactaggttgctcagtgtgcatggcatcccacaacgtttgctttgtcatttcttctgtacaatgaatcacctgaaacaaagccatatgagcatataactgacctttcagattatccatagattcatataagcatggttgcatttcgtcctttgaatgatgcacttgcacgctatgaattttctccctgaatttcatcttagatgattcttgccgatgagactaaagctgagtccccatattttatcccttcttctagcttctatttgctctcatcagaagtcagaagatacatttttgttcaagtttactacatgcgcaagaacaaataggaaaaactgttctatgttttgatgtcataaaaaccaatatcattacatgcgaatggcatcagacaactattttataccttgagaaattctccgtcaagctctctcaggaactcctgaacctgcacgaattatgcatttcaggtaagcttatcgaacattcagaacaacaagaagcacacacaccaaacatacaaatcaatgcaccatatgtctggtaatttcagacaaacaggaccgttctgttctgcgtgaacagttcattgactgcgtatttaccttgttggtttcgccttcctcgaatccgatgagcaacagcgcctgacgaacacaaccaattcagatggagatcagcacagaagcagcaaatagcaaggaagaggagccgcagctagcaactcaccggcggtccgtacatgggatcctcggcgttcagcggcacgaacttggagtcctcctcctcctccatgagttcgccggggacccctgcggcggacgtccatcagatcaacgcaaccaaaccaatcagctaaccgtggatgcatccgcaccttcgggaggcggcgacgatcggagcagccgccaccttctccccctcctccgctgcggcgccaagacgcaagcggaggcgcgcggagatcgagatcgagggagtaagatggtggcggaacggcggaggaggaggagtacgggggtggctgcggccatggccatcgtcgccggcgccggcggtgaggacgacgacgaggggagctatcctcctctgtgtggtctcc

SEQ ID NO: 18678 - DNA, 1501 bp, Oryza sativa
caatatttctagttatccatgttcattccacattgcatggtcatacaatatgaccatgtcaaaccaataaaccaaataaacaaacttcttaaggaaaaatccaggaatgataaatgtgttcccagttaactccctcataaagaataaaagaaagctagagaaaactgaaaacatcattaacagattggaaataagacaatcaaattctctgtgtaaattctacaatattgatcaataattgaacctgatcaagaatatgttattcagcaattgtaaaggacaaaaataaaaatcataagggactgacctgaaatatctgaaagacttccgttctgacaattgtgtgaaagcacatctttgcttcttctttggtttgtgcgtcttgaaatcttatacaaactataacttccattgtcttttgccagatcagcaccctcctcaacatcaacggccaacacagtagctcctttactcagagcatatctagaaatttgctaagggaagacaaaatttacaagatactatgtgccaatgtgaatttcatgatcctacacatagactgacaggaataaatggaattttgagaaactgcccaggagaaattcattgcctcatgtttgaatgcagaacacattaccgagcatactgatgaaggtatcaagatatcaagctatgtacataaaccagctgtatatcccactagttttgcatgtatgtgcatagttctgtatgctttgactagtcagataatagagttataatgatctgagaaacgttttgtggtaggatactctcttatcccaagcacactattgtgattctccatcgtgtacatgtaacagctttctctactccatggaaaacattcaccaacaagtttcagagctgctgttgccccagaggtaaatatgcacttgtattctctgggagatgcattgaagtattttaaaacctgtgaaaaacaggtcaacatcactacaaagaaattagcagatggcaaaacttgtaccatgcgcataactggatatagtaaagatgtagctgtgcaggcaccctgttgtagtaccttggaatcaaaacaattcatgcaacttcctggggcacaaatcattgtacgtagtagtagataagaaagtagcaataactagggcgtaaaatggaaaaaaaatggatgcaggatgactcatcatgcaatgtgccaatgctgagcattggcatagactgatagagcttaaatactattgccatgaggcagcctaaattcactattctcccgaagtaactgttctggaaaactagcacacaatacctgatggcgtgcagcagtaacgaggtcactcgcagccatgcttgaatcactctgactatctaataagcatgtcaaagaacacatccccaagaatctgcagtgcaatgttctaccaaggtaacaacaatgaagtgtccagaacactgtctcaaagtctaaggatacgtgggttcccatatacattggatgcaa

SEQ ID NO: 18679 - DNA, 1501 bp, Oryza sativa
aaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcggacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtacggcttcctcaccttcctcgcctcctcccccaccgccgccgccggtgcaggcacggccatcggcggctgcagcggcgcagccaccacctgcttctccttctccttccctcctcctccccctcccccatccccacctcccccgccgcccgcgacggcggcggcggcggagacgacggaggcatcgatcggattgggcgtcgcgctcatcgaaaccatcagccggggtctctctcgcgcgcgcaggattcgccgcggccgcgagctagggtttgggtgcttgtgctgctggtgtgcgtgcgtgtcgatgcgggggacgaagcgaagagaaaataagaatgcgaaa

SEQ ID NO: 18680 - DNA, 1501 bp, Oryza sativa
cacgtgttaatgggattgctccgttttcaatgttattttcgggttggaaaccagcatatacggacacaccctaagttattatacaatagttattttcagctattttatcggatggttggcttatttactccacatctatacaaagtatgttttttttttcaaaatttcttctaatacagtgcttagcccactaattctaaactatttgttaggtttatttgttaaaacatttaatttattgtaataataaaaatagatattatacgacaataatacgattaatatgttttgaacatgtcataaagatggcatgaaattacattgaatgatttctatgtattatgtgagatttcagagtacttgacaaatctccaattaaatgcactgtagctggtacaatactctattaagtttcagatcaaatacttatacgaatagtcctgcatttttgcagttaattttcactgatatttgtacatgaaagatatattttttttcaagtacatctgaaatctgaagagtagcgatgaagaaacaaaacaggtcaaaccatgtgagaccagcaaagatacaaaacagcacgtcatgcatattgacaaggaggaggaaaagaaaagagatagagaggaaaggaaaaaaagagtagtactagtatagtagagctacatacataaatgtccctttttcttttctttctaggtaagaaaggtgtagagagcaagaaaagaagaagaaaaaaagagatttaaaatggaacaaaagggcacaaaaacagtcaccaccaccactcccaaatccctctcagaaattaggacttgtagagcccatctctgagcccctgccttgctggccctgaacctctctctcttcctggttgcttcttttgcagttttttttttcccttcctcctctcttgattgtgttgtgcagtttgtttgtgtagtggaggaggagataaaaaagataccctgatctatctgttcatcgaggctgtctgcaagatttggcaggagaggtaggcagggggggagaagcgaaaaagcgcatctttttttagtcgtcttggttcagtttcctggttgcttcttttggatcctggagaggagaggaggagcccaccgtttctccaccaaaaacccaatccttgctgcttcctccgagcttgagatcgattggttccttccagatctaaggccacccctttcggctgcgagatcgatcgcgcaggaatctcgaagctaatcctagaaagaaagagagaaaaaaaaggcgagttatttttcgcttctttctccttatgttccaaaatgcaagtagagtagggttgtctcgttgatccttctccctctgatgatcatatggtttgtggttcttgatcctgggatgcgtgtttgtttggatgcaattgcaggtttcgcgaagaaacgagaggaggagagggaaggtaaaggaatgggctttgtgaggaagtgggcgatggggaggtgtcggagatgaagga

SEQ ID NO: 18681 - DNA, 1501 bp, Oryza sativa
tcatcccatcccacttagtcccgaaaccaaacatatgctaagaaaatttttatcataagacacattttttttcgttgacattaatcagatcaaaattaaattactagttttctggcatttacgatagaacgctgcgaaatcacgtcactgccaacgggacaaatggggcgtgcgtgtccttgaatgttgcaatttgcaaatcaattttgacgcacttgataagcatatgtgtgagacgtgcacgcagcacgccgtaggtggcgcatgtggcatacgtgtttgcatgtccttttacatgtttaagaaacagtttcaacgtcattaatctacggaagcgtcctgtaggtggtcagaaataaaccgaaaaactataaggaataataattgaacattttttttcgtttatttagttttctttcttaagtgctcccttcgtttataattaatactataaaacacttaactttttttaacgaataagatgttaaatatttttaacgtagtttctttttaagtattgacttttaataatttttaataaattatttttattttctagtaaaccgttttgatttattacagaatatgagcaatcgatgatgatgacctaaattttagtcaagcctaaaatttaattaaagaaaaaaaattaaagtgtatagtactccacgctgtgttcggagtctagtgatgggagcgcgtgattaattaagtattagctatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctg

SEQ ID NO: 18682 - DNA, 1501 bp, Oryza sativa
acctctagccgccgccctagccactgccgcgccgcgccgtttgcaccgccggcttctccgtgcctcgccgcaccccggcctctgctccgtttccccatttaatcgccgcaaccacccttccaccgtgcatcccaagccacctccaccctacgccgccgggccgccgttccgccttcgtcccgaggagcgctgacgccgagcttccccgcctttccccgcccctcgtcgtcgcgtccttggtgagctcctcctctccctccttgcctccctcctctgtctcccgtgcgtgctgccgcgccggtggccgccgccggcgaccaccgggccgtgcgccgccgccgttaggtcggccggccggcttgtcgccgccccgctcgcctaggccgcccggatccccttgccgcgccgcaccgccgctttcccgcgtgcgtcggccgtcgccgcaggaggccgcgccgccgtgagccgtcgctcagccgggccggcctgagccgtgctcgtgctcagccgcgccaccccgtggcagcccgatcagctcgggctgatctgggccgtcggttcccgtggaccggcgatggaccaccccgtggtcccagtccacggtggaccactcccttgcccgctgtcgtgtggggcccgcctgtcggcgccgctgccctttgatgacgccagcaggagccttttcctttgataaaataattaacaattgcacaataattcgttaataattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgcctgcgtgtagaatccgtcgtttcggaagatcacggtcgcaggataagagttcggaagattgtttgaagaagcaaggcaagtcacacattccccttgagcatgttgatcccaatttgcaaatgttttactgtttgcaaataaatatgcatattttgctaattacatggggtcagggttttacctatctgctcgcttgtgccatatttacttgatatatgtcctttgtcaacattgggtaataaatcgactagctcatgttacttatgtgacctagctagaactatatgcttagccatgcttaattaccattagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtggacaacggctgggcttgtagtgtagctttcctctagtcgacgcatccaggcaagggtgggcgtga

SEQ ID NO: 18683 - DNA, 450 bp, Oryza sativa
cgtgctgtaacgcccgattttcgttcgggattaaaaatcatttaataatgcattttctagaaattaaataaaagttaaaccaatttaatcaagtggaattatggagtaaattaaaatttcctttaaaaatcattggccgagaatattctgtaatattctttgtgccctaatgtactctctagaattttccgtgaattttcggagctcaagaaataattttaaaagcaccaagttcattttaaccaactaaataaaaagaaaaacaattaaaatcccccttcctctctttgggctattttcggcccaagtcttccttctctcccgtggcccgcgcgccccttttctctccctctcgagccggcctcctccctcggcccgctcggctctctctcttcctcaagtctgctttacttccctcgcccgttttcctctctctctctccccgacagg

SEQ ID NO: 18684 - DNA, 1501 bp, Oryza sativa
ggctaagcactgtattagaagaaattttgaaaaaaaaaacatactttgtatagatgtggagtaaataagccaaccatccgataaaatagctgaaaataactattgtataataacttagggtgtgtccgtatatgctggtttccaacccgaaaataacattgaaaacggagcaatcccattaacacgtgattaattaagtatttgctattttttaaaaaatggattaatatattttttaagcaactttcgtatagaaactttttataaaaaatacaccgtttaatagtttgaaaagcgtgcgcgcgaaaaacaagaaatatgggatgggaaaaaggggtgctgaacacgcccttagtgatgcgccttgcttaactgacagtggctaattaacttatttaaaccaccagccaagctccatgcacggatggatcgatcgaacatggcgtccaaattggcgcggcgacgttcggagaaatttcatgggatttggacgctagccgagccgaggagcaggaggagaagatttatcgattaaacaatggtgacccaacgcattcagcctgcctgccaattgtatgaggtgacgcggacgaaacgcaactcggcgcggcgcgcgacacacatggcgttgccgtggcggcgagcgcgatgccacggcgaacgcggcgcgcatgcgtgcgccacgccacgccacggcgatcggcgccgacgacgacttctctcgctcgtcgctacggaacaacggatatgatgacatgtactagtactatctgcattctgtgcttcagcctgaagactcccatttgggcctccggatggattcacattctcgtggtgttcgaatggcagggtttacattaccggttgagcactaaattttgagccccgtcggtattacggttttcgataaatttcgactaatttactatttaacctttgaaattctaatcgaaaactaattccgagctcgaaaaccgaccggctttcgtcggctctgttaaccctgtcgtatgatacatttatgctgagttgtaaactttgatttcaatgtacaaccttactgtgtttcagtccaaaacggttaaacggtgtgttttgtaaaaaaaattatatagtatattttaaaaaaacaaataaatatacttttacaaatttaatagttaatatttaattaattatatgctaatgagtcatcctattttacttatagttaacacgcttctccaataaagagtttcaaacggggtcttagagatttaatcaaagaggaaaaacgtaattttggttgtgtgtcatttcgtggacgggtcaagagatacgaggaatggaacggacggtggtgccattacgcgttttagtgactagtgagtatatcttggcatggggtttgggctgtgtttagatccaaattttaaatccaaactttagtactttttcatcacatcaacctgtcatacactcacaacttttcagtcacatcatcttcagttttaaccaaaat

SEQ ID NO: 18685 - DNA, 1501 bp, Oryza sativa
ttcaaaatttataatgattaatatttaattaatcatgtcgtgataaactatcccattttgcagcagagctatttagcacaaccaaaaatctcaaatgaaccagagagatttaagtggtaaaaattaaagtcgtaaaaccagagagtaaacaaaaagggggtaaattagagcacaatactaaaaaaaaagggcatagtctcaaatgtctttatcataaacatatttatattctttctgtagaccccgtctatatattgtaaattatcctctatcttttcttttcaaaatcagcacatttttttaagagaaacggattccagcacgttttttcagttcctaaatgactttttttttccttttgagaaacacctaaaagagacctggaaactggaaagtgctactcctactaccaaggttgtcagtatcccgatttgtatcctagtatcttacgatactacgatcctaccaagccgaaacgataccgatcccacctaatatcctaattttcataatatctcgatcttactattcattactacacgatcctacgaaatcttaggtggtatcccgattctacgatctctacgatactacaaaatattatttaaaatatcttggtttgaaaataatgtaaataaatatgctcaaatttatataaaaatcagttaaatatatcaaaaccaatgtggtttctcttgataaaggtctctatttgcatgacatatatcgttactatattttttttatatagaatgtctatatataattaatataaatattaattaaacttaaaaaagaaaatatcatagtatcccgatactatgatacgattctataatatgatattactttaagcaaaacgatactgtctggtatcccgatcctgacaaccttgtctactggagtacatgcttgcaaggaaagagatcgaggcgtggaaggaaagggattaaacaaaaagattaatccatccaggcacgcaggatccgagtcagtcaacgcattccaagggagggccgagtcagcagcatcctccggcgatctcgctcgccgctcgctttcatcatcatgtcccttctcacacgccgttgcatggatatatatatattttttgcctcacgcgcgcgttaacctcgccttcactctggtcgtgtttccgtttgttttccatcccatttctcgttcatcctctccctgtcaattgtcgcgagtcttctccttttttttttcgtttttttatatatagaaacaaaaaaaccccgcaatatctcctccattcttggattcacctcaacctcaaccagctcgcgaatttacagccttttgatcaatttacttcctcctccttctcctttataagccccgacctggtgctcgtcttcctcctcgtcttgctagttttgcaccggagaaaaattcattgccttcttctgaatctcttcttcctccgaggagagcatttcttgctttggtttgtgttttcttgggtgtgtcaggcaca

SEQ ID NO: 18686 - DNA, 1501 bp, Oryza sativa
cccgccaccctcgctgacgggtggggcccacccgtcatcccctacctcccgccgctcccgccgcctcgcccgtgccctagcgccgccgccgccgcaaatcccgccgctcccgtccgccccgcgtgcaatcaagaggggggaaatattccccgtgattccctccctctttccccccacttttccctctctctctccatcggattcgttcgggatcttttcccctaaacctcgccggcgcatcaatggcggccggatcttccgcggccgtttccccctcatccggccgctctctccccctcccaaccctatataaacactccccgtgcctccctccgccgtttccgaccctcgccgctctctctctccgccggaatcgagctcgcgccgtcgctctctctctccgccattgccgccgagctccggtccgccgccgtcgtcgccccggaccttctcccgcttcggcgtcgccttcttcgggttcgccgcaacctcgccgacctcgtccacctctccgtttcgttcgccgaccgccggaaccccgccgtccccatcgacccgtgccgcgccgccgccttcctccgctccggtcgccgttcccgtcgtcgccgtcgacccggggtgagccgtggactgccgattcgcttcccccttccctcccctctttcgggcgccgctccgccgcgccggtggtcgccggcggcgaccataggggcgcgggtgcaccgcctcccgtcggctgtgccggcgtggccgccttcgggcgcgcccctcggctgccatgtggggcccggccgtcagccgcccgcgccctcgggtgcggctgacgcatgggacccacggcgccggccggtgtgagccgggtgcgcccggtccaccgtggaccgtgaggctgccgcgtgggccccactcccgtggacccggtccgcccgccctctcccctcggctgacggaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcattgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaat

SEQ ID NO: 18687 - DNA, 927 bp, Oryza sativa
atctggagggcggagagaggagaagagcggggagaggggagagctgaggcggatggcgccgatgtggaacgggatggggagagtgaggccgccatcaccgtcgtcgtccatggcgtgggggaggccgccgccgacccgcctgccaccggtcgccaaacctcctcctctcccgtttcaccctgtcggctttctccccaacccgccggccggcctgcccacctagatgagaaaactgagagagaagaggggaaagagatgacttggcatcctgacatgtggtgcccacgtgggtcccacgctgacttagccgccacgtcggataaaaccggggtcaaaaccgtcaagggatttagtttgtattagttttgtaagttgggggatgcgttgtatccggttttgcggttggacgattttgtaactcgatgacaagttgaaggacctccggtgtactttttcccccaagttatacagataagacgctgccgctggcccaccaaagtttggtccgacaaattctgatggaaaaagtacatcagaggtccatcaacttcgagttacaaaatcgtcccccaaccacaaaaacagatatataacatccctcaacttacaaaaccaggttatgtcctaaggcagtattgccaccggttttagctgacgtggcgagttgacttcagtcaacaatgctgagtcagcacccacgtgtcataacacacagaaaaaaaaagtctctctcgctctaaccaccatcggccccgtcggagtccagtgtgcggcggaggaggggcacgacggcgccggtgtgcggcggggattgcttggtcgctagcggcaacgctccaagcggagacggcgcccgtatcgccgtccgtgtcggtaggcccatcgcctcggagggttgggggaagtgaccccgacaagctccgacga

SEQ ID NO: 18688 - DNA, 1501 bp, Oryza sativa
gcaatgaaagggtggaacttaagaacaagattagaagtttaatgctctctcttctttgcaccatggggttttgttgtcttaagtactattttggttaatctctgtcattgtctaagtgtccgtttgtggtcactcgaatttgtgttaaaccttttgtaagggtgtgagcctaagtgctcgtgtaagagacttttaggctgtgtacatcctttgggtgtagaggccggtttaatccattatctaaaaaacaaataaatgctagagagagactcctgacaagaatgctccggccaccagctgctacttttatttaattaagcaagcaaggactacaactcgagatctccaagtactgatacccaatcgcgtagcgcacactagctagatatgcaatatagtactagtaataatttaattcatttgtacgtacgactccaacagtaaccattattgcattggaaatggccgtgtccaacctaagactccagagcatcatcagactcgctgtggctgtgcggctcttggtggccgacgggagcaatcttccagacggcataatcagccgtgggctgcgagtgatagatggcgacgagcgtcccatgctcggggatcccgtggatgccgttgagcctgtaccccccgtcgacgaacccgtggacgccgtcgagggtgtacctgacgtccctcagcgtcctgatctccatgaacccgtcggcgcgcgggtgccccagtgaccacagtaccgagagctccacggcgacatggccgctgtagggagccagacccagctcgaggtcgccgccgttcaccagggcgtgccccgtcgtcctgttcaccagcgcgaacgctggccgctcctcgtcgtccgtcagtttccccacgccgtcgcacacctggaaccagtgctatgttcgatcgtgtgcagaccagacgtacgtacattgccgaatccacgcaaattaaaaacggtagtataatatcacacaacggtttatacatgtaattgcaaaaattaacagcttcgacatactttcttctacactacaggtcgtaaatactgatgatttgaggcaaaatcaagcaaccaaagaccaaattagaatatgcaaattaaataggatcctagctgggattgctagcttttggtacctgggattcgtcgttggggtcgtcccggacgagacgcagctcgttcccacggacggccacattcaaggttgtatctcccttgcagtatatccttattggctgtcccccttccatggtttttagtccctctgctgctgccttgcgctaccctgtggtttatatgtcttggagcagtgaatctggaccatcggatcaaaattaattaatacagatggccctgattgcttgagttctttattgcgctgtactgttgttagtactccgatctcccattggtacatgggatgcctatctgaccaaacattatcacggatatttaacttgactctctccgaacgtcctcgtataatgt

SEQ ID NO: 18689 - DNA, 1106 bp, Oryza sativa
tttttcaaatcaagcttaatacccaccccattcttcttcttcctgtgcatctcatgaattgtttcgtgcaaaataacaacaccttccattatgtttctcccgggtaaaaaggccgtctgtgaaggtctaatgatcttttgagctactagagctactctatttgctagtaccttcgtgaaaattttgaagcttacattcaataagcagataggccggtattgttgaatttgtttggcctccttatgtttgggtggaagagttatgataccaaaattcaggctgtgtagtggcaattcttctttatgaaagtcattgaacatggccattaggtcctttttaatgacttcccaaaacacctgaaagaactctgcaggaaatccatcgggacctggagccttgttgtgttccatttggaagatagcctgctttacttcctcctctgagaattactttgttaggatgtcattttcttcatttgagacttgaggaatgtcctctattctagactccctcatagaaaaattattttcctctgggggtccaaagaggtttttgtaatattttgtaatgtactttctcagctgtacgtcacccttaattacaccctcctcttgttccaactgaaaaattcgagtcttccggtgctttccgttagctatcaaatgatagtattttgtatttctatcaccatccacaattctttttgttttcgcccgttggtaccattttatctcctcttcccttagcaaaagtgctaatctattttttagatagttcttgaggtttaactcttgttctgatagacattgcatcttagccttcttgtctaactcatccgcttttgctaacaagttagccttctctttcttgtatgctccacttgtatttttcgcccatcccctcaaaaattgacgcacccgacgtatcctattttgccatctttccaacttagtccccccttaacttcctttttccatacatccgctaccatgtcatagaagctatctcttaacaaccatccaagctcaaacctgaatattggttgtttaggagtattaacacccgtgtccaacaatagtggtgtatggtcagaaagttccctactc

SEQ ID NO: 18690 - DNA, 1501 bp, Oryza sativa
gccgcttgtccccggcgcggaggtgcacggagaggagcgtggacgggagtggattgctgggccgcgtataggccgacggttgagggggacgaccgccgcggccatccgcgcgacagcagccatcggcggcggcgcccgtcgcatcggccctcctctccgcagcgctcctcccctgccagccgccggccacaccggccctcctccccatcgcgtcgaagacgctgccgccatccacatccaagcgaaaaatgagagaggaaagagagaagagggagagagagaggggtgacgtggacaccctgtcacgtgggtcccacgctgactgaaccgccacgtccgataaaaccggggtgaaaaccacctaggaacctaaagtgaacggttttataagttgagggatatgatatatctgattttgcggttgggggacgattttgtaactcgatgacaagttgagggaccttcggcgtactttttcctccacaaaatggtttcaaaatgctttgctatgcataagcttatttgaacagttgtttttttttataaaaaaaaaacgaaactgtgccttcctctctcccctacttagagcaagtttaatagtataaccaactactagcttcaaatcatttatagctaatataatagttaattcatacaatagttgcttactatactattaatacctggtcctacctgtcatacacacattacgtttttgagtctgtgctgtagctggctatagatctgtagcccgctgctcttctatctctttaaaatatgtttatagctggcttatagcctgctattgtacctgctcttatgacaactaggctgtgttcgctggattgtgttcccaaccggaacagtacacatggaaaacagaacggtctattagcacatgattaattaaatatttgctattttttttaaaaaatagatcaatatggttttttaaaagcaactttcgcatagaaaacaagaaagataagttaggaaatctgcgtaggaacacagcctaaacgtgtacggagtaatcagatagctcccttgatacttgaacgtgccctgcatgccgtacacgagcagaacctgcatagatcttgaacttgttgcgctcatcaaagaggtcagaatgccacgcatctctgatcaaaacacacatgttcgatcggcttccacgcatagtgcaggtgtcacctgttgttcagcatcgtcagcccaattgcagccgacaggagtattctccagaaaccgcacgtggtggacagattttgtgatgacagaatgaaccctgcctgagctgcacgatggtctgttcgaacgctgaatttgcaggatagccttcgaaaacgtgtgaagattttacttcaaattcccgggtcatccacgaagcgcgcatctggaatacgtaaaacggtggtgttttgtgacgataagtcgtccgtgcaaacgaacttgctggaatttgaaacgcgtttacggaacggaagcctctcgattc

SEQ ID NO: 18691 - DNA, 1501 bp, Oryza sativa
aattacacaatacaacacagacacccataaagcacacgcactcacctctgtgaacacacgcatgtaaaccctacccctataagtatcttcgaagactgggccggtaaattctagagagattgacgaagtcaccacagacgtctcgctgtcgacgggtacgtcatctaccactgaaatcacaacgccgttaaaatcctgaaaagtttgctcccatggggagtcgaacctaggacctcaggtgatactgaggctcttgtaaccactagcttgtaggccctttcgcgagacgttttaaaattctaatgacagcactagcaatctgtaccattcttcttgatgccgacggttcctttttcttaaggtgatagttatggtttttactcacctatagttgttgccttgctgatggctggataatcagcaaatttcaaaagtcattttctgacttgacagcatgaaaatatataaccttgctatccctttatagtttgaatttggattagtcattactagaaaatagaaatgttactctgacttactttttttttctcacgcgatttaacttgtaacacatatatccgactattttaaatctaaacatgtgttttgtttggagagcttaaaattctgagaaccagctagttggtagccagcttcgaatgtggaaaagctgggttttccagtttctggcttctagttcattttctgtattatacaactacagcttcttaaaatctgaatcggaagctaactgtttgggtgagcttctaattttggatgttacataggattgggaattcaggatcctctgctttgccaactgcagagtcatcagtatcctccttgccttccaggttaatttcagctctcacgaaatgccagatcaagctgggaatctgggatacgacgagcaggatatgaatccctacagcaaattaaaaattctcataactattaaagaaaatataagctttggtaaaaatgtaaaatgcctgacctgagttctctgtcgtattgtgtctcctcggagggcgaccggtgcagccagccaacggcggcagccggccgggaccgcggccagtgcagcgcgcgccccacgcgcacgcactcgataccgacggctgtgccgacagcgacgcggacggccgtggctcgccggcggtcgacgtcgccggagacagccgctgcaaattatgacggcgcgcccacacacccacacacacgtgaggctgcctgcctgcccagcctgggctttgctcatcagcatcagacaggatcagatcacagtcttaattagctgctgctgctgctgtactaattaatggagtaggagtacttaccatagatgcataagctgacactcgcctgagctggacctgcatcagcgtctactgtaccatgatcttgatgacttgatgaatcatcgatgcgtcgacctcccggttagctggcgcgccgacttatcgatccgtgcgtgttaattaatggcaagggctcccac

SEQ ID NO: 18692 - DNA, 1501 bp, Oryza sativa
ttggaagatattaaatgaagagagagagcaaagctatctactaacttagagatagtctatagagaaaaacgaggcaaggcatgagagagctatagatacccatgtagacatactattaatctagtctattgctgaaatgtacatgttttatagaaagcacattactttaccattgcgggtgctctaatagtcacacattatacgaggacgttcggagagagtcaagttaaatatccgtgataatgtttggtcagataggcatcccatgtaccaatgggagatcggagtactaacaacagtacagcgcaataaagaactcaagcaatcagggccatctgtattaattaattttgatccgatggtccagattcactgctccaagacatataaaccacagggtagcgcaaggcagcagcagagggactaaaaaccatggaagggggacagccaataaggatatactgcaagggagatacaaccttgaatgtggccgtccgtgggaacgagctgcgtctcgtccgggacgaccccaacgacgaatcccaggtaccaaaagctagcaatcccagctaggatcctatttaatttgcatattctaatttggtctttggttgcttgattttgcctcaaatcatcagtatttacgacctgtagtgtagaagaaagtatgtcgaagctgttaatttttgcaattacatgtataaaccgttgtgtgatattatactaccgtttttaatttgcgtggattcggcaatgtacgtacgtctggtctgcacacgatcgaacatagcactggttccaggtgtgcgacggcgtggggaaactgacggacgacgaggagcggccagcgttcgcgctggtgaacaggacgacggggcacgccctggtgaacggcggcgacctcgagctgggtctggctccctacagcggccatgtcgccgtggagctctcggtactgtggtcactggggcacccgcgcgccgacgggttcatggagatcaggacgctgagggacgtcaggtacaccctcgacggcgtccacgggttcgtcgacggggggtacaggctcaacggcatccacgggatccccgagcatgggacgctcgtcgccatctatcactcgcagcccacggctgattatgccgtctggaagattgctcccgtcggccaccaagagccgcacagccacagcgagtctgatgatgctctggagtcttaggttggacacggccatttccaatgcaataatggttactgttggagtcgtacgtacaaatgaattaaattattactagtactatattgcatatctagctagtgtgcgctacgcgattgggtatcagtacttggagatctcgagttgtagtccttgcttgcttaattaaataaaagtagcagctggtggccggagcattcttgtcaggagtctctctctagcatttatttgttttttagataatggattaaaccggcctctacacccaaaggatgtacacagcct

SEQ ID NO: 18693 - DNA, 1501 bp, Oryza sativa
atggacatacctaggaatcaccagagcacaatcttgggggatcgacaagaagtgattaccgataaatttatcttgagacaacaaactgtcgacatgaagagtgatttcggagccacaggacaactaatcaagccacagcaggagtatcttcagttacatcctgaccatgacaatggtgtcagacaaccggaaacgttgctacaccgaaggagcctgactgcattttctccagcatcaactgtaccatcacagtttgataaagactccattccttcccacttcatctgcccgatttctcaggttttcatatcctcagacaaacaaaatctcaaaattctgtacttttctttacagtaatataaatacttttgacaaattatgttgcttcagaagagacgtttgagttgaccatgttttgatttgcatgtaattgcaggagatcatgagggaaccctgcattgcagcagacgggttcacctatgaagctgaagcgatcatcaattggtttgatgaagggcacgaagtgtctcccatgaccaagcagcctcttgtgcaccgcgacctgatcccaaactttgctcttcgttctgtaatccaagattatacaaggagaaaacagtattcattttcctgatgctatttgctccttttccccttctctgactcactcaattttttttgtgaatattgttgtgggtgacatcgcactgacaaatggattcagctgaaagcaacagcatttttaaacagttgtcatgtgttgtttgttttgagctgtcagctagtgcagcaacagagatgctgtgttgatgacctttttttgcctctttgatttataaccaatcaggtcagacaagattatgtgctggcataaatcataatatccctgaatgtcacattttgcacgatgaagcctaaacaatcacatgaaaacatgatggaaatgcagcccatcgttgatggcaaatatagtggaaagctgatactttctctccatcgttgccagagcacaggaagatatttgaaataataataataataataataataattaaaaatcagattgagaattgtagaatcagttgatggttcagaaaggaacacaacaatttcaaggcagcgaaacaactctgttagcatacgtggcacctcattagccaagaaatacagctcttaatgctgaacctagaaggtcaatttccatgtttgttgacaaacttaatacccaaattgttgtatctgagacgctaatttatatcagaattattcaaccaaatcagagtactctcacaagcatttcagcgcactaaattaagggcctgtttgattcagcttaagattattataatctggattattatgagcaagctgaaacaaacaaataacttattataatagattattataatctataagccagattactataatctggtaatccactctaaagatgttttttttaattattgggtggctaacaactaataatccagagaatcaa

SEQ ID NO: 18694 - DNA, 1501 bp, Oryza sativa
cattcattcttagtaatgaagtctgaattgctatggggaacaagttaagtgtattatatttttcaggtcaaatgtgagaaaattgttattgagaatgaagacattgctaatgggattacagagcttattttgctgcatggggtaagtaaactcgtcatgggagcagctgctgacaagcaatactccaggtgtgtcttcatttctgctaccgatttgtacttttgttgcatcatatatctagctaagtgatgcctcaaaactctaatttcaggaaaatgaaattgcccaagtccaaaacagcactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttcataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgttacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggtgctgtatccagggtgacgcaggttcaaatgctaacctatttgataaacttgaagaagccttcgcagaggctgagaagtataggaagcaagcatatgatgagtcactgagaagacaaaagacagaagaagaattgatttcatatcaccaaaaggtaaacccttcactaagttagcataaaaaattgcaggtttttttacacaaagatctaatggacctggttacaggccaggaaatctgaggatttgttcttaaatgaggccaagcaaaggaaagaggttgaggaaaccctagcaaaggcaaatgtggagatacaattattgaaggaagaaatggatgcactgaaacacaaccgagatgacctcagcagtaagctttccgacgtgagtgaacagaaagtgacactagagcaacaggccgtggaatatggaagcattatcattgatctcaaggatacagttgcagcaagccaagccc

SEQ ID NO: 18695 - DNA, 1501 bp, Oryza sativa
ggatccgacaagcgggccctacctgtcagcggctgagagagaggagagcggcggctcggcggattgggccggactgggccgagggaaagagagagagagggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaatgaaatcttatctggcccaattttatattgagatttaacaaattaaaattagatcttctcttctaggcttttaaaatcatttctaataattccttttaaacaacaatttataatttaaggatttttaaacaagaaaagctcttaacaattataattagatcattaataatcaaataattactgaactgttctttgtatcatttaggaattgagctccgaaaaatccgagaaaatttaagagagtgtaattaaccatggagaatttaataaaaattaaacccatccatgctttatatttaggaaattttatttcccacatttaacttcacttgtaaattaaagatcatttaatataaattatattattaatttattaaataatttataaatcctgaaacgaaaatcaggatgtgatagacacccttcatggtgtacgtgctacagatctccaggaactgttgtaagtaagcgttggcatcctcgttaggcttgccgcagaacaggctagcctacgccatcgtgatgaggctggacttcaaatcaaaatccacatctcccaggttgagctgcggcccaatggctacattgccaacagagggagcagcgaattcacggagagtcttgtcagccatagtcttgaaggtcggtggcgctagtatggctggtttctttgtcgggagagttttctgcggagcaacgactcgcggtttgatgctccggaagaaagcttctggattttccttaaagttttccggtaagttgaaaccagtcatgcactaccctgtttccaaaacaaaagtgaaaacaaccaaggttagcctgcaaaggaaagtgattatacagaggtaaataaaaagtattagttctggtaatctctattataaatcttccccggcaacggcgcctgaaatgcttgttggtatttcttaacgacattactctggtatattatggttacagaatcaatccgtaagcacacggatatatcattgtagcatttcactcgagagtattccaagggtatcgtatttatttaatcccgtgggtagatcatagtagagagaactgactaattatttatatgttacttgtaataaccatagtctaagcaggggttaagataaatcatgtgtactaaaatatctaagttaaaaggaaagaaaagagatagaatctattccaatacttctagtatacatagtatacatacatcctaggtatctgatatactagataaaaa

SEQ ID NO: 18696 - DNA, 1501 bp, Oryza sativa
  unsure (1)..(1501): unsure at all n locations
gttaagctgttttaaatttgaccaaatttataaaaaaaatagttatattttatcttaagacaaatatattatgaaaatatatttaattatagatttaataaacttaatttggtgttgtaaatattattatatttgtctacaaaattagtcaaacttatagtttgactttgacaagagtcaaatcgacttataattaaaatgaacggagcaaatagcttgaggtattttcttaagccataaatttatcttcttctccttatttaaatacatatagtcgggtaaataaatccctctaaaacttgtctgacgacgttgatatgctctcctatataaagtaaaataaaggacaatttgcttagcaagttggttaatacttttaactaattaatttatacggcagtattgtttattatttagataaggcttaacctgaaattagcactcgcaacgggtaagagagagatcactgcgtgcatgtgctccgccatttttcgtacagtacattctcttcgcagacacgaaccggacaggaacatttgatgacactgacacgttgacccatggacccatatcgatgcttagctccagtcgtggctaaggatgaatcctgcacgtacacgtgtccaccctacatagatgatgtgttacacatgcatctgtgtagatgtgtagtacggaatagtagctagtagtatcacataaatgttacggaattgctgctgcacatgaatgtactcccttattcccaagacgatttcctttaaaaggagtatggagtagcagtagtagtcaaacagcatactattatgttgntttgtagtttacttaatacagtnttagataataattaacattatcactaattaatgtcatcattataacaattaggtaaaaaactaactactcgcaccatacaggcgaagtttatatagatatagcagaaaaaaattataagattacaatctactcccttcgtaccaaaaaagacaaacgttggttttcgtgtctaacatttaaccgtccgtcttatttaaaaaaattatgaaaaaaattaaaaagataagtcacgcataaaatattaatcatgttttatcatctaacaacaataaaaatacgaattataaaaaaatttcatataagacggacagttaaaattggacacgaaaacttagggtttgccttttttttatggagggagtagaagtttatatagatatagtagaaaaagttacaagattaccatctggaagataaaaaggaaaaaattagcaaaagaatggcatgtaattaagtgcttaaatgtacgtgcccttgcctctggatcgtaatcatctgcctacctagctggacactgacatcagctgcaactgatgccagctgttcgtcctggctgggagtacttaagcccacggggagtcgcctctcttcctcactctaatcgccaccaccacctcccactccaagacgctagctgcattgtagtgagagagagaggcggcca

SEQ ID NO: 18697 - DNA, 1501 bp, Oryza sativa
agcaagcatttctatctccttgatggtgtgaatgcctcgctgacgggtttggagtcgttccttgctccaactcatattagaagccatcttctctattaaatcaacggctccttgaacctgtttgtaccatagtttggctaagagttaattagtttcatttgagcaggccaaattatttagaatatatagatcctaagtgttgagtggttagcttgaaacatagattaagtttattgtgtgtaggaatttgtgatacactgagagatcatgtgtgcaagctgttgggtggctgcagcaattaacctggttcgttgacttgtaatcaggtggttaattagttgagtgggttaagttcggatgttagctgttactcctaattagttaggtttatggggtcattttacccattgtttggttaatcattagggatttataattagtgcttgcagatgtgtgtcgcaagtagtatatagggtcagtgtgtgcagcgtacatgtgcagggaggcatccggatcctttgtgaaggaaaaggcttcaggaggccacaaggtgtcatggattaagagcatcctcaatgttttagatcaattgagccataaggtgagacccacattcttatattgtttatctatagtacatgctacaatgtatatggtagcttcttgaccttaaggtgggacccattgagtaaaaagacacatatttactcaagattgaaagtgtgcatgcatgttgcaaagccatgatatatatttttaattcttatggctagccttaagcttaaggttgcacatagcactattctctccctatattctctccctagctcatctcccaatgtacaaaggtacaacaaaaattactactttattccttaaggttagttttcatgcacataatggttgcctttatagaagatcatcgatttgatgcatgcatgtcaggtacggagtatttttcagggagtagtgcagatcaccgaaggcattgatatgctgtacatggaatttccatgatcgacccggaacgctggaagagaaggcccacaaaggaaacaaactcccgctagatgaggccgtgcctcctataaattactctttccatcttcgctggaaaaaccccgaacaaattatcaatctactattttcttgttatttacttttctgttcttttctatttcgttttcatggctgagttttagtaacctagaatttggttaatctttgtcgttttgcgctgaaaaatggtcgtgcttctccacgaaagcgaggaggttatcctttgctagtttgctcggaaactagtcgttcgtcgtcacgtaagtacgatatttatcctctttgctaatttgcttgtaagttagtcgtgtgtttccgcgaaagtgaatcaatctcgaaatcggtttcactagccgattttgacctatcgatttcgacgattctattgtttacaccgcaaatcgttaggtgatcttgtgttgactaaaaaagcgtcaataga

SEQ ID NO: 18698 - DNA, 1501 bp, Oryza sativa
tcgatctcttcatgggcagatttgtggcaacaattcgtcacgaacttccagggaacttacaagcgccacgcgatcgaagacgatttacacgcattaacacagaatcagggtgaatctttgagggactatgttcggcgctttaatgagtgcagaaatacgatccccgatatcaccgatgcttctgtgatccgcgctttcaaaacagatgtcagagatcgctatactatctaggagttggcaacaaggcgaatcactaccactcaaaggttgttcgaggttgtcgatcgatgtgcccacgcagacgacgcgctaagacgcaaaaacgacaaaccaaaggcgggaggagagaagaagccagccaaggacgcacccaaatcaagcaagaagaaaagcagcaagagtaggaagaggaaagctcaagcagaagtccttgcatctgaatacgagcgcctgcccaaacacccagacccacaaggcagtgatacaaagagaatatggtaccctatacacaagtcagacagacattctctggaggagtgcctcatcttcaaaaaatcgttggaaaggtagttggctttggagaagggcaagcaagtacgtgtagtcgagaaggcaactgaggcaaccactcaggactcggactccgcgtacccagattccgatcttcatgtctcgcacatcttcggaggttccatagcgtactcttcaaagtgagaatacaaaaaagtggagcgtgaggtttattcgacatggcagggggctgcacccaagatgaagtggtctgaacagaagatcgagttctcagatgaagaccaccccaaggctactgttataccaggacgatatccgatcatggtcgaactcactattcggaatatcaaagtagcgcgattcctcgttgatggcggcagctccatcaatcttctcttcgccagcactttggacgcaatgggaattccacgaagcgagttgacacctaccgatcaacccttctatggaatcacccctcaatcttcgtccaagccattgggcaagatcacgctcccggtgactttcggccaagcgagtaacttccgaacggagcagataacatttgatgttgctgagttcgacacagcatacaacgccatcatcagaagaacgacactcgcgaagttcatggccacatctcactacgcgtattaggtactcaagatgcccgggccgaagggaacaatcactatccaagggaacgcaaagctggcggtccaatgcgacaagcggagcctcgacatggtcgagcacactcctagccaacccgccacagccgagccacccaagaaagtgatcaaaacgactaagacgccgaaaccagacggcgcaatcaaaatcgtcccactctccagtgccaaccccgacaagacgatcaagatcggggcatcaatgaacgagaaataggaactcgcgctcatcaccttcctccgcgacaatgcggacctattcgcttggcagccgtccaaca

SEQ ID NO: 18699 - DNA, 277 bp, Oryza sativa
tgaagatttgctcatccttgctgtaaaattgccgcctgtagtggatgtttgacgactcacgtgctcaaccactggagatatacaaagtgagatcggccaaattagccagcaaacaatgaatacaagatggacacaagcaagcagtttaaacttaagcaccagtattaattgttgtattgccgtgtcagtttgtgatgcagaacattgagcatgaggggtggtcacttgtcaggcgaattgctcgtgagccgtcagagagagacaggtttcccggcga

SEQ ID NO: 18700 - DNA, 1501 bp, Oryza sativa
acaccaaaattttcagcaagagtaaaactaaaacgaagaaaaagtccactcgaagcaaagcaactacacgttccgccgctcagtgcgatttgagcgcagttagaacatcgtgatcagtcgctatcgttaaagccatcgagcgaaatgatcctcaatttgcaagtaagaaacgcaaagcgcagacacagaaacgaacagaagaactgaatactggcagcatcgcagtaatcgcgcacaagagcgaggaatcacgaggtgaaatgcgaaaaatctcgcggacctggcgcttcatgtggcgcttgatcccgaaggcgatgccgtggaggccccagcgcccgacggtgaggtcccacgtgcgccgcgccgtgcgcgcggccaccgccgccgcctcgcagcacgttgacggcggcctgtacggccactcctcctcctcctcgccgccatcccccgcctccctcccccgcgcctccgccccggacgacaacagccgcgactcctcctcctcctcctcgccggcctccggcgccggctgcggccggcagcatgcgaggagtatgtaggcgagcagcgcggtgcccgaggctgccgccgcccccgcggcggcgacggcggcgggcatccggcgattcgcggcggcggcggcggcggcggggatttggggcgatcgatcgcgaggcgttgaagtgtgggacgaagtggagaagaagcttcggtttgtttgtgaaaggggtggatttgtaaacttgagacttgcaacttgccccccaagtgaagtgaggtggtttttaaaataaggcacggtttagtttgggaaaaattttaggtttagttatcacattggatacatggataaacgtttgaaatattaaacttagcctaataacaaaacaaattacagattctgctaagaaactgcgagacgaatttattaagtctaattaatctgtcattagcaaatgtttactgtaggtttgtagcaccacattgtcaaatcatagcacaaattaggcttaaatgattcgtctcgtaatctatatgcagactgtgtgattggttttttttccatttaatactacttacactccatgcgtgtatccaaacattcgatgtgataggtgaaaattttgttttgcgaactaaagagcccctaagaaatttggttttcgaattcgtcctggaatttttgggaagcttgtgagccaaatatgtttggtttgtggaggtcgttttcgaaaataaaatggtttgccgagagggtgatgtcatcgctggatactgacatttttcagatgaaatagtctccacttgcataatgttcttacatcaatggctgaataccttcataatttatgataattataaaatagtataaataaataaattaactattataaagtttaaaacaatctaaacattttttctaaaagatttagtagtatgtgcgtaaagctgttttacaaaaatcataactgaaagcgtgtgtacttgcatattcatcggt

SEQ ID NO: 18701 - DNA, 1501 bp, Oryza sativa
ttaagctgttttaaatttgaccaaatttataaaaaaaatagttatattttatcttaagacaaatatattatgaaaatatatttaattatagatttaataaacttaatttggtgttgtaaatattattatatttgtctacaaaattagtcaaacttatagtttgactttgacaagagtcaaatcgacttataattaaaatgaacggagcaaatagcttgaggtattttcttaagccataaatttatcttcttctccttatttaaatacatatagtcgggtaaataaatccctctaaaacttgtctgacgacgttgatatgctctcctatataaagtaaaataaaggacaatttgcttagcaagttggttaatacttttaactaattaatttatacggcagtattgtttattatttagataaggcttaacctgaaattagcactcgcaacgggtaagagagagatcactgcgtgcatgtgctccgccatttttcgtacagtacattctcttcgcagacacgaaccggacaggaacatttgatgacactgacacgttgacccatggacccatatcgatgcttagctccagtcgtggctaaggatgaatcctgcacgtacacgtgtccaccctacatagatgatgtgttacacatgcatctgtgtagatgtgtagtacggaatagtagctagtagtatcacataaatgttacggaattgctgctgcacatgaatgtactcccttattcccaagacgatttcctttaaaaggagtatggagtagcagtagtagtcaaacagcatactattatgttgttttgtagtttacttaatacagtattagataataattaacattatcactaattaatgtcatcattataacaattaggtaaaaaactaactactcgcaccatacaggcgaagtttatatagatatagcagaaaaaaattataagattacaatctactcccttcgtaccaaaaaagacaaacgttggttttcgtgtctaacatttaaccgtccgtcttatttaaaaaaattatgaaaaaaattaaaaagataagtcacgcataaaatattaatcatgttttatcatctaacaacaataaaaatacgaattataaaaaaatttcatataagacggacagttaaaattggacacgaaaacttagggtttgccttttttttatggagggagtagaagtttatatagatatagtagaaaaagttacaagattaccatctggaagataaaaaggaaaaaattagcaaaagaatggcatgtaaattaagtgcttagatgtacgtgcccttgcctctggatcgtaatcatctgcctacctagctggacactgacatcagctgcaactgatgccagctgttcgtcctggctgggagtacttaagcccacggggagtcgcctctcttcctcactctcatcgccaccaccacctcccactccaagacgctagctgcattgtagtgagagagagaggcggcca

SEQ ID NO: 18702 - DNA, 1501 bp, Oryza sativa
attgctttgagtttttatttgtaacttttaatcattcgtcttattaaaaaaattatgaaattattatttattttgtttgtgacttgctttattatcaaaagcattttaagtataacttatcattttatatatttgcactaatttttcaaataagatgaatagtcaaacgttataataaaaaaaagtcaaagcgaccactaatttgggacggatgtagtattgtttagatctcttgtcctaaactagtatttgttaagtttatttattaaaatatttaattaatatctatagtcttattggtaatcattttcagtaatccaataaatgtattaatactagtatagtaccaatacattacagtaacaaactgtacacatctctgaagtatggacaatatatactattatgcagaacaagaagtgacagataccaaaacatattgatagataaacgatactactactactactacactacataggcagacagggtataatagaattatgagtagatggaagatgcattgctgaagaagccatgagcccatgatgtagcatgaattatgattaacagctaaggaggcaaggcaactaacctaatctagtgttgagctttgattagccaagtctgtcaaatatagggggcttgtttgttgctgggcgagtgcagttcagaatcccactcgtagaagaggagctaaaagaaattgtctgacgcctttatgcttgcttgggtcgcccatggccgctttattcccaatccttgtttcttctagttctacctcgcgattgctacctccggaggctgctgtttgcaactgtgtgtgctgctatatcttaaaaagacacgaatattagagaaaaacataatatcaaataaatagaagaagtgtggtttcgaataaaaccaccttgtagagctattcggaaaacctgaacgtttctcgtgtgctcctacgtcctaaccacacgcaaattcttgtctaatcctgcctgctagtatctatctagttacctttccagttgtcttattactcttggagagtgaagcataaacgtgtattccatttttgcgtgaaatttttttctctctcggttttacgggaatgtaatggattttacgaaacttccgcgaaattcctcgtggaatttctaaatcaagtgtaagtcaattggccacaaatcggtcgttttttaataccttttgcactcttttataaacagaggaattcgcgaggatttcgtaggaactgaactataatttctacatattttttcgtataagaatcgtaggaactgaactataatttctacatattttttcgtaaaattcttatgtttcaaaggagtccttacaactaatacaataaccaggtgtacattccatcgttttctctctctttctttgataagagggctgcacaaattgtacaaacaggaattcagaatacgacacaaaaaacatgtcaaagctggtgatcaaaatggaagaacaaattttc

SEQ ID NO: 18703 - DNA, 638 bp, Oryza sativa
gcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctgcttcgctcacttcatcacaggtttgctcccatacatcttttgcatttgtactaatatgttatatttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggtgtagtacagaaatgcgaggttacgcagttattgttttcatcaggcccaatgtcaaataaggtcacatttcagatagttcacggtgaaggaaatattagatttggtccagatggtgttgatctgtcagattttgtaa

SEQ ID NO: 18704 - DNA, 185 bp, Oryza sativa
ctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagt

SEQ ID NO: 18705 - DNA, 1501 bp, Oryza sativa
gctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttgttcggcagcgattgctaaggcgcaagtccacgacaactaaatcaatatactcacccgtcttaaaatataaagattttagttggatgtgatatgtcctaattctacgaatttattaatgctttacgttcagattcataatactagaatatattatatccaatcaaaatcccttatattttagaacggatggagtaataaaagtactcctcagagctgtttgaagtctatttgtaattggatttcaaacatggctaatattgaaagtaaaattcaaatcgaaaaaaatgtttagtttcatctttttatctttcattattgaataatgaatggtaaccggggtttatgaacggagccgataggaagtggtaaacgtactccttccttctgtccaaattcataataattgaaacattatatcctgtattagatagttatattttaagatggacataatactttgtaaaacagtaacaagtcgcatttataaaccctgcttgccgctctactttttttttttaagtatacattgcttgctcatgctcggttgctaaggcatgtgctccataatttggcgtttgccatggctagatctggtttgatttcccctagtttgtttaacatccgaataaaaaacttaccagtctaaacaaatagcagtagtgttttgttttgtttaaaggctaaacaaatactttggttggcagaagtggccgatgcatgccatcgatgaactacgcataaacaaatctttctactactaacttagcttgtagccaccaacaagcagcctcagattacacaatacccacacatgccttcccccaaagtcccaaaccctaaggtacaggcacagccacaccgaactcccatgtgtagcgtgccaatgtgtcgacttgttgccaaacagctacacaagaatgcatgtggcttgcatcactcactcatggcatgttgcttcttggcctcgccgttttttgtcctctcctaatcctcactcaattaccttacctagttttagttactccatccgttc

SEQ ID NO: 18706 - DNA, 1501 bp, Oryza sativa
taatgtatttgcctgggattataagcttggtctgttatctagaagttcatgttgtttagtcatctttggtttctacaaaacccttgcaaaaatttctttgtcgacttttattcttcatactatatatatttcaatagaactactgttctcctaaaaagtacaaacatgtagcaaaagctgatatttgacaaaactataaaacctgtgcggcttaagagtaacaatctgcatagatatacaaacaatgacataatcacaagggacaggtgctttttactttttgagtaagcccgatcactacagaatacaaccatcttcataggttaagtaatgctacagttaatctgataaagaagaaagagagaaaatccacattggacatggagatgatgaggtcacgagatctccaaagatttcaaaagcagacttatggggagaatatatatggccatatgggagtgcacgaaattacattcactttaaaaagggcccaggtatgacaacaagcttcctaaggtcagtgcaggactagacataaccaacaaacatcgctggagcttcagtatgtattcgatagaaagtgcagctaaaacatggatcagcatttaggttggcatcaatatctgcagaggccatgtaaaataaaaaacctactacattatgaaaataccgaccatgtaatcgattgtatcgaacttggaaagcgtgatatcatacattggtctaacatcagagaagtggacgattctgctaatttctaaaatagttcaaaacagtcagtactgaaaaactaaattccctaagatcacacatggcatgtcattcagctttacaataaatagatacatgcaatactattctaaggaaaaggttttgctgtatgatgctgtttgctgaaggtggttgtgcatttatcagtttggtgattaaagttcgctgtgctaacaaagcctcctacaatagtaagccaacactttcgaataaatcaatgcgtattcattttacacaacatagttccataattgcacttacctgaacatggcccaacaagtgtacagattggaaaagtgacttatcttgcttacaagttaaattcataggctctgaagttaaatcaataataagtacacaaggaacatggtatgctataatctaatacttttgttgcttatacagaagtgtgtaaagatcatcattaaacctactaaattgattgtaaactattagccctatttaaggtataaggtttacatggaacgaactgtaaaatgttacctatgaaacactgaggagagccaatcatccttctagcttgagagaggtttcggcttccctcgccttctacatcctactcttcctcgatatccctgatcgcgcaaccacatcctcacccatgaagctccatccattgttgtctgcaacaacctctatcgacccatccccttccctcaccagcggaatcgagaaatgcagcttctgttgcagtgcatcaacccaataa

SEQ ID NO: 18707 - DNA, 1501 bp, Oryza sativa
tgagtggttatacaatggcggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctttgatggtatgcctttaggaatatctggtactttcaactttatgattgtattccaggcagatcataacatccttatgcatctatttcacatgttaggtgtagctggtgtattcggcggttccctatttagtgctatgcatggttccttggtaacctctagtttgatcggggaaaccactgaaaacgaatctgctaatgagggttacagatttggtcaagaggaagagacttatattattgtggccgctcatggttattttggccgattaatcttccaatatgctagttttaacaactctcgatctttacacttcttcttggctgcttggcctgtagtagggatttggttcattgctttaggtattagtactatggctttcaatctaaacggattcaatttcaaccaatatgtagttgatagccaattaatacttgggctgatatcatcaaccgtgctaatcttggtatggaagtaatgcacgaacgtaatgctcacaacttccctctagacctagctgctcttgaagttccatctcttaatagataaggcttttctgctaacatattgaagaaagaaaagctagaaatacccaatatcttgcaagatattgggtatttcttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgtggatagaatgctagatgcccgggaccacgttactattgtttctttctcctccttcatattgacattttctatttttgccaataaatgatgagctacaaaaggattcgttttttttcttgtcacagctgattactcctttttttccattttaaagagtggcattcgatgtccaatatctcgatcgaagtatggaggtcagaataaatagaataatgatgaatggaaaaaagagaaaatcctttagctggataaggggcagatgtagccaagtggatcaaggcagtggattgtgaatccaccatgcgcgggttcaattcccgtcgttcgcccatcctattattgcaaattccaaagatgcaattttccatattcctagttacgtatttacttacggcgacgaagaataaaactatcactatattttttccttttcctagttcttcttccaagcgcaggataacccaaggggttgtggatttttttctaccaa

SEQ ID NO: 18708 - DNA, 1501 bp, Oryza sativa
gatttgatgtttgcgtctaagttgggatattcgttctatgcgaatgtaatgttgatgggtctttaaagtacatatgttttgtgtctgatctttatttgtatcttagattatcttacagaacctttagatctgcaaatcagattccaacatgtctctatttttggtgcctgaccgtgtaattctgcatgctagttttgcaaatgctgaatatggagtgatagttcttaaagtatgtcttttgttcttggaatagtatgcatagattttactcaaatctcaaagtactggtacaagttgctggctggaaagtctgtgcatagttatggtagattttacttgctagagttattattaaatggcatattggtcgatttcactcgaaacatggttgcatagttatgtgcgcatttatcagaagcactaaataaaaggagacagtgggagtttcacccttttggttggtatcaggggtttcaatgtcgataacattgctgtgcaaagtgaatttctgggagtaatgatgttacaaagaatgtgctgtcggagattcggtcatgtgttatctgaacttttccgatttttccggtggcccgtggcctctgtctttgaaagaaaagctattgcatgatagtagtttagctatataaatgagtttagtatggatattaaaccaaagaggatgcgatgtcattaatttgttgctgagattatgtattatcttaattattaatcatgtggtgccctttctgtttctcaatcttacctcaggtttgttttggatgcgatatctgtgtagacaagtttgtgccttgttgagaggaatgcatcaattgttttcatttttttttgcccaattttgaagtttaaccaagatcagagaggttccctttgatacctgatgttggcggttatctcaatttttaacatactggctgtttaggacccgtttggtagggctccaaactcctactccagtgggagctagctccgagactcgttgagaagtgtttggctagttttcagctctagatctgaaaaaaattgcaaaaaaaaatgcaaaaaaagttgaaaaaaaaaggaaacctacccgcggcagcccaatcccagggcgcctcccgccgccggtggcgcgtcatcaccgcgcgcgccgcccgtcgccggccggccgcctcccgcgtgtcgtcgccgcgtgccccgcccgccgccggccggacgcctcccgcgcatcgtcacagcgcgcgccgcccactgcccgacggccgctgcccgctagctcgctgccaaccgcccgcgtgtcgtcccgtcgccctactaccgtcgtgtgcctgctgccgccgccgcgggatagcactgaccggagcgccgccgccgcgccctccaccgcagcaaccgacgccattgcccccgatccctcttcctcctccgccgctatggccgacgccgcctgccgccgccgatgccgcccaccaccgcccgccacaactattgggactcgggagaa

SEQ ID NO: 18709 - DNA, 1501 bp, Oryza sativa
aagttttctaatctctttttagctcattattatataataatcaagcatatcgttgtgctctcccgcctgatattcttatttgagataacatgcaaaagtgcatatttcttacacagtgagatcaaatcacgctgcaggtgcgaggtccatcgtgtgccaagatgttctccgactatctatctgagaccaaggaagaatcaggaacaaagaacatcatggtgctggaacgtgggttcaatggatgggagctttcgggacaacccgtttgccggtgcactgatgccccttgcaaaggcacatgctcacctgaagaacctgagttgtaactctactcgcttcctgaatgatcagcaatgttggcagtcgatctccaatgctgaatttggtctattttgcctcatgagatcattcgtcacagtgtattggactgaaatgccactttgtggacaatttcatcagatatagcataagttaactaccccactgtagtgtcaggcacaccacggggtactgaattattactgattactaaaaactctttacatcttggctgaagaaatgttcagcttcttcatgtgctatgtgttatcaaccgcttgttacactacacttggactctcatcaatcgtcacatacatcctaggttcacaatgtcacgacgtgtttcccatttatagcctgtttctgaatattggccattcgttgtttcaattgattcatttcagtctttgttccaattgattcatttcagttgccaatttgcccctctctttttcctcccgtcatattcaattgaaaaggcacaatctcacgctcttttctcttcaaaaagaagtcgccaatttgccttttagtcgtttctccgtgggctgtgtttgatgcctgtttcgttgtaactcaggtaggcgatagccaccgtaggcaccttttttcattttttagaacaagacgagaatattaggccccgtttagttcctaaaacaaaaaattttacactatcacatcgaatatttggatacatgcataaagtattaaatgtaaggaaaaaacaattacacagatcacgtgtaaaattgtgagacgaatcttttaagcctaattacgatatggtttgacaatgtggtgctaccgtaaatatttactaatgatagattaattaggattgataaacaatgtggtgctaccgtaaatatttgctaatgatagattaattaggattgataaattcgtctcacagttttttgccagaatctataatttgttttgttattaaactacgtttaatactttaaatgtgtgtccgtatatccaatgtgacaaccaaacctaaattttttcccaactaaacaaggtcttagtcaaactataccggaactgaaacatttcaatcgaatttcgttcagattactgcagttcaaaccagaccctggtcaacgcttattgggttgggcccaccctgagagacgccgcagcccggaagagccagcccactttgacggtt

SEQ ID NO: 18710 - DNA, 1501 bp, Oryza sativa
agtaaccatctctctaagcaagatctgccatagacatgcccacaaggaatgcaactagatatacagcatcacacagttagcaacttaagatatgcactcatgagaacaatcaaaacatagaagcatatggcgcaattccacgaatttagtaaaaacaaaaaaaaaatctcctcaccttacgcgatgcgcgccatccgcggtccacgcgttcatgcaaatggggcagccgggaagggactggctctccgcctcgccgccgttcacctccgcgctgtcccggctctcggaaaccctagcctcgcgatctccacccccgcctctcgtcacctcgacagatccctggctctcctcctcctcccaagagcccccctcctcgcccgagctggacgagctcagctcgagcacctgcggcgccaccactcctcgagccacctcctcctcgccgtcggcgccgtcccccactcccccgaggcgaagcccctgctctccctcctcgtcgccggcctcctccatcgccgtcgtggggattggggatcggagagaaggggaaattttggacgcaatggcgccatgaaaatttcgcctgaaaagcttggcgcgcaggagcgaaaaagatttgggcctttggatctcgtgggctttccaatgggccgtagaaatgggcccaggaatagattggtgtccggctgtccgcgccgcacccgcggaggggcgttgtgtctcgctgttataagtttagtaccacctcggagattcgaggaggtgggggaggggaggagcagtatataatgggcacccctgccctcgttgcaacatacttacctggacggggtcgacggccgatcaagaagagccgtggcctaggccaatggcccacattgcacttggtgggcgcgttggcttaccatctccccaagcgggagagtggacgtcataatttgtggtagagggggtacgcgttcgcgcggcccctgccaattctccaatttaaaatttcaacccaattttaaactttgcccataggttttgacttgggcttacctaatttggaaccttaaccgtgggatttgactaaaataataaatcgggtatttcccttctaacggtgttcccagaattgtgaatcttttctaccctagaaatgactattttaaaatgtattttataaattttatatttccaaaatctatatattttataatgtattttataaattttatatttctaaaatctaaatattttctttcttaaaatatcaaatttctttattgacgagatcttttccattttgaaatttgtgaaaggcgtagcctaggttaggtatgggaatttcaaggcgcaagttgcaaaaaatagtttagacagggatttctgaattgtgaggagcaagttgcaaaaatagcttcgtctccgaaggaggaaagggtcctccactcgatgtgcagattcctcatcagtacgcctttctctcggaggagaggggaaaggaaggcggaggcgg

SEQ ID NO: 18711 - DNA, 1501 bp, Oryza sativa
cttttgtcatgctttcaggctttacacattcctgaatttttcttttactaattatcactgacacaatgcgtatttagagttggtagtagtgagttagtgaccatttgaagacaacctaaagaattcaaccttggatttgtgtacttaccctcttgttggtgcggtgcaggttgcagaatcaatcttccaattctgaacagccaactgaacaccagttgcgtccggggctgtttggagttaagggcagcacaaagatgcaagagacacgaagctgatcagtcacattcagatgctccaaggacgttatgcacagtacaacaccctctgatcaatcgtagtatccagcaccggcgcttatgtggagctctgaatctaatgattgatccacctgtgctgcttgtgactatgaagacgatgtgccaacgagaaactatgcaaaactgcatatccatgcttgatcagttcagttcagcgttcaagaatgtgcatgtcttaaccatttcctgcatgtgtatagtatggtttttactgtactactggcagagatcatatcctgtggaagtttaccatgatactagttcggcaattaactgaagatgtggaccactgtccactattaaaggaaaagctcatcatttaggcctaatccattggttgggcagctactcaactgttcttcccttcagtttgtcaatgaaacgtgtgtcggtatgtcatatgattgggaagatgaattatatatgtgtgaattaatagaattatcatatgattgggaagatgaattatgtgaacagtgaattaagtttctgaaaaaaagttaagatagtgtgtacgtgatggtaccttttgtctgatccatgagaaaaaattccaataatttctcccaattggagccaaaataccaaaacagagtaatggaggaaggaacatttcgtggagtaattcaccaaagaaggtaaagggaaaaagtttcaggtgcattataagcatatatatgatattcgttgctgctgatgtgtagtaaccgaaagtgaggctgcaaacttagttaccatcggaagaaaggcagcatgggaaatcaactttgttaatgctgccagtaaccaaaggtatgcagtttcatggtgagaatttgcaaattcactttctcaggtttcctgttttcgtgaggcgtcaacatccaaaatttgtgtgccgtatcacacaaaccctctttaggggggcaacatcctgttcagcctttatgccagcagtgttcagtttcatccaaatctcccagtttttgtctctacctaagattcatgcaattaacttccttccatccatcaacctgccatcacttggtcccatcccatgcatgcattagtagccacacatcatcctataaatgactcactccaacaagtgagagattcatcacaaagaagaagagaaactagtagcccatcattcattcacatcactataactgacaaaatggcaaggcctggtagtggtaaca

SEQ ID NO: 18712 - DNA, 678 bp, Oryza sativa
ttgtatatagagtatagatatagacaaaagacatgaagacaaaccaacttctcctttaaagatttttatttactaactgttgccttagcctagaggacagcaatgggttgaccacatgtagtgtcgccctatccatattacatactggagcaacataggtcatggattcatggccttagatcaagaggctatacaaatactacatgcataagtaattattgtggaagaaaaacagagaatatatacatccaaacagaaatgacaattatggttatcctgccaacatgatcaagagaggttgatagcaagcggcaacattaggatatacggtgccagatactcattttctttatttatttaaacaagacaactcaaacctgctaggaccacggcggctgtctctcctgtatggcgcatcacggtatgaggtacgctcagtacgaatcctgcggtcctttggtggcgggctgcggctgctcatcgtcaaaccttccttctaaatctccaagctccaaccaaactgcgaacaccacaccacaaaaccagcacctccaagactcccacaacctgttaggctgttacaaccctcccttcttccttccttcctgtccacaacaaaaccacaggctgaattccagctccatgagcccaaacaacagcaaccatcctttcctaagc

SEQ ID NO: 18713 - DNA, 1501 bp, Oryza sativa
agagatgtcgccacctgatggtccgcgagcggcccgatgatgtcagtcaaaggaagggcctacgcttaatcaggtcataaggtgatttcgaaaggagaatacgagatgcttatcaaatacacttacgttgatggcttcatcgcgttccgccgcccccttttcacaaaggggcacggggatgtcgctagccgtggtcggaccgctgatcatcacttgaccgacgcgccgctccatagcttcgctgcttagacctgttaaacggaaaccaacttttgataagtcaagaggaacgcgactacaagcacgccaagatgaatacgagaaagataccccgaggagaaacccgggtcgcgtcatccgacccgaaatagttataggctggatgggcccgagcctggagcggctggatccgcctaccgacgaagtctgcagcgacttcatatcccgacaagccctgttctcggagatcatcgatgatgtcgataaacgactgaagagaggggctcaaagggggcttggcggtccaggccggaatcttgtccggttgatcctcgggaacaacgaagacagggttcgagtccttgatctcaagatagaaccacctgttccgccacttactgcgggaagaaggacactggaaggggatataacgcgacttcatgccatcacgaagtcggaacccgacgcaaccagacaccctattggattccatccaacgcagttcatagtagaaacggaagagatcgagaaaaggctctaccccaatgtaggcctcacagagatgaacaaagatactaagaaaggcgatggaattaggattcaaatggagaagagaaagaccatagaaattcaacaccaggagaagaaactcggaaggtggaggaagaaaaccgcagagaacgtaatcttcgatcacaaccatgcgacctaagaggggctgaggatcagtacctcctacttctctctccatgtctccacggccgggaagggcgccgtcctcctaaaggttcttcaacgtcgcgctggtggaagacgacttaccgagatccattgttgttccaagatcgccggaaaacaagcctgagttggcgaactagggtttcttgcggcggcggagaaggcaaggagcgctggcaggtggtgtgtgttcaacaaggttggcagacttcaaaatgagctcccaaaattcctttaaataagcacactaccaacggtgcgaattccaaggaacggagagagatccccgccggaaatctctgggcccgttacgcgcggtagttttctggacttcagttcaaaattcactcgtgaccgttgggcttcaaacggcatgctcgactacgttctatctccgcggtcctcgcgccaagaatgacaacgttctcgacacccgaagtcataaatggttgcacgagttcattttaagcagaagtcgggggctactgtcagggttacgggtcaggcataccctctacccttcaatatacgttacatatcgaca

SEQ ID NO: 18714 - DNA, 1501 bp, Oryza sativa
agttcccagtggaagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaattctaagattacccaccaaaaattataaaaattatggtaatgaataagtctaatagcctaggctatgactatttaccataatgagaacaggcatataacataccaaagaaacgactatggtaaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaaatactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccgccgcctcaatccctcacctctccctagccatccctcgaatcaaatcagcgcattcgggtaaaatcga

SEQ ID NO: 18715 - DNA, 1501 bp, Oryza sativa
gatgtgctctcatccattcattgccagattgtccgtgcaattgtttattttcattgtcaaatatatgaaacttaagtgataaaaatgttttttttgtttgtgtcaatcgcattgtttcttggttaattctctaaaagtgataaaagttttttttttttgaaagtgcaacctaatgaaatactagattttgacatgcatcttgtgtttctcgtgactgcaagaatatcaacctgtcactagagaaggagaatagagaagattaaaaagatatgcaaaatgaggtgtaccattagcgtatgataaattgagtattaatcattttaaacctgaaaaatggattaatatgatttttaaaacaactttcctatagattttttcttaaaaaacacaccgtttagcagtttggaaagcgtacacatgataaacgaggatattttcttttcaatgtgcttgaaacgaccaaggattgttgacatgtcctttgttttagactgggcagtgttttgccactaaggacaagtggctttgagtactaaagttaactagatgatgttagatattgtgaaatggttaaatgatttgggttgaaatattatgaaaatgatttgagaatgatgatttagtatgtgtatgtttagttttagaatgaaataaattgtagatataattagtatatgcttacatgttgagccttgtgtgtttagtgtgttgatgtgatatgcttgcatgttagattttaggagtgctaataaatactatgcttgtatgttgagctttaggtatttaatgggtattagctttatagaaagaataagggattagtgtctactaggtgtcattgtcaatctgtcattgcacaacttctgctaaatatgctagtttttataatgtgtagaacttgagatatcttgttctatgcattgcatatcactagttaaactcagttttaccaagaagaagcatcgttctctagtgcatattgctggcttgatttagttgtctcgacgttgttcaggtggtctcaacctttttcttggtttattagtcatgccctaaacaataaacagtaacatagatcatcagccaccaattaattaaaaacagctttgttgttcactcgaaaaaatataggggaaaggaaactgccacgtgcccaagaagtgagtgttgccccgtcattgtcgccagaaagccaagaaaagaaaagcaaacacatttgtttctctctctttctcttcactccaaaaatagcaaagcaaacacattcgtttctctctttctcttccctgctactcgctcctcctgtcctaccaatttatcctcgaaagaaatcgttgattcctcttttttcttcaatttgtttacgtgcaattcagttcttggaaataaaaggttggatttttactctgaacaaagcgaaaggtaaaaccatctcttttgtaatgcagcaatttatgtatattttggcatcctttcagttaatttgtttgattaggtgtgg

SEQ ID NO: 18716 - DNA, 1501 bp, Oryza sativa
agtctacaagagggcaaaagattagtaataagagagatgccatccaatctgcaagaggacaggttcttttagcttgtggtgttcagagaccgacatgttttggtcagtgtttttttttttttgaggtgtcaagatgagcctgaattctgaaggaattgtaaagaagtgatcgatgttaggtgtggcataagttggaagaccactttcagagcctatcactgcattaaaacatgtctccaatggcaaagataccaaccaattgaattagcaacaactaaaaacaaattgcagtagaatcgtactgaagctttactgaactcggacaattatattgaggattcgagatgatagaaccgtgctgagaacactgcgtgcattttctcctgttcttgatgccgcaatgattcggtgagatctttgcggcgaggcattggaggaggattcgatcgattgatcgagtcgaagtgagtgagtgagtgagtttttctgacgatattgatcatgcatccatgcagcaatgtcttcccttgaaatgagctttctcggtactagcagttgcagagccatggaatgatggcaactgctccatgtccaaatgcgtctcataagttaagttgcatcttatcagggtcagcttaaactactaattaacgcgttggttagctgcagaaacatctcgtcagttttctatgcataagcagcagagatgatcgggtcgcaaatctgaaaacatgtatgcaattgcatgttatatgttgagtagaagtacattatattggcgatgcaattaggttgtcgtcggttcagagactccaggcacttgttaattgcaaggtatagaagttaactaataagcttagtaatgtggactggtaattcagtgtcatgttacacatgcagttcgagacctccatttgtcaactacgtcaactctttaacacacaattaattcagagaaaaataggaaaattaataaactattattagtacacgatttgatcagttggccaagtggttgttgacgaatgggatgtcgcagctgcatgctgggcaatagggaaattaattcgattcagagagatcgaatctttgtgtacgtaatctcagaaaatctgacccgattagttaaccaattaattaatcatgcgtgttgaacatattgtttgtaacgtgaataatgcgaatattcggaggaaaaaacaaaataggtgtgcgattttgggggaatttttattttgctggtcagcgctaacacatgctaaccgtcaaattaatcatattgccgcgttgctgacaattttaatgagccgcatatgcagaaatgattacacggtagaagttaataaagaaaccccggaaaaatgcaggcgtattcgaactgaaactttaactactttcaattgacgagctgttcgaagctgaattttggacgcgctgtaaatgcaaatgatgagcatttaggtgatatgtacctcttcaattcaaagtttttcgttgaaaa

SEQ ID NO: 18717 - DNA, 1501 bp, Oryza sativa
aatccattttcaagttttttaactaatacttaattaatcatgcgctaatgaactgctttgtttttcgtgccggaggggaatgttcccaaccgtcacaaacgaaagcagcctagatgaactagctaagcaacggtagcagcgagggcacattggatactgatgaaaatggagcggatgaggacgaataatacgcatatctcatatttgttttcgtatttttatcggatataaaaaacaaatacggatagctcagatacgaaaacaaataaaagttatctcgaatagaaataaagatagaatacgaccggacactaatatagagacaaatattcctaggaacatgaaaaccacctaaatttctaatacaaacaaataaataaatgtctaattaatattataattgttgtagcggggctgaacaccatccccatgctcggccgaaaacatgggtagcgaggaaattggattcgagcgactatttgctcgaataaaattcccatctgcatcagcttctgaccaggaatttgcatttgcctaagagcgcttgttccaaggaaaatgtgttcgagtaagtttgcttggcttgacctaacatcactagtgacattgtatttgagcaggttcattggctaaagcaaatgaagtgacgaggagccaaaaggtgggagagcttgttcgagtccaagcacgggtgttcaactcgggcaatcaaagttaagggaaagtaccatcgaacaaataatatattttagggaagtgttatggggaccacctcaattgctctcaccagctggcactagatgtcgagacgactgaaatgtaccaatatgcccctaagggtaatatgataacttcatataatcctgcaatggcaaacttgtaaatcttgagtacacggctgagcactatttaaaccaaccaagatcctttaacaaggagcatatcagtagagaaaaatacttttactcacttttggcatttgtcttttgagctcactctcaggatagacgagaattcgtactttcccgtctatcctccaactttgtccgtgtccagagatcacgacaataatatataaaatatagtgtaatttataaaaatatttataagttttaaaacatattaatagtttggactagtgttgtgagatgtgctatacgaagtagattagtattgcataagtcctttaatttacttaagattttcctaagagggagcaaagagttattacatattctgttatatcgatttgtgtaataagaagaggaggaagaagggtagggatggctggataaggaagataaacccctctagcttgatgttggatccatccccgacacacgatcccgtctatattaagcatgaagaaaaaaacccgtaaatatcaatgtattagcatcttaattaatctgagcattttgatattcgtaaatcgtaacaggaaattgaatatattaatttggcatttctatacaggacaagattactcgcctggcttggc

SEQ ID NO: 18718 - DNA, 1501 bp, Oryza sativa
agttttacacatatcacaaaagtttttaaataaaacgaacggttaaacatgtttaaaaaagtcaacggtgtcaaacatttagggaagaagagagtatatccctgtgtagagtgtagctagctagattagacttagaatacgaccatgatgggttcacgggatgatggataaatagttttccggtgctacaaaagctttagcattatattattattgcatcatgcatgtgatagctgcatcatttgtatgagtacattgtttgtgttcaactctctatcgacatcgatggacggtgcatgtatggtaccgtacgtatatgctactagctcttcagaaggctggtccaatcgtccccttatctttaatactcatcgtgtctcgtctaagttgtcatttgctatgccgacatactccctctattacctgcattagtagttaaaagtgcttaaattttaatatggagaaagtactgcatattccataaaattttatgcattaaatatattttaataatatgtttgttttgtgttggaaatattattatacctttttataagtttgtttaaacgtaaaaaaaagtcaaaacgatttataatataaaacagaggaagtgtctatctcacaagcctagataaaatgtcttataatggattaaaaacccgccctctatatatccaatggggatatatacacagctaaaatacaaaaaagtacatagactcgacctcacaaaaaggatttccacacaactaaccaacataaacacttaattatgctcacacaattctgaaaaacaagtagctccaaacatccttacaaagtacttaagacccacaatgataccacatcacatccccaatcaacttctcaagttccatccagttttagagaaaaactccatgacattattctctatctggcgataaccattcttcagagtgtcgctctcttcatccttgaccaacaacaaccattgccttgtccaatgtgttcccctgaaaaataacttgcaaaaatagttgagtttggattcttcaaaaccacatcatttctacaaagccatatcgctcaacatatgtaacgctccgcttttcgtgaggcgttaaaaactaattcggaaaaatcctaattgcaaaaattttcgttctttgtgtgcgagtctaagtcgtgccgtggatctcagtttaaatccgtccttgatccctctcgtcgccatcaaaatcatcctcatcgaaattcctcttccaatttaagtctccgaaatcaaattccgaaattcaatcgcctcctttgaatcctcgccaaacacttgtcccgattccaaaaataccgagtccaccttgaatccattccttgactcctccctgtttccccgagtccaagtaatcatattcgaaatttcattccaaatccaaatcccttccaaatcatctctctgcataagtctattttgcctccttctaattttggatgggcctgatccccctcccctcggcccatc

SEQ ID NO: 18719 - DNA, 1501 bp, Oryza sativa
atatgggtgcaaccacaacgcgcatgctgttattagtcctagaaattagtcgaagatctctgttttttaccgtttccttctcgctttagatgaatcagtcacatatgttacagttgtttcttcagagttcagattcagagaggattaggtactgtactagaaaatgtcagttgtacaccgtgggttatccaatattgacagcctctgttccaaatataagaatctactgtagttagcaaccaacataaaaaaatagcagtgatcatactgtttaaacagttatttgtagccccagcataaggtaaggtcatccgtgaactgtaatagcacacaactgttctaaagacttcagcaaatttggcccagaggatgtggcccatcagtagtttgtccaaagaggttaggcccaatatttgtttgcatgccactaattaattaatcactcaaaatacattacatatactcctacctactatgtgttgcatgtcttctatgcgtagggattggaattaatcaaatgaccttattatcaccttcaacatgatgcatgtgatgaatattctgacctaatctggaacatggacaacttattcatcggcaggagtctcccctgcttgttcagttttcagcaaagtttgcactgatcatacggtcataccgtttttcagcaaacaatctgtaaccccggtcttgggctctgaagaaagaaacagtatagtttgttgtttagctaatcagcaaatctggcccaagaggattaggcccattatttaatttgggtttgaactaatggagacaactttcatcaaggcctaaatttaatccattagggtggtgagcctgtcagttttaaaaatcaaataaaatgaagaattattagatggccgtgaccttgactcaggatcagtagtatatggaccgatacaggtttctttcggtagataggtagccagtaccttcacaaatctcacctaaatacgccattttatctctcccaacgttgacatctctctctccctttcttccgccgcagattacaccatcacaagcagccagctcctgcgtgtgcgaggatgaagcatgcataatggccaaattggcccccctttttaggtcgccatgcatgaacaatggccatcgatcgagctctcctctccctttctcccaccaaaccccacaccattttctacctcgcatttctctcatctccctttccacaattccacatgcatccaaaaagactacgtgaaaaagaaatcatttttcgcgtgtatgcttaaacaaaaagaaaatgattggacattttctttcacgtgtatgcttaaacaagagatgcagtacgtggtaagggatgcgtgattttaaccctaagggtctcatcttttcgcttatacttatcaaacaaaatttgatttttcgaccttaaatttggagttcattttgggttttttttcatcgaagtttattttttggccttcgcttttaggttgataaaaacatg

SEQ ID NO: 18720 - DNA, 1501 bp, Oryza sativa
acgcattttgtgttgaagattaagattttcgtggcacgcttttcaaactgctgtttcgtgcgaaaactttttatatgaaagtcgctctaaaatatcatattaatctattttttaagtttataataattaaaactcaatcaatcttacattaaaaacacctcgttttacgtaaaaaaattaatatttatcttaagaaaagaacaccaccatactcttctctttttctttcttgcatctcatagaaaacgtcccatgtgaaatactagatctctcctcctttgctcataggtgaactgataacctattgttgcatttgtgctactgcaaaattcagcagcacgcgtgcatggtaacaccaaaaccgagttcatactacggacttgtcatctttttacatgcgagcagagagctggccaccaattctgtcactgatctgcctgccagcaaccaaaaaagcagctctcctttcgcctgcatatgctgtacaaaagccccccgtcagagattgcagctcatctaaaacatgcaatgttcagtgcacatcgtcgacagagcaagacagcaacaacctcacgttcttggacgaagctagctagctattgcaatgaacagatacaaacttttttcaggaaatcatgcggaggaacgccaaattttactcagagagatggagatatgatagtagtagtaatctgcttcaaaaattcaggtgattttcaagagagttcgatgctgctgctgctgctgggctaatgctgtccgtccactactagttgccggccatcctaatgtgtactggatcgcacattggaaggtgaaggattaacaacgtttttttggctaagctacctgttgctgtccaaattatcaggggaatcccatgcccaaaacccaaacaaaatatgccattccatatgccaatgcaatgcacacacacaccaacccaatctcaaggaagaacaagaacaagaacccggtgatgttgactcccacatctctgggccgcctcgccttccggcccaacatgtcctcccacccggcccatctaaaaaaccccatccggtgctttgaaaaagtcaacgcgaggtgggccccgccggacagcacgagtacaggccggaggcagctgagcctgacgcggtgacggacacgtggggaccacccgcccggcccagcccagccgctgccatgtggggcccacaggggatggatggaagccgcgcggaagcgttaggcacaagggggggggggggggggggggttcgcataaaggcgaaggcgaagaggccaactcggcgcccggattcggacgccgcgtggggggaggaggaggaagacggcgaccctcgccgcgaataaacaattccaaatggtggccgccaccgcatccaccaccaccgcgaggacgacgaggagcatcaccacgcgtactctgcctcctaccacctagctaggagctaactaggtcgtcggtgctcgagatcgggggagggaggcgcga

SEQ ID NO: 18721 - DNA, 1501 bp, Oryza sativa
attttagctgtgtatatatccccattggatatatagagggcgggtttttaatccattataagacattttatctaggcttgtgagatagacacttcctctgttttatattataaatcgttttgacttttttttacgtttaaacaaacttataaaaaggtataataatatttccaacacaaaacaaacatattattaaaatatatttaatgcataaaattttatggaatatgcagtactttctccatattaaaatttaagcacttttaactactaatgcaggtaatagagggagtatgtcggcatagcaaatgacaacttagacgagacacgatgagtattaaagataaggggacgattggaccagccttctgaagagctagtagcatatacgtacggtaccatacatgcaccgtccatcgatgtcgatagagagttgaacacaaacaatgtactcatacaaatgatgcagctatcacatgcatgatgcaataataatataatgctaaagcttttgtagcaccggaaaactatttatccatcatcccgtgaacccatcatggtcgtattctaagtctaatctagctagctacactctacacagggatatactctcttcttccctaaatgtttgacaccgttgacttttttaaacatgtttaaccgttcgttttatttaaaaacttttgtgatatgtgtaaaactatatgtatacataaaagtatatttaacaataaatcaaatgatagaaaaagaattaataattacttaaatttttttgaataatacgaacggtcaaacatttttaaaaaagtcaacggcgtcaaacattttgagatggaggtagtatatgtgtactactagctatatgattatatgcacacaactgtacattaacctaacctgatgaccaggagatcgagattaatcatctagctagacgtacaaaccgaccgtggattaaactgctcattcgcgcctagggaatcgattccgctaattaattacggtgttcaaacagtaatctacactcattgtatacagatatcgcccatgtaaaaccaagtaatcctccatgttacaccgctgtcacacatcgtctttcctccatcacatcaggccaagcaggtcaagcaaaaaatcatggagacagccaaacaaaccacgggctgatggaaaagaaaggcagggtcggccagccatatttctgcatcggtctctgaaatctgaatactacatccatgtgtgttatccagtcactgagtcacggcttcttgtcgcatttggcccatctcccgaagaacatatatgttaatgtaccatttctacgtactcctactccattccgttggtggcgagtgagcgatctctatataaagccgagatcccccaactcggagagctcagctcatcacacttgcagttgcagtggtggtagactggtagtgcattctcagcttaatttgcttgagctagtagctgctcgtgagctgtgcaccaatgg

SEQ ID NO: 18722 - DNA, 1501 bp, Oryza sativa
gtccttggctactgatcgaagtggatggacagcttcattcgccgacgtctgctgcgtgctcatctttctggtgtggtcgatacaaccaaaaagaaagaaaataaaggaggatgaattggagaaataaagcaagggagacaccatcttttcattgccattattccttccatcccatctacaattttctctgaaccaaggttggatgtattagctagcaaccggtggttatctcatgatctcatctggctgtgataaattatttttctgaaaattttggtctgtgtataatcagcacaccgacagaaaaagggcatgctaattcgtgcgcacatccatgtcaattgaacatacccctgcatatgggatcatccctaattagcaacatgtttgtttttttctttgagtaaaacaagatgatatcgataatttaatattctactactgtggtagttccaggaaatgtgtagttgtatacagtcacatcttgcagtacttctttgcccactgtgcaagtatgtgtttccacaaaatggaacctaatgttggggagatcaggataggctttagtgctttacatatatgtccccctagctaaattaatcttctcacaccaagataagagttgctgatcaattgaaggaggcattgaaatggagatttgagcgtatctcaatgtttaatcccttccaatttattggctcacaatacattatctaaatcccttaaaatttacattatctaaaaaaaatggctcacaattggccatgagcacataatctcccactggtcaaatccaatgcacctccacaaaagcatcacacaaattactttataaattccctccattgtttgcgccaacaggcatgtgacagcctatattgcttaattccctgctaaagaaaaggcaatgcatcaaactctgaaattgcaagtaactcccactagccccattttgcagtatattgacctgaagatttgccaggttgatcctgcattgaattgtggccagttttacagaccaattttccgtttctgaaacagtgccattgacaggtgggcccaccccatctttagcagttaattactttggatcttcggttttgcaaatctcagggaaaacccttgagcaacttctgcttctctcaccctgccattgctgtgtatttaagtggcattgtctgtcacctccttctcccacttgttttctttcagtctttctttcttcttcttgtttgctgatcttgttccttggtggaaggatgcttgtcacctactcctttttgagttccccactctcctcacacttgttctacctctcttccccataaaactattatcatctttggagccaaaagccaaccaagaggagaaagcaaagggaggagaaaagaagcaagcaaagcaaagcaagaagcaagaagcagctgctcagctcagctcaagcaagtaagtgaattcttgcttgatcgatccatcgatcgatcgatcggtttgctggtga

SEQ ID NO: 18723 - DNA, 1501 bp, Oryza sativa
ttgtcccagctgtagcttttcccaaaagctgcttctgctagaaactgcccctaacagtccacagcttttgagaatatgtagttaaagattctgaaaaataaactaagaagccagaagctgggtttcagagcttttccagattcttagaagctggctaccaaacagctacttttcagaatctaaagctccccaaacaggccctatgttttctagcttgagccaactcgatctggctcacgagcctcttcacttgaacagttgcgaaacagacaagcaatgatagacattggagagattgaagcataggtggaggccaagtctagcgcaccacgccccttacccaggcattcgaacttgtgactcataggttgtaaactacacctgcgaggacaagctggcaaggagcggcgacgttatttccaatttcaattgagggggaagcgactagttggttgcgttgtcagcgtaggcgtaagtcaatattgtgtaatcgtacaaatgtggctcccttctacgctattttctgtgtgcatgacttggcggtgtagcatgagtatgcactcctgttgcgctgtcatctgccccaaaagaatagagagaattagggtttttactagtgcttatctttgagctagacaaataaaccaaactataataggctggctagcgcgagctaccgaataactcatgagctagctcgaacccagctcattctagaaatgaggttcggaggaggctttggctctgctcgtttggctatcgatcgagccaaaccaaaccaatataagcctgagtgttttttcctacccctacaaaggtttaaactcttaccataagcacagttgaaggctatcacaaaatacaagtttggtaactagtactccatttcaaaaaatagatttattctcttttcttttcgaatataagttgaatgaaattacgtggtttctttgaaacgtcagaaatcagtttaaataactctttacagcgtcgatcgctctgtccagctaccatttcacaatttttatgggataatagcagcatgaccggtagacacatgcacatatcacgatgatatcatatcttttttcaacgaccaaaatgaattttggtcggtataacgtggttgcacgcatatggttagttgcaggcattaacgaacgtgctccgagacaatagatactacaaaatgattgattccaatgatcatggatatgatcgaggtaattaaacatgtactccctccgtttcaaaatgtttgacactgttaactttttagcacatatttgaccgttcgtcttattcaaaaacttttgtgaaatatgtaaaattatatgcctacataaaaatatatttaacaatgaatcaaatgataggaaaagaattaataattacttaaattttataaataagacaaacgattaaatatatgctaaaaaatcaacggcgttaaacattttaaaacggagggagtacatctatgtattcgtggatgcaacta

SEQ ID NO: 18724 - DNA, 1501 bp, Oryza sativa
actcaattcagaagcataattgggagcttgaggtacttggtgaacacaagacctcatctaagttattcggttggttatgttagcaggtttatggagaaaccgacctctgaacattgggctgccatgaaacatatctattattatattattaaaacagccttgaaaggaggcaccacgttcgctgtgggggctagaaattcccacattaatcgaagaaaaagaaaaaaagaaaaaggagagtccaagtagaagtctaatttaaaaatacttgaaattcggaattaaaaataagaaatattgaaagaagtttccatataagaacccaatatgagattaaccaaaatttaaaataaaaaaaataaaatctaaaattagaaaaggaaaggagagtccaagtagaagtccaatttaaaaatagctgaaattcgaaattaaaaataagaaatattaaaagaagagtccatataagaacccaatacgagattaattaaaattcggaataaaaataaaaaaaatccgaaattagaaatggaaaggagagcccaagtagaaatacaatttaaaaatagctgaaattcggaattaaaactaagcaatattaaaagaagtgtccatataagaacccaatccgagattaaccaaaattcgaaataaaattaaaataaaatccaaaattagaaaaggaaagaagagttcaagttggaatacaatttaaaaatagctgaaattcggaattaaaaataaggaatattaaaagaagagtccatataagaacccaatacgagattaattaaaattcagaataaaaataaaaataaattcaaaattagcaaaagaaaataaaagaagagttcaagtagaaattcaatttaaaattagctgaaattcggaattaaaaataagcaatgttgaaagaagaatccgtataagaacccaatacgagattaattaaaatttcaaataaaaaataaaataatatctaaaatttgaaaaactaaaagagagtttaagtaggaatacaattttgaaacaactgaaattaaaaataaaaaaaataaaaacatttaaagaacacaatacggtattaactaatttttttaaaaaaataagttctgaaattagaaatgttaataaaacaacaaatagaatcctaatgacgattaaaaggagggacgtcaggcaggctgtgaagcaaacaagtaaggcggttgccgggacttctagaaagtaaaaaaataaaccccattgataatcatattcgatttttaaaatttcaatgacataaaaggagaagcagcgggcgggcgtataagagttatagaaaataaaaaatgaatttcaacaatagttatgttcgatctttagaatcacaatgacaataaagagtaggcgacagacgggctgtagaggggcatagtggcatcgttcaaattttaaaggatcggaacttccaaaaagtaaaaaaacctaatgataatcatgttcgattttaaaatctcaa

SEQ ID NO: 18725 - DNA, 781 bp, Oryza sativa
  unsure (1)..(781): unsure at all n locations
accgggtcggcgcaccccttccccccgggctgacgcaataaacctttttaaaattanaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggt

SEQ ID NO: 18726 - DNA, 1328 bp, Oryza sativa
cccaagttagtgttttaattcttaaaacctgcttaacaactaaaatgtggaatggttggcctgggttggcttggacgagctgggacccagggtcgggttgccagttcggtctgaaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattcagcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtgtgtctttgtgtgtgctgggccttcgctgcccatgtaataaattatctatttacgcttccgcttgttaaactctgaattgtatcaacttttggtgtaccttgcctcctgggacaaggattaatgcacgcacacaaggaacgcccgttgggtcagttccggtcgtgacataatgtttctaagcaggctaagcaattatatctaatatctagttgaaccaatataaataaagctcaactagtcaaattgtaataacccaaggtatgaaggaatgaagtaatcaagtacaaaagggccataacaaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagaacaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggcttaaattgaattatgacgcaataatgaattatttttgaaaaggaaaagaaggtttattgcgtcagcgggctagggtttcggtggaccgggcgcacgggcggcggttcacacgaacggacggccgagatcaacttgatccaaaacggacggccgagatcgatcgggtccacggcggctcacggcggacgaccccga

SEQ ID NO: 18727 - DNA, 717 bp, Oryza sativa
agggagatgggccgacccggcccaaaggagggaagggggacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcagg

SEQ ID NO: 18728 - DNA, 587 bp, Oryza sativa
ttttagggtttttctttttacaaaaccactttaactttgtttatttcttcttaattattatttgagctctgaaaattccactaaaatttatttacgcattttaagcttttaggaaatatacaaaaatcctccaagccttattcgacttttaactttgcacattttaattgttggaggctttcacatggattttacttattctttgcataatttcgaggatgcattttagagtcgttttgggacgtgacacattagtacacattcgggacaacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagg

SEQ ID NO: 18729 - DNA, 556 bp, Oryza sativa
tcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttaga

SEQ ID NO: 18730 - DNA, 376 bp, Oryza sativa
tttggtgtaccttgcctcctgggacaaggattaatgcacgcacgcaaggaacgcccgttgggtcagttccggtcgtgaccgacagcagacggggtgtaacgccccgattttcgttcgggaataaaaatcaattaataatacattttctagaaattaaataaaagttaaatcaacttaatcaagtgaattattgagggaattaaaaatttcctttaaaaatcattggccgggaatattttgtaatattctttgtgccctaatgtactctccggaatttttccgtgaattttcggagctcgagaaatagttttaatagcacaaagatcattgtatcaattaaaataaaaagaaaacaattaaaatcccccttcctctc

SEQ ID NO: 18731 - DNA, 1056 bp, Oryza sativa
cctccccttcctagccgccgttagcgcagccgcctccgcatcgcctttgcgccgtcgccttcgccgccggttgtcgtcgccggcaacgcgttcgcgcgcgcgccgtcgccgtcgccgcggtcggtcggccggccgtgagccaagccgagccggtgccgctgccccttctctcccgcgccgctgaccagtgggtcccgtgtgtcggcgcccttcctccctctcccgagtcgctgaccggtgggccccgcatgtcggcgccgcgcccccgtgctgacgtcagtcctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggctcttccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaatattactatgggatggttacctattgttacagccatgctaatatgataccatgctcctttgttagcttgggttataacatgattagagttaggactagggtttgcttagccatgcttagttcaactagcacacaatggggagatctcatttaaaacctagactataggtttatatgataatgttggactagtgacaccgcttgggtgttggttaattaaaatgaatcacatggtgggctgtgggtgcatggttttgctggtcgcacccatggcagttaaggaccggttcgcgggatgccctggaagaacttatcgtacttaccacaagccagcgcgggcaacggctgggcttgtagtgtagctttcctctagccgacgcatccaggcaagggtgggcatga

SEQ ID NO: 18732 - DNA, 453 bp, Oryza sativa
ttgtaataattaagcagtattaatcatccactgtccaacgctacaccacgttgcgacaggcccaaccatccacctaaacaatccaaattcaaaagattacactagggtgagactaatcacggtgaatctggttgactgcccataaccgcgggcacggctattcgaatagttttactctgatcagaggtgtacaaatgtacccacaagacacagccccacgacacgtttccatgcgccgacatgccaccacgacatcccggaaagaggccgtgacaggaccattcgcataaccccctctaaccaagcacaccacacctcaggtttcacccccactcctcgcaaggcagcaggcagtcccctctcgtgcctaggtgaatccggaagccgcataggccgtcgcagggcccatccaaactccatcatgcccacccttgcctggatgcgtcggctaga

SEQ ID NO: 18733 - DNA, 709 bp, Oryza sativa
tttacgcattttaggcttttaggaaatatacaaaaatcctccaagccttatttgacttttagctttgcacattttaattgttggaggctttcacatggattttacttattctttgcataatttcgaggatgtattttagagtcgttttgggacgtgacactgtcacttcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaaatgatacaaagaacagttcagtaattatttgatcaataatgatctaattataattgttaagttcttttcttgtttaaaatccttaaattataaattgttgtttaaaaggaattattagaaataattttaaaagcttaaaagataagacctaattttaatttgttaaatctcaatataaaaatgagctagataaaattttattaaatactttgcttgttcctctattttctagaattttctaggaattgtttgagcaagggaagtattttaataaatgaaacatcatttcacgaattattttaattggaaaagtttttaaaatcctcccctaagt

SEQ ID NO: 18734 - DNA, 619 bp, Oryza sativa
agtgtccaggtgatatgaatattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaacggatttattgcgtca

SEQ ID NO: 18735 - DNA, 624 bp, Oryza sativa
agtgttttaattcttaaaacctgcttaacaactaaaatgtggaatggttggcctgggttggattgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaattactgtttactgcaaccctaacccctttatggtataactcctttgtactcccttgcatttattctgcacttgtgggtgtgtcttgttgagtacggtggttgtactcagtcttgctcaatttttcccaaccccagaagaagagttccaggaggatgaaggcttcggtgtctagctcgtgcctgccgtcaagcgcctgtggtcgtcgccctagtcttccgctgtttctcgtttgtctttgtgtgtgctgggccttcgtcgcccatgtaataaattatctatttacgcttccgcttgttaaactctgaattgtatcaacttttggtgtaccttgcctcctgggacaaggattaatgcacgcacgtaaggaacgcccgttgggttatttccggtcgtgacaga

SEQ ID NO: 18736 - DNA, 665 bp, Oryza sativa
tcatcatgcaaagtttatatagagagcagttcaattctcttttggtttataccttcctactagcatttctcatatttttgatgggtggctcttaggggtggacaagaaaaagagtaaacttctattggttggagcttctacaatatgttgggcgctgtggttgagcaggaatgatatggtttttaacaaatcatcatcttttacatatatgcagataattttcagagcaacatattggctctgattttgggcacaattataaaggtgtgatgaagacggagatcttctaaaggttgcatgtcgtaaacttgagacgacggttatacaactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgt

SEQ ID NO: 18737 - DNA, 427 bp, Oryza sativa
attgaatcccaatttgtaaaattatgttgatttaaattattgcattatcgctttatttaaattcccgcgttatcactgttttatctagccatgcctatttacctttgttacgaccttattattattgtattgttagtatttcctttttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactgttggattatcgtggaattggcttcacacctccccctctattcaaaatccccaaaatggttttaggctgggctcggggtgcatggttttgatagtagcacctcggccatataaggaccggt

SEQ ID NO: 18738 - DNA, 441 bp, Oryza sativa
tgtttttgtggttcaagggaaaaaatcttggtcgctcgttaagtgagttttttcaaaacgggtcagtctagggttttagtaaaactattgggatttattcgtcagtcagttggggtttgatgggtgaaatgcattaggtcctatctcaggaacatgggttgcaaggtatttatgctttatttgttattattagtatatatctaatttctcattattttatcgttatgtgggtctgtcttgtttattcgctctcatgcaaaatgatctatgcataaaaatttcgctcttattcgtttcccttatttgagtcttttattgccttatttaaatttggatttgagcatgcattgatcctactcctttgtcttctctagatggctggccacccacccaaccaccgcggagaaggcatgatcgactttgtggcagagctggcacgca

SEQ ID NO: 18739 - DNA, 917 bp, Oryza sativa
aaaaaaataaaatgaaccgagtagggagtaccttagaaagttagaatgaatattaggacccagtgatgaaaggtagttttctcgtaattagttttgattatctgaaagcaaaaggttctttagccatgcagatttgggaatttggacgctttatgtgcgaatgctaattggcgaacgcgcgttgccattgcgtatttccggcccacaaggcctacacacgcgcgcttcttctctcttttttcttttttttttgacaccgccgcttttttccttttttttttgacaccgccgtttcttcttttttttcgctgttcgctgttcctgccgtatggattagagaaaaaatcgtaattagtttagactagtttcctatttttactagtgaatagtttactagtaatttttaaatctcaactttaaaattttcaaatttggacttgaaagttttcaaatctcgagttgaaaattttcaaatctcaagtagaaagttttcaagtatttcaaatctagacttgaaagtattcaaatcttgtgttgaaagttttcaaatcttgagttgaaaattttcaaatctcaagttgaaagttttcaaatctcgagttgaaaattttaaaatctcaagttaaaagttttcaaatttttcaaatatggacttgaaagttttcgaatctcgagttgaaagtttttgaatctgagttgaaagttttcaaatttcgagctgaaaattttcaaatccgagttgaaagttttcaaaatttgactttaaaatttaaatcttaaatcgaaagttttcaaatctgacttaaaaattttcaatctgttagtaaaaaaatctcccgaaaaaagaaagaaaaatcttgagaatcttcctaattacccatcattagtgttaagtgttaactaatatatagtagtta

SEQ ID NO: 18740 - DNA, 1046 bp, Oryza sativa
agtctatcaagtgacaaacagaattagaagttgcaaaatcaagtcgaacacaggggttaaaaacatttatcaccagtttaggtctatgttgaggacagaacaattcggtgcaacaataaatatatagtgcagatcaagctacatctgaatagatatgtaactctaagtatattacttagaaacaaattgaaaatttatactagttgacatcaaggaagttttattacagtataaattaaattacctatatagactctagaatcccccttaggccaaaaggacatgcagtaacttgtagccacacaacctctaacaaatagcatgcatttagcatcagcctaagtatattcagcacaatgcgccatctacctaagtggcatgaaaaaaatgtatattcagcactcaaaggcagaatatcagatccttgtatcctcaaattcagatcaacacatggccaccaactttcagttaatctcaaacagaagagcagctagttcgaccaacacagtttcagattatatatgtgtgtttatttaaaatccaagatatatacaacttaatgtattacaagttgcagaagtacaaatcattatatgcccagaattttctctattacagattcctaaaattcaatatgagttacagttaacttctcggaataatcatcacaaagaactaataatctaaaacatgatattcgttagaaaaatcatttcagtgtcagtagtacaactgaaagtggcaaagaaggcttttgacacaaagagggactagcaagaataacaatgccttgaaacaatattcgttcctctgcatatacttcttatttaagagaatcctatgatctctctatacaagcttatacattatattcaatgtctaatctaatcctaatagctttttacaagtttgtactgtgaatcggcaaacaaataagcaatccctagctggatcaacaatttcaacatgtgataaagatttgcttcattcagatgttagcagagcaatctaatctgctgcaccgaaaccaagaacaaaaatagcaa

SEQ ID NO: 18741 - DNA, 157 bp, Oryza sativa
ttggccgtgtggcagtacgcaggaggctggcccgtggaggacgtcgatgtagctttgcccacgtgccggcagaggatggtcggtggtggagcatcaaagcaatagctatggattggcaggggagggctgcgggtgataacctgcgcccggtcttagc

SEQ ID NO: 18742 - DNA, 1501 bp, Oryza sativa
gctgtcttttctcgaatcttttgaaccctattttggccgtactcctatggatgaagtactccagcacagttctctctcattcaggagcattcatggcttctttatggcttggattctcatctctgatgcacggaagccaacgtacgtactagctgctcaaacgatgccaagattcaaacgagtccaaaaaaatctgaaaaatgcagagatcaaacttcgcctaaaaaattcaaaattcaaacgtgcagagttattgtatccataaatgtgggcaggtcagatagaagttccgtattcgctatcagtgcactccgatggcccatatcagcagccatcaatgcaggaataatgtccgacaccatatatgtaaaatttacaccatcattttaagatcagtacaagggacaaggaaggagaaagaagggacgaagtagccattttccgcatcgaaattttggttaaaaagaattttggagcactaatgtataaactgaaatacttactactttccaaaaaggcaaaaagaatagaattcagtaaaagcagagccaagttcttaaaaataatgaaaacatgtgtatataactaatacttcctccgtttcacactataacacttcctagtaggcactagcattgtctacgacattgtccacattcaaatagattcatagcatgaatgtagataacgctaggaagtcttacgtcgtgaaaccgaggaagtagtattttacggtggtccgtcggagtatttaccatatgtattattatcagtgtaacaatagagcatattgaaaaaaatatactaattaaccaatttcccatataaaaattaggaagcccacacaaaaatgagtcttaggcatgtgctcaagaccactggaagattcttttcttcttcctctgtcagtgcaggcctatgaagaattcctattgatggaagaagagctcagtcttttgcatttgtagccaggacaaggagatagctggagctttatttggaattcgggtacatacaattctaagagattttacaagctcaattttatgccccttcagcccccaagaccctatatttggctatggaagtcaaagtgtgttatgaaaattaaggtgtttgcttggcttcttttcagtgacatgctaaataccacggatatgcttgacagaaggcattgtgcaaaggagaatgctgatttaacttgtgtcctgtgtaatgggggtcaaagagaaaccgggcttcatctcttcttcacccgccctttcagtgttagatgttggcgacatctgggtatcacttggaatcagcacatggagttctttcaaatgattgttctatcaaggttgaactttgccagaatgggtttcttggaaattttttttattgcctcttggcacatctggaaacagagaaataggtttatctttcagaatgttgtgccctctttttcagtcatggagaagcctcttcaagaatgaaattcttctgcatatgtgcagaa

SEQ ID NO: 18743 - DNA, 934 bp, Oryza sativa
ctgtagtgtaaatgaaaagaatggttaaaggatgatataagtacaaacggtaatttattttttttctctagagcaattaataaagtgggttgtccattagccgataatctcatgctatgctaagccaactacagttttatcgtctctgcacagtgtgggtgggccggtctactcaattattactaataatgttatgatatgttattgaatgacgatacagacttttgctaatataggttgattaattatggttagatagatccaactaaaaagataaaaataataccatcattttgctcaataaaaacattcaattatggtcttcttttctcaatgcatgatatatgataagtatcagtatttatatggtatttttctaattctttcatattagtttttacatatatgttaatttagactaatattttttcccataattaaatggataaataaatcttttttctatatttatctaaaatattttaagtgtatgtaatttaatatgtaagatatggacttatagtataagatttatcttttttaaaaaaatgtggcaccatagtagatgggtagtttagtgaacaaccataagaaatacgccctccatcccataatataacacattcacctaaaatcttttattttatattatagtacggagggagtagagaatttgttgtatgccactgattttggccatattctatattatattaatgtatcaatgagtttgtcaagttctacaatatgccatcgtattttgtttaacttctataatataccatcgtcattcagttaggctccattagtgctattgtacaattttatcctaatgaccgaaataccccgtgatgaactttccaaatttggttaaaaattttctgaaatatcaaattataatcttccaaagtttgagagcagcaagtcattgcaa

SEQ ID NO: 18744 - DNA, 1501 bp, Oryza sativa
tgatgaagaattgggctaattgggctagctactggttcggccgaaccaggccgaaccctggccaagcccaatcagcccacaactttgtaggtggacttcttgttgattcctcaatccactgatgtgaattattaggcttgtttactcgtgtgaattctgtattattagcccatctgtccacaagtttgcttctcgatggcttccgattgatcgttcgtttgctttccgtcgattctcctccatttatatgtgcttctcctgcatacatgttagtagcatagtacatagtggaaatagacattttaattggaatttatgcattgcaagcatagctagtcttcattaattgggtaatatggacggtcgaaattgttcgataacgactgtcaacagtgcctagtcctcactgtagccgatatgaatagagatgagcctgtgctatcggctgcagcttatttctagtccaatactttgaatgcttttttattcaaccaaggaccaataacaccaactctcctggatatagtcatgatcatggacttagacatcacatcatcggctaacccagttagtatgaataccaagggcaaattctcttacaaaactaggagcatcggaggttggattggcttcatcacccagaacatgggaactggttctgtaacccctaaggaacacacagcctttctaatgatgtggttggaaaagttcttgttctgtggtccaagttgtggccctactaccaactggcagcacatagccaaagcccttgtagacaagaagcaattccccttgggcaaatatctgctaggctcattgtatcaaactctgaattctgcatcggctaagattgctgtagattctgtcattggcactggtggcccttggtggcttttgcaagtatggctcaaccttcataccatcaaggtggctaaatgtcacaccccgaagttctcctcccaagcctaaatttaatttataaatgaccctaagaaaataccggtgcaaagcaagagtaaaccccttttaaatcaatgcaaataataatcggaattggcatgtggaatttttcttgagttctaaatgtcgaaattcactaacaggatttttagtggaattttcagagctcttgaaataattttaaccaattaaaatggagcaagcaatattttaattccagggaaaatccttttctccttttttctttttctttttccctccctttttcgaatgggtcgctggcccatcctctcctttcctccccctcctccctgctgggccggccgcaggccgaggcccagccaagccgcccctccctcctctcccggggtcgcgacaggtggggcccacctgtcgggtccttccccaacctcccgccgctcccgccgcgccaccgcgcccacgtctccgcctcctccgggccacgtcgaccacgcccgcgcgtgcgccgcgttccccgcgcccactcccctctctctcccgttcgcgcccgcgcccgaga

SEQ ID NO: 18745 - DNA, 1501 bp, Oryza sativa
cttgatagaacaatcatttgaaagaactccatgtgctgattccaagtgatacccagatgtcgccaacatctaacactgaaagggcgggtgaagaagagatgaagcccggtttctctttgacccccattacacaggacacaagttaaatcagcattctcctttgcacaatgccttctgtcaagcatatccgtggtatttagcatgtcactgaaaagaagccaagcaaacaccttaattttcataacacactttgacttccatagccaaatatagggtcttgggggctgaaggggcataaaattgagcttgtaaaatctcttagaattgtatgtacccgaattccaaataaagctccagctatctccttgtcctggctacaaatgcaaaagactgagctcttcttccatcaataggaattcttcataggcctgcactgacagaggaagaagaaaagaatcttccagtggtcttgagcacatgcctaagactcatttttgtgtgggcttcctaatttttatatgggaaattggttaattagtatatttttttcaatatgctctattgttacactgataataatacatatggtaaatactccgacggaccaccgtaaaatactacttcctcggtttcacgacgtaagacttcctagcgttatctacattcatgctatgaatctatttgaatgtggacaatgtcgtagacaatgctagtgcctactaggaagtgttatagtgtgaaacggaggaagtattagttatatacacatgttttcattatttttaagaacttggctctgcttttactgaattctattctttttgcctttttggaaagtagtaagtatttcagtttatacattagtgctccaaaattctttttaaccaaaatttcgatgcggaaaatggctacttcgtcccttctttctccttccttgtcccttgtactgatcttaaaatgatggtgtaaattttacatatatggtgtcggacattattcctgcattgatggctgctgatatgggccatcggagtgcactgatagcgaatacggaacttctatctgacctgcccacatttatggatacaataactctgcacgtttgaattttgaattttttaggcgaagtttgatctctgcatttttcagatttttttggactcgtttgaatcttggcatcgtttgagcagctagtacgtacgttggcttccgtgcatcagagatgagaatccaagccataaagaagccatgaatgctcctgaatgagagagaactgtgctggagtacttcatccataggagtacggccaaaatagggttcaaaagattcgagaaaagacagcaaattttttacgtttagcctgctaaatcctgaccatgtccggacaaatttatcccggcagtatttacacagagcttcttttggctcattagctgtgctttacttaggtggtgtttggatccagagacttaactttagtccctctatttaaacactaatt

SEQ ID NO: 18746 - DNA, 1501 bp, Oryza sativa
ttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagttgtaatagagttaggagtcgtgtccgacaagggcatatcatgtattttgggtataaaagtagcccaaaaccagtgtaacaaagtaacaatcagttcaataacactttcgacgcatcgccaacctttcactttcgtttactttcgatgagttcttgctttcgagttgggctgcatcagtttgatctccgacgacaaggtaaaacttgttatggcggtttgtgttctcgggattagtggttctatcttcatgatactctaatcttgtaatagccctagctcataaccaggtatttagaagtgcatttgttgtcttttagattgcatatttactatattgcaatttgatcatatgcgataacaaaattaactctaatcggtaaaattgaaaccacttctatttgaacaataacttgaacagaagtgtacatgtttaataatttattcaaatactagtttatttatcaccaacaaatataaattttgtggaatttttcctctctttttagacctcctaaaaattcaaactaactttcagattaactgaattcactttttcactagaattatttaactcaacattttttagtgaaaccaattggattagaaagcatgttccaagacccatctctggaccagaggccaaaatttgaatcccctcctaagcaattcgaattagcaggtcatgagtgagaagagggaataaatcttagttttgtcttttcttcttgtctcttcctctccaacccctctctctttgacatgtggatcccaccagcagtccctggcccacatggcagtggcccaaccctctcatactcaggggacaagcagaagaatagccatgccacgttttggccatgcaagggagagagacaagtgtgacacctctctctttactctcccttctcctctaagcttctggccactttctccactcctcccactc

SEQ ID NO: 18747 - DNA, 209 bp, Oryza sativa
ttatttgcgttggagcaaggcaagttattattcctctcctttgagcataactaccctatattctatatctctgttctatgcattagtcatacatgatttcaaatgcataacctgaacatagcaaaccagatatgctagattttgcttagccatgcctagttagattgcataaaatataataaacttagattgggacagtacggtagaaa

SEQ ID NO: 18748 - DNA, 459 bp, Oryza sativa
ttatatccttgtcacctaaatttccttttagcctcaaacaattccttgaaacctatgccatatatattagggttcaaatcctatccttttgcctccacctattttcctaccatattcccaaaaatattttgaggaatactattaatttccttttctatttgagtgcttccaaataaattccctcaaactccacctctaaatattgcactcaaataaattagaaaatctcttttgtgaattctctccgaattcaaattcttcgcaaaacctagttatccaaatcaaatatataaattagacttctttctttttgtcatcgggccgaaactccgttctttcttccttttggcccaatcctttttctttctattttcctccttcctcttgggcttccggcccagctaagccgagccggcccaagtcagcccacaacccagccgcctccctcctcctcccagt

SEQ ID NO: 18749 - DNA, 1194 bp, Oryza sativa
attcctgcagcccattgtcgtcgatggaagaagttgtgtctctccccgacctactccaggccgagcaaagggcaatcaacctccggagggcgataccaagcagaagaccgtcatccgcttcaacccacaatcagaaggaagcttctcctgtgaatgatagcaatatgcagtcctatcacatcatcacagaactaatcaaggatgcagtcactagaacaatgccagctatatctctccagaatcaaaatgagcagccatatttgtggttttcagttcgctacctatcattgtgtaatcgaaagtttgcagcaatcatgtaatacataaatatattcatgtctataaacagtgagcttgctatgcttatggatgattcatgttgaagatacaatgtaccgatgttaagcaccttccctttttgtttaaggcagtgcctcgtattcttgtaatatgggagaaatgtgtaataaagacaagttctatgaggactctttcagaagatgctgatatgggattatgtgtataattgtttactgtcaaaggagacctagggtctcatttcagaggaactatgttctaacctcgagttaataaccaacctgttgatggaaaagaaaatcaattaaactgtgttgggttaaaaggccaatgagacagtagttggggataggagtttggatacgccttttacagatcaagataaggattgttggatgaaacccataagggtacccgccatgcctctacattgataagttcgcatatacctgcaaacagttaagaagacccaggagacatcaatatttgagagcatagtagtcgatggttggtaattagtctatcaagtatcagaaaagggtcaaaggtgatatggcagaagaacaatttggattctccccatctcgaggaagcactaaagatgatcatcggcaattaaaccctagtggcatagatacagatagcaagcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgataaaagagattggcaaagatgttctccagcatgaaagaagtaggccgaaaggtgattgataaacagaaaca

SEQ ID NO: 18750 - DNA, 1501 bp, Oryza sativa
ttccctctctctctccctcggattcgctcggaatctttcccctaaacctcgtcggcatcaatggcggccgcatctttcgcggccgtttccccctcgcccggccgctctctccccctcccgacgctatttaatcgttccccgtgcctccctcctccgtttccgccgctcgccgctcactctccccttcggaatcgagcccgcgccgtcgtcctctctctccgccgtcgccgccgagctccggttcgccgctgtcgtcgccccggacctcctctcgtctcggcgtctcctcctttggcttcgccgcgtcctcgtcgacctcgtccgctcctccgtttcgcccgccgaccgccggagcaccgccgtcctcgtcgacccgaaccgcgccgccgccttcctccacttcggtcgccgtttccgtcgccgccgtcgacccggggtgagccgaagaccgccgcttcacttccctcttctctcctctctctcgggcgccgctccgccgcgccggtggtcgccggcagtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccagccgcgtgcacccggtccaccgtggaccgagaggctgccgcgtgggtcccactcccgtggacccggtccgcgcgccctctctcccggctgacgcaataattcgattttaaattaaaatttaaatgaagaaattcgcaaatatccatttaaagaacatataaacttcaaatgggcataacttggccatttgaactcggaattggaccgttcaagtctctaatttttccttaagaagtcaagaacccatttttgtgctttgtttctgctgttatgtggaatttattagcgtaaaagccttttcttttccgttggtcgtgtagacgctgcagctttggaagatccgctcttcgtggaagttgaagccggcgtttgggaaagtgagcaaggcaagtcacatcatccttgaacatattgaatcccagtttataaaattattttgatttaaattattgcattatcgctttatttaaattcccgcgttatcacggttttactaagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaatattaggtggttttataactttagacttggggaattctcatatcacttggacactttggaattgttggtttattgtggaattggattcacaccgccccctctattcaaaatccccaaaatggttttaggctgggctcggggtgcatggttttgatagtagcacctcggccatataaggaccggt

SEQ ID NO: 18751 - DNA, 1501 bp, Oryza sativa
ccaggttgaccctaggttatgccaaatggttatccatagaagccctctaaaaatattggaaaagtagaactggtctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactacctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgctaccacgaagcatttggttgagatgttgtgggctatggatgaaagtcgtgcggagactgtgttagccgctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaggatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgtgagtctttagtttgtaataatgaaactcagttaagatcaataaaagttaaagtaattctctgtcct

SEQ ID NO: 18752 - DNA, 834 bp, Oryza sativa
aatctttcccctcttcagtaagagaagctttggagaagaagtcttaggtggagtcctggcttataccccagttgagcgcctgtgaagatggagcagtaggcccgctagtccgctgctgtttatttttgattgtcaggccttaagtgcctttgtaataatgtaaatattatcgatataatacagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagaggataaaacctaaggacatattttataaataaaattatttgcgaaagttccttttttctccttcccctgtgctatttgcaaaacgtttactctttcttccttcttcaaatttcaactagtactagatggtcggctttgtggagaagaagatgttgtcaattgtctgccgaagctccggaagactgcaggatccgctagtaaagtgaaggaagcagtgaagccagctgtgaagcaggagcgaagatcttggagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacaga

SEQ ID NO: 18753 - DNA, 1418 bp, Oryza sativa
cccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccgctgatggtgacagctcgctacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcaga

SEQ ID NO: 18754 - DNA, 200 bp, Oryza sativa
aagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctacatgtgcgggatgtgaatgatgcctttgacatgttgtctggatggttgcagc

SEQ ID NO: 18755 - DNA, 361 bp, Oryza sativa
cctgttcatgataatgagatgattattatatatgccatggttcattagattagagtttctcctgtgcaacccatgattaggcagtgggtagagagcatagaggtctccgctcctataaaatgcacttctttgatcacttgtatagcaagagggcttggggttattacaaatgatcaaattgcttatatctcagtctctcgtgtttatataaatgaatcataactagtgcaaggtcatactttgaaacatggagcagatgtgaccttagtattcttccaacccggttgtagaaatgaaatcctgttacctaacccggggtatcatttgtataactgttatgcactaaccattcccctgcaga

SEQ ID NO: 18756 - DNA, 246 bp, Oryza sativa
cgaattaacaaattcatggaacattgcccaacttccttaaattctatgtaagattcaataccattgtacctgtaagcacccttacagtatcaataaagactacttcttggtctcatataatgaccaaagtgttttcacccaacaactcctcactctgacgacgcctagcgttgaaacctgtccttatgtccgtttacaccgtctcgacaaggcctccgaggaacccaagggatcttcggctggaga

SEQ ID NO: 18757 - DNA, 411 bp, Oryza sativa
cgctatattgtttttaaaaaagagatgctgctgaaatttctttgttttggcacttttatagggttctttagtggcatcccagacttgtggagatttctagggtgttacaggctgtatctagctacacccagtctctctcttgagcttatgtgtcgccttggtttagctttcatccactcctagtggtgcacaacttctcgctcccgcagcatctacacttatacaagcaagaggagatgccctcttctttttctaggcggcgtttgctccagttcgcagttgcacatttgccaataaaaaagagatgcttcctacatctctacaatattgtgccaacggatcataccttcaaggcaaaaggttcttgcacccgacgtgtgtgcatgactaaaccgctcgcctgagttggca

SEQ ID NO: 18758 - DNA, 337 bp, Oryza sativa
cttattccattgctgcccactgggtgttcgatgaaatgtcccaaagacaagaagctgctaatggggaatgctaagagaaattcatggccaccttcttggttgggtggagtgattagacgatgggagttgcaacctttgcattggccaggatccaaattatatttggaaggtttaccattgatgcccccatggccaccaccggctggagtaagcttcctggcatgggagccttttgatattggagttttagtcattggaaccgtgattttaacacaggagatggctgggttgaaaccatggcctccaccaagtctagtaagttctttggcatggggga

SEQ ID NO: 18759 - DNA, 1501 bp, Oryza sativa
gcaaaggaaaatgattatatagaggcaaatataaaatattagttcaagtaatctctattatgaatcttccccggcaacggcgccagaaatgcttgttggtatttcttaacgatattactacaaatataattcccagcaatggcacataaatagttctggtatattatggttacagagttcatccataagtgcacagatataccattgtagcatttcacccgagagtattccaagggtatcgtatttattttattccgtgggaagatcatgtagagagaactagactaataatttatacattgcttgtgataatcatattctaagtaggggttaagataattcaagggtagagtgacacacaagcattaatactcaatctcataatatattatctaagctaggtgggaagaaaagagaaagataatctattcctatacttctaatatacatagtatacatacatcctagttaaccgatatactagctaataccctctttccaatgccctcccgtgttgatgtagaaacacgaggcctgggagatctgcttaactccagtgcaggtccaaaaagcttgcctttaggttcgcaggcgtgccagttgatttgatactgcaatcaacaagaaataaagacaaagaaaacgcagttaaaccgtaaatgatagccgatctgccagccgccgatgacgtatcatttatctttgagccgatgtcatctttgcatctttgcatcgatccgcagtcatgaataaataaggaaggactaaatctattcgatcggctgtaattattaacaatatataatctttatgtcgatatatacataaatcaagtgattgggatagatcggtcgccatgccgagatagtataaatcacttagatcgaaatatatattaacaacgaaattatatatgttcatagcatagccgatcagatagatatagcgtgtatcggctaatactccgataccactctatattaagacattaaagcgagtaaaatatatcaaacaagaagcttaacatatctaaaaagcaataagatctcaacataaagggcagatctagcatatcaattaagcacatgaaatataaggctaaaccaggtaagatcagctgaaaccccgatgctactctaatcaacaaccaagaagcaggctagaaaccatagttctaaacacgacttatgaggtcaaacacaactgatgcagccataagtatgaaaagaaagacaatatctagacaatcaagctattggaagcttcatagagtggtagatatcctatataatctaagccaacgtcgatatgtaacataatcggctgctccctagcgatagatattagccgactagaggttagatagcgatattgtcagagattatataagatatatgataactcgacaacttacatgaacaagattagagtatcataaagatgtaagcactaatcccgagaacgcaagccgccataacaagttttacctcttagttgaaga

SEQ ID NO: 18760 - DNA, 385 bp, Oryza sativa
ttcactattattttgtgatgaccaattagcatgagatgtttgatttatattggttttgatatttggtgttttatttgtggagtggtggtttgtagttaggatcggtctgaccggtctatgcatgctggtcagaccggggaaaatacaatgaacatgattgtacgaaaaatagggttttagtatgatgcttgcggtaagaccggctagcccatcgatctgatcgactggctcctgattggagttagtttcgggttgtttctttgaacactcgtgattatttcatgtttatgaattctaatttatgctatactgttatatgctaatgttgagttaagttgggaaaggacttgtgctcagatatgtttcttgtttattcatgtgcagt

SEQ ID NO: 18761 - DNA, 1124 bp, Oryza sativa
ttaaatcctatcgctatcggctagtatcggcatcggctattattggcatcggctggaactactccatcgccttgtcagccgatcggctatttaatctacggtttacatatcttgttagttgcaggatcaaactaactggcacgcccgcatctcatcaaactttggacctgcactggagatgaacagatctctcaggccagtttgtctttttcgcatccacacaagggtatcgtatttattttatcccgtgggaagatcatgtagagagaactggactaataatttatacattgcttgtgataatcatattctaagcaggggttaagataattctagggtagagtgacacacaagcattaactattcaatctcataatatattatctaagctaggtgggaagaaaagagaaagataatctattcctacacttctaatatatatagtatacatacatcctagttaaccgatatactaggtaataccctctttctgatgccctcctggtacttcgagaagccacccctgattgccgagttccttaggacagcccgtcatgaccatacaactggggctaaatacggaggaataccctccccaaggaattaacctaggattatatataggcaaggaggaatacccgtactgagctatcaccatcagcggcccacctctcatccgcaatatataaccccaaataatgatatcccgtagtctagacaccacgtctaaactaccaaatactactctaatatcatcgtcatgacatagagtaattgcacaagcaaacattatacctgcaccaaagcatctcccagataagctagccatatattcagtataacaaaaacataatgtaaagtaggtactcatatactcggaaagtatttcaataccataaatgtatttagaagagtattctaataataggacaaagcttacaaaagataagagaaaagctgctagagccatacccaaactgctccgaaggcttccagactccgatttctactctatttctattctaccagctagatgctactaaactaaacttgagagaaataagagagttaattgcttgaggtgtgtatgtgaagtgaggaggtgaagtccttatataggcagg

SEQ ID NO: 18762 - DNA, 322 bp, Oryza sativa
ttaacttgtagcttggatagcaatgacctcaaagatccatcatgaattaatgcttttgggttaatacacatcttcccaggacttgcaccttcaaatatacattgcagctctttgttgctcaactgtctttccttcataatacgagcaagttctttagatataatacgagcaagttccatagattggctattcatatgatgcccctgcattgcaagaccatagacctctcttccctccatcccccatgccaaagaacttactagacttggtggaggccatggtttcaacccagccatctcctgtgttaaaatcacggttccaa

SEQ ID NO: 18763 - DNA, 182 bp, Oryza sativa
tggtgtatgtctttgggagatctagacctttactgttcttaaaaaaaaaatctctagtgtagtactagctactgttcgtcccttcgcatatccatgcacacttaacagttgaaatgtccttttgtataattaattgaaatgtccttttgtcagttgttaagggactgaaatttttaaacaga

SEQ ID NO: 18764 - DNA, 327 bp, Oryza sativa
aacataaatgtcaaattagatggctttgcttccgcttttcaaaattagctgagctttaataaaatgatagaaatccagttagctcagttggcatctttagtccccgcaaatgaaactaggaggattccggggcaacccgactcctccattgaaaatgtcaaggcgatcacgacgaagggaggtaagtccactcgtgatccgccatatcctaaccctgcaggaacaactgggatatcaaaagaagcgccatctaatgattcggctgacaaggaagttcagccagaaaagatagtgtcgcaggagtactgtgacacacgattgctgcat

SEQ ID NO: 18765 - DNA, 1501 bp, Oryza sativa
tttcttcactatcgcgtatctcacaccaaaaactgtcccattattcagttactaactcattggacaggaagtgcagctactgacgccacatgggagcagctactgacgccacatgggaggatatgcaagatcttcactcaaggttccctcatgcaccggcttgggggcaagccgatttccaagcatgggggcttgtcaggcctcctctgaagactcaagactgccacaaccacaggaagcctgacgatcatgaactggacgggaagactgccgatcaaaccgctgatgaacaagacgatggcacggtggaaggaatccaggaggagggacaaggcgctggagaagcagaacaagatgctggaggcgaggaggggatcgtgccgatacaggaaacggcgccaagcatcggcccaagacgtcggaggcccaacccacgctacttcggcaatcagtgggccaagtagccaagctgtcatgtgagagagggagagccgtgtggtgttgtcctaactgtatataaaaaacataggtggatgttagaaggtgattaactggatacgtggtggcgtaggcggcggcagaacgatcctgtggatcgatacttgtatgcgtgaacaattgtccagtaaatttgagggagaaatcgttagagtacctaacatagggcatcatgtactcaggtggagcgagcttgtgaggctgaaagtgggtcaagggcgaagggaacaagtctggagtgagagaggagggtaggagattgggtgttatcgattttggacgattttcaggatttaaatctctctcctctcttgttaatctatagtttaatttgtgggcacgataaattcatgtggaattttctggacgtagatgaagatacctagtttccattttctgtagttgctctcaaaaattttatgtggtttgccctcagaaaattggagaaaatgggctcgttagaactttgtttgaatttttaggagatttaaatagagtatataaattctgaaaaaatatatttattcattataaataacctagtatttgaataaattgtttcccctatacacttctatgcagtttcatgcacattatggtgagagtaggttttagccgattaaggattataattagtctatcatttaattggtttgactgatttatttgaggtatcatcctaagtattaaaatttgaccaaaattacagtgaattgtacgtgttgattacagactacatgaatttttccatgattttaccttgcacgaattattttcaataattcgcaagacgtttatttatataagtgttctcattatataaatgcatctaaatgtttgtaaagacttatattaggacttgacttgaactgagttgttattatttgacttcactttcatgtacttataattatttcacaataatgaccatgggtttgtctagtgaagttatccttttatttatgttcatgaacctaacatgatatgcaaaccaaaatccaaa

SEQ ID NO: 18766 - DNA, 1501 bp, Oryza sativa
agatcgaggtggttggcgactctaggatcaccgcaaggcgtttaggtgctgcgatcgtgcttgtcgacttgtcacaaaaagttgccaacacgcgcctccctatcagcttcagcagatcaaaattccactcaaatagaagacatgagaatctaaaagtcccctgacttacttctcgcggatcgtcacaatgcgttgacgacgcgcaggtggaggagacgcgtcagaaaccttcctcactacttagcataatgacaaggtgaaagttaccgaggaagtctccgctttgcggcgatgtccgagcacagacgagaatttcctcggcttggtcggagccttgccaccactaccggtggcaatgtcggacgcctcctcgacgaccttctccttcagggaagccgccacttgatgatccgcgagtggtccgacgacgtcagtcaagggaaggggctacgctaagtccgatcataagctgatttcaaacagggaaggaaaaagacattcaaataaactcacattgattgcttcatcgcgttccgccgcatccttatcgcagaggggttttggaatgttgctcgtcgctgatgggtcgctgatcatcacttgaccagcgcaccgctccatgacttcactgctcagacctgtcaagaaagaatcaattcttgataagtcaaatggaacgtgaatacaaatgtatcaaagtgaatacgagaaggataccccgaggagaaacccgggtcgcgtcatctggcccggaatagttatatgccgggtgggcccgagcctggagcggctggatccgcctaccgacgaagtctgcaacaacttcatatcccgataagccccgttctcggagatcatcgatgatgtcgataaacgattgcagagagggggtcaaagggggcttggcggtccaaaccggaatcttgtccggttgctcctcaggaacaacgaggacaggattcaaatctttgatttcaagatagaaccatctgttccgccatttgctgcgagaagagggacactggaaggggacatagcgcaacttcataccatctcgaagtcggaacccgacacagccagacaccttattggatttcatccagcgcaactcataatagaagcgaaacagatcgagaaagggctctaccccaatgtaggcctcacaaagatgcacaaaaacgctaaggaaagcaatggagttgggattcaagtgcaaaagtgaaagcccatagaaattcaagactagtacaaggaattcagaggggggaggaagaaatccgcagacaatgtaatcttcgatcgcaaccatgcgacctaagaggggctgtggattagtacctcctgcttccctctccgccttgtcgcggccagggagggcgccctcctcctggagcttcttcagggtcgcggtggtggaagttgacttgccaagatccatcgccgctggaggatcgccggagacggacaaggattggcgaggttagggttctttgcggtggcg

SEQ ID NO: 18767 - DNA, 1501 bp, Oryza sativa
ccattttataggcgcagggagggagccggccacaggagagggcggaacggaggcgggaatggcggccggcggccatggaaggtggccgggaaaggcgcagccgttccgagcgattaaaagcacgaatcaaggtagaattaagggggaaagagagaggagggaaaggggattaattcccccctcaggccttgttcttttcggctgggtttgagggggggggggaatgggccaaaatccccgtgtgccatcccggccgggtcgaattttcttccgtggcccatgtatgcgttcgcctgggctggggtcggagcaattctccacccaatccacaccaattccacggggagagaaaaatcgcctcggagacgatttttcttttccaagccagccgcagcgctcggcctcctcgactcctcgctgcgctagggtttggaggcggcgcgaggtccaagaggcggctctagggtggagatccgagagcagcatatctccagccgccgccgctctccatcccgccgtcggttgccgctggtctccatcccgcttcagccgccgccggtgtccatcccgtcctcagccgccgacggtctccatcccgtttcagccgccgccgctctccttcccgctctccatcccgcccagttgccggcgctcgccatctctccttcctcgcttcggattcaccagttgcgggagagggcgaggtcgagggcaacagcccggacactaagaagcaggtctgattcttgatctcctcttttcccactcagaaaagattttgtgacttatctagtggatgaatttgttgctagttgatgaattgagtggctgtatggattgaagtatcagtcatgttctgcttagaaggaggggtgatgtggtttgtagtagtagaacctgaaaccacagaaaattccatgcacatctctctatgtgtgtgtgcaaatcttgcctatcagttgctctgtaatcaaggaaatatatatttcaattggcagatcctatatttctgaacatgggctctcttctttcttttctttttttgtgagggagaaacctggtttgttgattctccaggaattattgtagatgcagtgggagcacacctgaaaaataaaaactagtgcactctgttgttgctgtctagaatgcatcactttgcttttggccaaggtcatttgagcttcagattgaacgaccaatactatatgccaattgaatgagcaagaagatgcaaaaaattttaaagtcatgctatcaggtggtcaggtggacactgtagtatacattctagttttggtatttttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgttcagatattttactagaggtcatatcatacaa

SEQ ID NO: 18768 - DNA, 182 bp, Oryza sativa
caatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatc

SEQ ID NO: 18769 - DNA, 1003 bp, Oryza sativa
aatggtcaaacatgtgagaagaaaatcaacggcgtcatctattaaaaaaacgaaagcagtatgaatcaagccgtacaatatcttttgtataaatatgataaatagtacatgcacagacaataattgcagcaaccaattaggggtccatctctcaagacaattacacaacacctaccacatgtggaaaaggttgaatatgagaaaagcaatctgctttaaaagtaggtttgtccctacattaatccctaccatcgaaaccgactataaccgatgcaatcctatatccaaaacaaaacgggcaaaaaaaaccggacgaaaaaagaataaaaaaacgggcggaaaaagggaaaagaaaactgaatccgattccgcagtaaaaaaaaagggcaaaaagaaaaaaaaaggaatctgtccgattctaaaaaaacaggcgaaaaaaaaaacaggtgaaaaaaaagaccggccaaaaaaaaaagaatccgtgtggacgctgtaaaaagaaaggagaaaaaaaaaataaaaaaaacaaatatgtccgattccaaaaaaaaaagaattatacgtgacgcggtaaaaaaatcgaatcctattatatttgacacggtactatatatctctatcttctctatctctactgcttaaaaaattaaaaatgtttctgttgtccgtaataacgaaaaaaaggaccaaaaaaacattaaaacaaataaaagaaagtccgattcaatctttccgtggggacgagcggcgccctccatccccgcttgcgcgatgaaacgcaagctaaaaaaacaaaattgagcaaagggataaactagattgaagttcccgaaattaaaagagaataaacgatattgaaacacccctaactcgaaaagagggaataaaatagattgaaatttcccgacaaaattctctaaattcgaacaaccctaatttcgggtaagaaccataagagtcaaatccaaatcaattaagctaagggttcgggttacttaccaga

SEQ ID NO: 18770 - DNA, 1501 bp, Oryza sativa
ataccttggataatatcaactccttcagctttacttttgccaaccccacacgcctgtgcctcgcctgaaatttaattcagcacaacagattatatttttgtcattcaatagccatttatatagctttgtatgatatgacctctagtaaaatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaaataccaaaactagaatgtatactacagtgtccacctgaccacctgatagcatgactttaaaattttttgcatcttcttgctcattcaattggcatatagtattggtcgttcaatctgaagctcaaatgaccttggccaaaagcaaagtgatgcattctagacagcaacaacagagtgcactagtttttatttttcaggtgtgctcccactgcatctacaataattcctggagaatcaacaaaccaggtttctccctcacaaaaaaagaaaagaaagaagagagcccatgttcagaaatataggatctgccaattgaaatatatatttccttgattacagagcaactgataggcaagatttgcacacacacatagagagatgtgcatggaattttctgtggtttcaggttctactactacaaaccacatcacccctccttctaagcagaacatgactgatacttcaatccatacagccactcaattcatcaactagcaacaaattcatccactagataagtcacaaaatcttttctgagtgggaaaagaggagatcaagaatcagacctgcttcttagtgtccgggctgttgccctcgacctcgccctctcccgcaactggtgaatccgaagcgaggaaggagagatggcgagcgccggcaactgggcgggatggagagcgggaaggagagcggcggcggctgaaacgggatggagaccgtcggcggctgaggacgggatggacaccggcggcggctgaagcgggatggagaccagcggcaaccgacggcgggatggagagcggcggcggctggagatatgctgctctcggatctccaccctagagccgcctcttggacctcgcgccgcctccaaaccctagcgcagcgaggagtcgaggaggccgagcgctgcggctggcttggaaaagaaaaatcgtctccgaggcgatttttctctccccgtggaattggtgtggattgggtggagaattgctccgaccccagcccaggcgaacgcatacatgggccacggaagaaaattcgacccggccgggatggcacacggggattttggcccattccccccccccctcaaacccagccgaaaagaacaaggcctgaggggggaattaatcccctttccctcctctctctttcccccttaattctaccttgat

SEQ ID NO: 18771 - DNA, 1501 bp, Oryza sativa
ttgggctagataaaattttgttaaatactttgcttaattctttaattcctagatttttctgggatttatttgagctaaggaagtatttttaataaatggaattgcatttcatgaataatttaaattgaaaaaggttttaaaaagtcttcttttggctttgggccgaaagccggcccaaaaccctctctctctctttccctcggcccagccggcccagtccgccaagccgccgctctcctctctctctcagccgctgacaggtggaccccacctgtcaggttcgtcttcctcgagccgccgccgcccgcaaaccctagccgagagccgccgccgtctccttccaaattcgaccgcgtctttccttctccagtgaaatcttttgaggggaaataatcttctcgatctcctcttccttttctcttatagaaactccggtcaatttcctttggaaataggcggattcgagattgcttcggattcgttttcccccgatctttccttctcgtcgccggcagccgtgggccttcgccgccgcctccttgcccctttaaaaggatccccgagctctcctctacccgccgccaccctcgccttcgtctctagtcgtctgtagcgccctagcgccgtgccgcctcgcgccgccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttcttcctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttt

SEQ ID NO: 18772 - DNA, 312 bp, Oryza sativa
agagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 18773 - DNA, 232 bp, Oryza sativa
ccgatgtggtgctcccaggtcgccggtaggctcctcttcttctccaccactctcgttctcccttcttgctgtcgccgccgctctccgttctctcttccaccgccttcatgctgccgcgccgcgccgtcacacaatttggggatagagggagagaaatctcatcgggaggaacggtgtggcgaagccatgcctccgcaatgcgccgcgacctcgtttccccatgccacctagt

SEQ ID NO: 18774 - DNA, 336 bp, Oryza sativa
cattctattgtttttacactaagcatttaagaagctattgattatcggaattttaaaagtttaactgatttttatcttaaacatcaaatatttttgataggaaggagcgctttcttgcttcagcttaatggtcaataatcaatggatgaaatttgcgttaattcttcaattctttttctgaagaaataagaagtgggcattcttcgtttttactctgaagaaatagaagggggtagagagagaaatgtggggaacagaactgcaggagtgagatgtttgtttgtgtaatattttttttaagataatggtgtttgtgcgtgcagtgtcatgcgtgca

SEQ ID NO: 18775 - DNA, 1501 bp, Oryza sativa
tttctcttaaattacttatccaatctacaatccgatcacaccgttgtattcgttgtaattaaatctttacaacaagatgtcacatgattatattctaattaaaaataatcatatgtttcaatccattaacactctttgtttcatacgcgatagtaatatgtttcaatatgtctcttcagcatgtttcacaaatttcgtggaactacatctcactactctctctcctctctccacctcatgcatgcatgcattttagcgggcttcaaaacaacttttctcataaactaattatccaatctatgatccgaacacatcggtgtattcgttgtaattaaatctttacaacaagatatcacatgattatattttgatgaaagaaaaacatatgttttaatccgttaacactagttgtttcatatgtgatagcgatatgtttcaacgtgtatctttatcatgtttcataaaatttttaaatgtttcagttgctgattttttgtttcaccatatataatttgatgtttcactcattggtcaactagaacatttgaccaaccaattttctttgggacataggacgttagatgggaagcttcctcatgattgaggagtgaagaatgaagtacagcaatatacacatacacatacgctcgctgcttggctggacgtccgatatttggtgagatatcggacgtccgagccgtagcgctctccgaaacttttgacacgtaagaaattttttattttccatttcagacaaatgctttttgttttattgaaaccgacatttcagacaaatggtactacaggcgtacagctgctataaaaagacacatatgccaacgctcttatcagtcgagcattcacccagcattagccggtttcacaacagcatcataaagcagctgctcggccatggcaccaccgcctgcggtgctcagctccggtgagctcggcgcgcgagggcacacacggccgcacgtcgtgttcgtcccgagcgccggcatgggccacctcctccagttcttccgcttcatcggcgcgctgtccgcccacgacgtcgacatctccgtcgtcaccgtcttcccgaccgtgtccgccgccgaggccgaccacttcgccgccctcttcagggactatcccagcgtccgccgcctcgacttcgacctgctgccgttcgacgcgtccgagttccccggcggcgacccgttcctgctccggtgggaggccctgcgccgctccttgcacctcctcggcccggtcatcgccggcgtcaccccgcgcgtcacggccaccgtcaccgacgtcacgctggtgtcccacgtcaaccccatcgccaaggacctgggcgtccagtgccacgtgctgtacgtctcctccgcggccatgatgtccctctgctcctacttccctatctacctcgacaacaaggatgccggggccgacgtcggcgacgtcgacatccccggtgtgcgtcgcctcaagaggtcctggctgccgcagc

SEQ ID NO: 18776 - DNA, 225 bp, Oryza sativa
tcagaattgggtcacagcccatgggcagtaaaaaagggtcttctttatgggagaacccccgccggtagaagctcggcgactggattggcggcaaccgcccgccgccgccttgagaggccttctccccctccgattctgcttcctcctctccctccccgtcgcgatcctccgttgctgtcccgatccctgtccgcgagcgcatacgctccgtccttcccatccaga

SEQ ID NO: 18777 - DNA, 1501 bp, Oryza sativa
ttcctactacggtgtctgtatctactgtctgtgcgacactgtttgtgatgcactgaacagcagctcgctgcgtcggcctctctataatctgtactgtacaggttttcagtgtcacgtcgctgcctgggctggccatggcctcgtgggtgtgtcatgtgtgcatgcatgacatgcaaagtaagcttgtgtatagaacattcaggaccggatgaacagaataatgtgctttcagaggatttaccgctgccaatcaaacctgttcgtagattggacattggagtacttcagttcaatttcactcatttcagtcaaccgatccctcgccacagttaaaatttggagatgatatggcatgtgaagatccatcctgcatccgagaaaagaatacattaagcttacaaaaagaagagaagatagaatacaggggcacattcaacataaactacagttagcattgacacaatgcggaggaacaatgtggcacatgaaacaattcagttaagaactaaccctacaacagcaccaccattgcatgattgcatctgcatcactgcatgccaacgacttccacaagcttggctaggttggttcaaactaactgaacacatgttctctctctctctctctctctctctctctctctctctctctctctgtgaagtctgaagatcatgcatactccagcatgagtaggggatggcattaaaacaggttggtcaggtggtgaccggagacgctattcgagttattactactacccggtgcctgcctcattctaacaaacaaaccccatagatagccatcttcttgcgccccaacatggcagattttggcagaccaggcccccccaaccacgaggccacatgggcaacacaaggtgaccactgtggctacgcattggaaacaggtattccttcacatatcttcacatcaacctcctctcctcctggcttggtgacaagacagagaacaaaatggttggcaaagttattagagacagttggaaggataacctgtccttcccatttaaggacactgccacccttttgcaagccacaggggaaaagaaaacacacacacacaacaaagatcctggcatctctccagtaatcctcctcctgctgcctcagctcctcttctgtaatcccctcctttcctatgcttatctatgagaaggaagatggctgggtgtcagaggcttcttcaatgttctcctcctcaggttgagggtattcaaggagggagcacaaacaagaagagagcaagagcaatgtcttctttaatgttgcattgatgaggggtccagaagagaagcataaataaagaaggaagctagccatatattcttcccagccagtgttcctagtatccattctctctcaaactcaaagctccctcctccaactatctcaccttccttctattctattctattccctctggcttagcttgtttttatcagttcttacctttcttgattctcctctcctctcctctgcca

SEQ ID NO: 18778 - DNA, 218 bp, Oryza sativa
tttatccgcccgttgtttattacacaacaacacgtgctatcgaaaagatagttcacagtcacacggttcatatacaaataattataaatatatgattaatcaaaattatattttgcttcaaaacaaccttgagcagagctaaacataactactctaccttgaaatgagcccaatgttcaactcagaaaaactaggatgacaaggtatcataggtaatc

SEQ ID NO: 18779 - DNA, 434 bp, Oryza sativa
gagtattccaagggtatcaaacatgaggaacatacagccatttgatctccttgcttaaatctttagagtcagattaccataactccttccctcggcacatcagccctagatccacccacgtcattgccatgtcatctatctctatacacgtgtcaccacgaggcatccacgccagccgacccatcatacaccgagtccaccaaaacctgagccactaatcagtgggccccactataattttcttattaaaaataattcaatttaaagaattaatatccataggatattcctggaatattccttttctttctgtcattagattttctctgaatttgaacttctcgaggtcttaacttatccgttcgaacttcgattttgtcagggttacgggtcaggcataccctctacccctcgacatacgtcacgtattgaca

SEQ ID NO: 18780 - DNA, 594 bp, Oryza sativa
ccgcctttttgcctctccgtgcgcgctcgccggcgaggaaggatggccgggagggagaaagaaggaggcgccggtcgttcctctctcgtcgtccgtcgatagagatgatgggtcccactatttgtttttctttcgtccgactgacatgtgggccccacattttgtttttatttcaattttttttattttgctcctagtgccacgtcaccgccacataggatgaggaccaagtcaaaccagccacgtagacgccacatctgccaaaaccaccatcaaaaccgctgagagacctactttgcaccggttttgatagttgagggagccgttgtatctggttttctggttgaaggatgaaaatcggattcgttgacaagttaagggatctcaagtgaacttattccatttttgtacaacactatactactacttcctccgtcccataaaaagacaattctgacacatcctatttctatgaatatggacatatctctgtttagattctttgtaataggatgtgtcgcattcagctttagattcattttttggggacaaaaggagtagatgataactttttaacacaatatatacacatgc

SEQ ID NO: 18781 - DNA, 312 bp, Oryza sativa
cgggctgcgtatgtacatgtcagtatgttgccgcaacgaaatattagtactaattagtaatactttctccgcctcaaaatataaaggatttgcgttcagatttataaggtataggatagtatgtcacatcacccaaaattccttctattttaggaggaagggagtaccgttcaacgtgtttaagtccctatcacatcggatgtttggacactaattataaatattaaacgtagactattaataaaacccatccattatcttagactaattcacgagacgaatctattgagcctaattaatccatgattagcc

SEQ ID NO: 18782 - DNA, 164 bp, Oryza sativa
tggtgctcggcacggactacctcgcctctgagtgtgccatcggcatcaacctagagtgcacatcaccgctggaggaaaccatctatactctacgtgcttcccacagcagcctaattcgagttcaccccgtttgacatggatgctggccgtcacgccgccacagc

SEQ ID NO: 18783 - DNA, 1317 bp, Oryza sativa
ttagttctcaactaacattgttataacttattttagaaaagtgtggcttgtcatatttttttttcctatagattgtaagttgtatttgtggtaaagttaggtaaaagattaaatctatgatatgtaaagcaaggtgcttaaaaaatgtgttaatttacaactatgataattagcaaaaacatagttatggaggtttggcggtctaaagtatggatgaaagaattaaaccaaacaaccccatagattcactgatgaaaaatatcagccgagcccatcaaaagccatcagctcacgcatcacgacgttgattgtggtcttgagtccccccggtacataggagcctgtgcagagcgaacgctgatccaagagtccggttgactgtaacaccctgaataatactcctattcagttaaaaaatcagtaaaaatttgaatttttttagaacttttggatcatgcgcagtgatctttgctggagttgggtggaagttcaacttaaaacaaagctatgaataactaaatcccataatcataccaaggggatgaaatgaattaatttacaaaattatatagagcttatacagtataaataaggagaaattagttgccaatttaacttctaatccaaatataatgcccacaattgaacaagcatataatttgacactaagagaccatgagttaaattaattgtcaatacaacaaatatcatttaattacaacaaatattatttaactctagaaaataattgccaccttaatctgagtggagaccataaggctaaagagacgtcaataaattaaattacaaatataatcaaattatcaattctctcaacccataaaggaatacccctaaattaaaaaacataaacttaagtctaaatctccttctcgggctcaaacctctagccaagcccaacccatctcccttccgttaccctccacctattctgttgggccagatcttataaactgatttcagggtccgatcccaggcttccaattgagcgacgtagcatctcgtgtggagctctcctcctgattcttggctgtagaaagtgccacgtgtacgcacctatccacagccccgttagatgacgtatcgacggtgaaaacccgtcctgtggacctaaatggaaattacaagtttcgatagggggttttttacaaacgtacgatctcatctagaaaagtccgaagtattggagaaaaaaatcccagaaaacaatcgcaagaaaaaatagattactatctccatctgcctactcatagtgccgtaggctgccaccggcatggtgacacctgctttgggcga

SEQ ID NO: 18784 - DNA, 166 bp, Oryza sativa
agacagcatcaagggcggatcaaaacctttcgaggtcaccaaccaaacacatcctaatatctcgttcgcggtctaaccatgacgtgattataccaaatttagcaccttcatacccaggaataacccgctccacaaataaacattcgtggcactttgagtggcacca

SEQ ID NO: 18785 - DNA, 305 bp, Oryza sativa
tattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 18786 - DNA, 561 bp, Oryza sativa
acgatgtgaagtgttgcaatatgactttttgtcacatccattccgtggcaacatctaaatttattaccacaaaataaaaatcgttacaataacctattaccacgctatttattaccacggctagcaatgattttataattgtggcaacatgtatctattgccacaattttagtattgatgccacgatttttttttggcaacaaatgattttttctagtagtgtatatgaactatagataatggcttcaacaagaatacgaaccaccattgtcatgtacaaccagctaagactagaccttaagatataaaccccaagtcaaattattagcaacaagcaccatctcaaagaagcctctcttagtatgcccccgtcattccgagacagtgtcgtcatatataccttctgaacttagcacaatcacaatcaaccacaaacattacttcatacaaccttctgtagacacgatccctacgaagataatactgcgaaaagccaaaaggcacctggccaaaatccatacatctgtcctatataaagagaaaaaaaaaagaacttgagca

SEQ ID NO: 18787 - DNA, 1258 bp, Oryza sativa
agctggcgccgcccctccagaacgggcggtcggtgaagatgccgacggtgcacagggcaagctcgagcaccttgcggttgagctcgcggcaatggtgctcgcgggcaccccgtcgaacccggcgtgctccggtaagttgtcgacggaggagatggcgacgagcagcagcaccagccatcggctttgttgccggcgacaacctcaccgtcccgctccgtttcgccctcccccctcgctgccgcaggtcgcagtcgtagtggtggtggccgcggcactcgacgcgcgtcacggcatgacctgcccaagaggagagaagagatagagagagggagagagaggaggaagggagggatgacgtggcatcctgacatgtggggcccacgtgggtcccactctgagtcagccgccacgtggcacaaaaccggagtcaaaaccgccgagggacctattgtgaccggttttgtaagttgggggacaccagatgttcggttttacggttgggggacgattttctatctggctaacaagttgagggaccttgcgtgtactttttctgaatttctatcgtcgtttcgttgcatagtgggccgaattttagtctcagcttcaagaatttttttcatttttagatttttttaaaaatatttacagaaataatctatcggccaaaaaaacaaaaatagaccctgccgcccaccacttgggcagcaagctgacgtggcaaacgggggagggacgagcggtgacggagggagggttttttgcaggaaaaggcggcaaggggccccaatgcaaaaaagccagccggggccggccattttgcaggcggccccttgtcgccctctggtcgggcggcaggcctcactgcctataaaaggcctgccgcctagcccccggccctcattcctccccccacaaatccagtaaaaaaaagaagaaaggggaggagaagagaagaaggggcgaagccctgccggattcacacgccgatttcaggtaatattcatagatcctatatgtgactattgagttaaatactgtgtattttttaaaactttgtttgaataaatgcattatatttttagggttttagttgtactaatctagaagtgcgtattgtagataccgataactacgtagatctgctagtttggaatcagtattttaccgttgaattggcatacacaagaagatattacgttgtaggtgtttattgcatgaaagaataatatgatactagttattttgttgacagata

SEQ ID NO: 18788 - DNA, 1501 bp, Oryza sativa
tttaagatttaaaagattcatgtaaatatcattttattgtgacttgatctattgtcaaattttctttaagcaataatcttctcaataatatcaaactgaaccaaaggacatcagttaaactctaaagattaacaaatgaaaaaacaaactttactcttaaattgcactaggtagattgtaacacgtttcattttacacaggtttaacactagaatacatcatcaaacatatagaaatttcacaaaatcagaatgaaatcccatgaaatatggtctaaattcaaaaaaaatcaataatttttacttagattttacaatattttcctttaattacagagtaaacttcacaaaactacaaatttattacgatgtatcacaaaactacaaatttaacactaaaattatcatagaattacatatttaggtgaaatatcacaaaattacatatttagtaacaaagttatcacaaaactacaggttttatatcaatttaatcacaaaatttgaacatttataactcaaataaaacattggagctaaggatttaaactctaaaatctatagttctatgataattttattattaaatttgtagttttataatacttagccttaaacctgtaattttataataaatttattgttaaatatgtagtttcgagataatttgacccaagtatccgtaattctacgaaatttactcttaatcatatgacacagcataatgccgaagtgaaacttattttaagaaatggagtataatttactccttaaaaaaatactctacacaaccaaggcgtatcaccgtatagtcaaccgtccaacccaacagctaccaggtaacgaacggtttgctcgcctccgccccagacgctgccccgctcagcgtcctcccttggttgcgttgcgtcgctgttcttccagcctgtcacacgcgcacatgacaagcaaccacccaacccttcttcccctttgctccgctcacactgcacagcgccaccacactgccccccacctccccaaaccgtacccaccaccatctcttctctcactaacacctcgggacaaaagcacacggccccacctgtcattgccccaaaagtacagagaacacatagggcctatttagttcgcctaagggaaacttttggcgtgtcagattagatatacggacacatatttaaagtattaaatatagactaataataaaataaattacagattttatctagaaattaggtgattaatttattaaacacaatattgccaaatcatgatgcaattaggcttagaagatttgtgtcacaatttacacacaatatttaatattccatgcatatgtcaatcagactgggtgaaaaaattttgtttggtagctaatcaggccccaaaaaaaaacgcgagcacttttaattttctgctcccgcacgacacagccccgacaggcgagacacgtaaccatcacgccactgacgagtgggacccaccaccaaccactggtt

SEQ ID NO: 18789 - DNA, 214 bp, Oryza sativa
agatgtccccttttgtcacgattgtagagaacaaggacactatgccctgaattgtccatgggtatatgccaaagaagccccttcctttggtttaatagggcagacatcgctaaaccagcctcctcgcaccaagtcaagcttgcagcctagtgtgcaaagtagagagcccaatggagagaatccattgaatcccgggaattgctttcctcctagc

SEQ ID NO: 18790 - DNA, 1501 bp, Oryza sativa
aaggcagcaattcatggtctctttccggcgtagggtgttttacacggccgtacctctctgtctgtcactttctttccaatctgaattctgaattcccagttctgctttgctgcacaaaactcaagtatcagctccccaattcagaaatgtactccctctgtcctaaaatataagcattattagaatagtgccaagtcaaactttttaaattttaactgttaatagtaaaaaattaaaaaagattaataacataaatttgatgttactatatttatcattaaacgaactatcataatatgctagtctttttatttaaaacattttactttcgtagataccgttggttaaagtagtatatcgaagaccgtgtgagggtctaaaaatacttatattttgggacggaggaagtatacatcaaacaacacatcgtgactaaagttcattcagcttcctgcctgaccataagcagcaacctgcaaaacattacactttgccgatgggccagttccagagtgcacaaagctcacgatgattttatatcataaaattcattacttatacagtaaaaaaaaaaggtatcaattgctgattttatgaatccatggaatggaaggaaagatctagtttttttttcttattgctaactcaagggaacggaaaattttgcattgagttgcacacaaagaggtaatgggctgatgcactagtctttcagcatagtactagcattccagtaatattctagtatgagttttttaagcagatagaagaatgtaacagtgacagtgtgtactacactgatgctcttctgaaatacttcatcacctcttttttttttcagctcagacattttcgtctcaacgtaatcatcatcctgttcaatgcataataacagcatgagtcagacagacagattcagaggtccaatgtgtgaaaatgaaatctagcaaagcaagtaaaaggggatgtttattgataaaccctgtttctctgttgactgttgtcgtgcatgctttcttgctcgttgacaagcatccccctgaaaatgaacaaccacgctatactaaaataggaagataaatgcacacaaaacacaatgaattgctgcagacaatgctggatcaactgagggaaaaaaaataaaaagagaaaagaaaagcccatgaaattaacctgaaatggaggcccatatactaattcgttgctttgtggagaatacgcggcccagttgaggcccaactcgagccgtacacaaattcggcctggaatggaatccaataatgattcggtttgcaccgcccgaacgaaacgcgataaaaaatcaaaatcggcgtcagaaattaaccaaaagctacaagagaatcgacgaaattcactgatccatcgatcgatcaatggcagtagcagcagcggttgcttctgctagattattggcgaggctgttgccggaggtagaagacagcagcacgaacgccggcggcgtcatggcggtctctttccg

SEQ ID NO: 18791 - DNA, 1501 bp, Oryza sativa
caggatcaaagatgttctacaaggaggtaaaataggatttttgaagaacacggtcaaagtaacccttttcaaagttttctaacctagttgacgtcttacacactctagttgagactaagaaaagaaacgcacaaactaagaccgtgttcgttggttgaagttgagaacttctctctttcacatggaaaccggaatagtagattagcgcatgattaattatatattagctaaagaaaactttaaatagactaatactccctccttacttaaatttttaacgccgttaacttttttaaacatgtttgaccgttcgtcttattcaaaaacttttgtgcaatatgtaaaactatatgtatacataaaagtatatttaacaatgaatcaaatagtaggaaaagaattaataattacttaaattttttgaataagacaaacggtcaaacatatttaaaaaagtcaacggtgtcaaacatttagagatggagggagtatgatttttacaacaactttcctatatttttttttaccaaaaaacacactgtttagcgatttgaaaaacgtgtacgtgaaaaatggaggagtggagttgggaaagtgttacagatagtggaagaaagggaattccagatacaacgatattgggttttttaaggtatcggagattcaacaatatccactaatcctcgttaaaacactatgcgtaagagttttgcccctatttcatatatagtcacaaagtccacgatcgccctcatattttggttctttcccactgtgaaaaaaccccaaaaatcttcacacaaatgctatttctcccataatcttcttataagaccaccaaacacgcttctaagagtgacatgatgaagccttcaattgaagccaccgatcaacactagactcttggtgggtgtactcaaacgatcactctcaagcactacacttgcaacaaaagatcgtctccaattagctatagttgctcgtggactattcctcgagtttctctggttcaagggtacatgagcaactagctattgtaccataaaggggcagaaaatccgatcacaatcggattattcggctgagcattgtctggataaccttggtatgaaattaatgtgttgatttaatatatgtgatgaacaatttgtcaaaggtaagtgtttattgaaaatacagtgaatagtgtttctgttggtgaactgtgcaggtcggcattgggtggccggtcaaaccgggtagtacacgccggtaagactgaaggtatccaagtggtctaagatgctacgtgggacaaaaccggctggggaattgatttgcagtggttctgggagttgtatgatgggttatatcggttgatagatgcgactcaaccagggatatgacttgagggaggtaaaatagacttatccacttggtttttgacctaggcccaactgctctgcaaagttaaagtacagaggcccaaagtcgaggatattggacatggcctgtctgaatt

SEQ ID NO: 18792 - DNA, 1501 bp, Oryza sativa
accctcttaaccatttgccacatttagatgtggcaattaactttttgccactgaacccacatgtcatagatacatgtggacccacatgtcattaagataggggtggcaaatagttatttgccaagtctgtgtttagtttttttaaaagttgaaagtttgggttgaaattggtacgatgtaactgaaaagttgtgtgtatgacaggttaatgtgatgaaaaaagttaaaaatttagatctaaagtttagatataaacacagcccaaatctaaaaatggcgaatagttaaaagccccgccgaaatccctgcgagcgtcggggcccagccgagtcgccgtgtaatttgacttcacgagcctagcacgcccagtggcggtccgcatccgggtcggtggcgagcacaagctgttcatactactaccatttcaacaactaattaagtataaagtcttctaataaaatgcttccactgtcatattataaatatagtcatgaggttacacgttcaattttaatcattcattttattttaattattttttaaaaaataaaaaatataagtaacgtataaagtagtattcatgtttgttatctaataataataaaaataaaaaaaattaaataatacaaatgattaagattagacacgaaatcatcgttatgtttaaaacgagccggaggaagtaataattgactgatgttgattgtcatagagcagctagaaatgctactgctcgacagcctatcaccactcactccaagcctcggaggttcactcatctccagagactactggtcctcgcgcgcaatcaaactcttctccggccgccatgtccaccaacgacggcgtgccctcccggcggcggccgcatgccctcgtcgtccccttgccgtcgcggggccacctcctgccgctcctcgacttcgcccaccgcctctccacccgccacggcgtcgccctcaccgtcgccgtcacggcctccgatctccccctcctctccgccttcctcgcatccacccccctcgccgccgccctcccgatccatctccccgacgcctccctccacgagaactcacaccacgcgctcctcgccgtccatctctccggtatcagcgcgccgctcctctcctgggcgcggtctcgcccggacgatgcccccaccgtcgtcgtctccgacttctttcttggatgggtgcagctcctcgccgacgacctccgtgtccccctcttcccgggtccccgtctttcccgtacgagcatgtcccgtcggtggtgaggagctacgtcgccggcgatccggactgggagctcgtgcgggaaggcttcttgctcaactccagagcttggggcgccgtggtgaattcatttgacgagatcgagggcgagttcttggagtacctgaacaggttcttcggccatggccgcgtgtggtcggtcggcccggtcgccgactccggctgccggggagaggagaggtcatcggaagcagagcagctgttct

SEQ ID NO: 18793 - DNA, 312 bp, Oryza sativa
tctcggccgtccgttcgtgtgaaccgccgcccgtgcgcccggtccaccaaaccctagcccgctgacgcaataaaccctcttttccttttcaaaaataattcattattgcgtcataattcaattaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttaga

SEQ ID NO: 18794 - DNA, 1501 bp, Oryza sativa
cttgccggggccgagcgtccggcgaacaatctcctggtgcacctccttgtagtgcagcagcctccccgtagtgacgcccagcgacaggaacagcagcagagcaaccaggaacgccgtgagcacgatcccaccggccagcccggtgccagcccggtcgtagtgccgcctcggatgagcaccgccgacgcctgggagacgcagggcatggcgaggatgacgagcataagctccagcctgaggaacacgagcgcgccgtaattgcgtccctgtgtgtgcctgtggcacagcttgaggtagaaggaaaaaaaaagaaaagagaaagaaagaagataatgctgacgcgtgggcttcatatttttttcttctcacttgcatgtgggccacactttttatttttttattttttgttgactataatgtcatatcaacgaaaccagacatctatactattttgggatttttttgaacggttttacatatcttagagatacacattttttgttattgtggttagagacctcagaaagactcggcgtacaattgagggacatccggtgaacttattccgtgagctctcgtggtcccccaagctgcccgcgagccccccgaaatcgagatatttaggtggtgtttgggaaggagggacacaaaagcataagtccctgtgggagggactacaattttatgagggactaaattttagtcccttcttcctaaacaccctcttaaccatttgccacatttagatgtggcaattaactttttgccactgaacccacatgtcatagatacatgtggacccacatgtcattaagataggggtggcaaatagttatttgccaagtctgtgtttagtttttttaaaagttgaaagtttgggttgaaattggtacgatgtaactgaaaagttgtgtgtatgacaggttaatgtgatgaaaaaagttaaaaatttagatctaaagtttagatataaacacagcccaaatctaaaaatggcgaatagttaaaagccccgccgaaatccctgcgagcgtcggggcccagccgagtcgccgtgtaatttgacttcacgagcctagcacgcccagtggcggtccgcatccgggtcggtggcgagcacaagctgttcatactactaccatttcaacaactaattaagtataaagtcttctaataaaatgcttccactgtcatattataaatatagtcatgaggttacacgttcaattttaatcattcattttattttaattattttttaaaaaataaaaaatataagtaacgtataaagtagtattcatgtttgttatctaataataataaaaataaaaaaaattaaataatacaaatgattaagattagacacgaaatcatcgttatgtttaaaacgagccggaggaagtaataattgactgatgttgattgtcatagagcagctagaaatgctactgctcgacagcctatcaccactcactccaagcctcggaggttcactcatctc

SEQ ID NO: 18795 - DNA, 343 bp, Oryza sativa
tcctgtgaagatgttaaaacgacagcttctgtgggatattttttatctgtaacacgacatgctttatatgatggaggtagtattaaggtggtgtttgaaattcatgtaggtgaagatgaagatttagtgttttatgcaaaatgaggtggtattaatgtatgattaattgagttttaattattacaaactcaaaaaatatttatctgatattttatagtaactttcatatagaatgttttcatatgaaatgcaccatttagccgtttgaaaagagtaccacgaatattcaaatttttatacaactttttgttggaaaaaagatctggacccaaagaagtcacaa

SEQ ID NO: 18796 - DNA, 1501 bp, Oryza sativa
ccatctctgcgactacctctacgctttctttcatcataccagtttggttctttcatcatagtaccagtttgaaacccaagacatacaactctataaaatctgtgcaagaaaagaaaggcttgccttttttttttaccgcgcagcaattcaggcagccgcagctcgcgaggccttccagctctcgtactgggggtcgtcggtgggcagctcgaagcggcagagcgggcacgagttgcgcacgtcgagccacggcatgatgcactcctcgtggtaaccgtgcgagcagggcagcctcttcacgcgctccccggcggcgacgccgtccctgcacaccgcgcactcctccccttcgccgtcctcgccggcggcgacgacggcggacggtagcgcctcgacggccgacctcgccgcgggcggcttgctcttcaggaacaaaccctccccgacgagcacctcgtacacgtcacggtcggaggtgtacacgaagccctcgtcggcgggcggcggcggcggcggcggcacgtcggcgaggacctcccactcgggctccggctgatccatcccggcgccgccggagggagatgccacctcctcccaatcgaattcctccgccgcgttggaggcctcaagccgcagatccgccaccccctcctcctcctcgtcgtcgtcatccaattggaggcaatcccaccggatctcctcctcctcctcctcatcggggaagccgaggtggtcggggcttggcgcgacgagcgcgtcgtggaagaggtcgggctccacggagaggaactggctgcggaggcggtcggcggccgccaccaccgacgccgccgagaaccccgacgacggatccgggtggaacaccggcacgaaggcgtcgtagcacgaagacgacgacgacgcatctagggtttggggcatctcgtcggaggcgagccggacgaggagagacgaggacgccatggacgcgagagatagagaggggaacgaaaaaatcgcgccctggattagcgtctcgcgagccgcttgctattatagctcccctaaataaaataaaataaaataaaaataaaaattaattctgctagtgaaactctcgtggtacgtagtagattggaacggcgaccgacgagacgaccctcgtcgctgacgagtggggccacccgatggtgggggattataaaagaaccagtggttggtggtgggtcccactcgtcagtggcgtgatggttacgtgtctcgcctgtcggggctgtgtcgtgcgggagcagaaaattaaaagtgctcgcgtttttttttggggcctgattagctaccaaacaaaattttttcacccagtctgattgacatatgcatggaatattaaatattgtgtgtaaattgtgacacaaatcttctaagcctaattgcatcatgatttggcaatattgtgtttaataaattaatcacctaatttctagataaaatctgtaatttattttattattagtctatatttaat

SEQ ID NO: 18797 - DNA, 318 bp, Oryza sativa
cttaacggcggccggtccggtgctagccttctcctaggtctatgtattgggcgttgtcggtgcgtgggcgggggtaaattttttcgttttcccggttacgaccttccagagttgtaatcatgtatttttttttctgctctatcagtttgaacttcgctgtctttggtgctagtcgttaaaaaaattctattaggtctcgctctgatcgattcgctgagattgcacttagggcccctttttcaaaggaaattcataggaattttagaggatttcatttctataggaatttttcctatataaccctttgaatcaaaggaa

SEQ ID NO: 18798 - DNA, 1501 bp, Oryza sativa
actgaaaattttcaataattatggaaaagctattagtatatgccatatgaaaaggcatggtccatgcaaactggcttttcatgatttctgcagctcctgctgctgaggaccagacccagtgtaagctctgaaggtgacattgaattgaagaattggttggcagtagctctgatctgcctgccactgtctcttcttcctgcaccccagctcacccttgcaaacccatacctacatgccttttttcatcaaaagaaatgcacaattctgcagcatgccaagaaaatttcatccatttttatcacagcaacatgacttgctaatcgccatgtactacaagttgagattcatctgagtggatggaattgttagtattagaaaaggctggttcgaatggaacacagcaatcgtggcagattaaactaacaaaatggcattgatatcattagcctttttcctccccacaagagaaaaaaacaaagatcattagcctttctagctctgctttggatgcaactaagctctgcaatgcttaaaacggggaaagttgggtgtctcttttgatgctgcgtatactcgattgtttttccttttcattcctggtgcctgagccaggtcgaatgtgtaaaagccagtgaaaaaaaatcaaatgcatctaaaccatctgaacaaatgcatttgatttggtacttctgtctgaactagtgagtcatatatgcactgctttccttcctgtaatctacctccattaatcttcagttgtagtgtctggtaatgatgacctgatgaggattccattctcccagttggtcgagtacacaaaggctggagaggtgaaaagatgatcaaatcaaatgcgcacgcttgctgttactactctcttttggttctggctgtcagaaattcagaacgaaagttgcaagacaagtatgcctgctgtttggaagtcaatcatcatcaccggagcccgagctgcacttccctggcatttcttgtccgggccagctgtgacactccttttttttgttctcaaactgtcaattgtgacttgctcactccgtttttggccttgttcagttctaaattttttcttcaaactttcaactttttcatcacatcaaaattttcctacacacataaactttcaactttccatcacatcgttccaatttcaaccaaacttctaattttaacgtgaactaaacacaccctttaaatgtatagcattattaacttttgaaatgatatctatccattcatcttactagatgttagagaaaatataaaccatagttaaagtatttttagtgataaaacaaatcacaacaaaataaatcttgctcgcatagtctttttgacaaatagaaatagtctgacgtcatgtctaaaagacaacaacgttgtatatttaataatttaaaatgaatataggacgatgtctgttgacttatataaggcatatcttattttagtacaaatctttaagattaattttagctgttag

SEQ ID NO: 18799 - DNA, 1501 bp, Oryza sativa
ctataaacttagtcaaacataaaaaggtttgactaaaaaatcaaagcgacttataatatgaaatagagagagtatattttagccataatagaaaaggaaaaatattatatatttaagagtataaatgtgtcagaaatttgtccttttttctctctctctaagtataatgaatttgaagttaggtgtgatactattggaagtgcatgtacatttttttttagaattttcggtgatatttattagttagtgtgcacgggacacttgtgtgtaccatgttcggatagacagaataacccttttccagaacaagggtagtgaaagcgagcctacaattctagttgattcagaggagttacacctagttccttctctatatgggtaattttaccatccataagaaaataccgggaggtaatatattttctagtataaaacccgttaccttcagctattagatattttagtatgaaatttagtacctatggctactttctcatcaaggaccgtaaaatttctctagataatgtaagggcttgttctttatgggtgatgtatagaattaagtgtatggaaattattcgagaatataaatgaatgaattaaatattaaaatattgaattgttggttttcaaaaagttttctaagaaatgcccataattaaagtttttacaaataaagtatggttttgaagcttacgaagtgtgccgtatcatctacaatctgtaagctggaaagaacacgacccttatgcgagaaagaactatatttgtttttgtcgatgcatctacagttaagggataatggcccatcagtggtatatttctaaaacccacgtttaatttttcgatttgacaaaaccaattataatttgctcggtcaggtacaaaagtacatcccatcacgaattttgcttcatgtgattccgcattaattttattctctgttctcaactccatatacgtggagtatattggatggcaaacagtagagtagactagtagttcgagtgttataggtctctgagatgccggcgtgagcagggcgagtactttgttacacttccactgaaatgtgaacagaccagtacagtgagattccgttctcgtagcttttttttttttctttgacactcgcacagcaattcatcgttgattgctgaatgatgcagacaggccattctttggcatggccagataggggagctgagaaggacgactgcctagagcttaggaaaacccagggctttctggtatatgcagagatatatactgttgtataactctcattttaggctagctgagcaatatagataactcaccatacagtaaaaaatgttaagagcaaatcatcagtacataactctgaagaaaccgttcggtttttctggagggatagggcgcgcaggatctatatttaaagtcttttcatttggacatcatagtcatggttgagtctaggatttatgtttccttctagcttgagtcgttgttaaatattagg

SEQ ID NO: 18800 - DNA, 1501 bp, Oryza sativa
atttagagtagtatgaacaaagtcgaaacatcttataacctaaaacggagggagtatatattttattcctaataaactgtgattagatgcgaatataatggttattttcggaagctgggaatagtataatggttatttgggattggggctaagccggctaacctttgtcctagcaaacttattaccatcactgtattttatagggcaatgctattgaccaaacaaaatatcttcttagtatttctaaatttcatataaaccaaataaaattttactattgctattctattgaaacctataaaaaaaattagtaatcctgaaagtttctgtcataaagggtataggccacaaatactatcatagaaagcttacctgacttgataaataggaggtgaaccaaatcggctacttgtaagtagagcagaacttgggaatggctaacacttgtaatacaagataatgggtggatagaatattcgtaagcttcctatacataaaacaagtcgtatgtggctaaattactaataactacatgtaactgtgtatctcaatctatataagatgggcgtgggtctcaagattggggcagatgcaatcacatgaacatgacatatacaaaaccctatagcaatacaattcactaaacaagagtagagtacggtattaatataattatctctcatcgagtttgtataaatctctttctcttgtatcaccattgagctcttagttcaacgcatagcgttctaacaaacgacactactattaataactttaccgaatactttacaacaaacacatataagagcaagttcatagtatagccgtctatcagctccaatatatctatagtcaatttaataactaatacatacaatagttacctactatactatagatacatggtcccacctgtcatacacacattgcgtcttgcaatccgtgctgcagctggctataaatatgtagcccgctgcacttctttctcatctttttatctcctagaaatgtatttatatctggcttatagtttgttattgtacctgctctaatactaccaacaacaataatacatttaactttgatagccttgaaagtggcaaaaaaaaatgaacatactcttttagagcaagtagtatggttctcattctcaacaaccatcttcccacatgtacacagtgacatgttattcaagatgcacctggtgtcttcttgcaactgttggagtacagaatcactagtgcagaacttcttttttttttaagttttagaattctgacctacacgtttattttatcttttagtgggatacctgtatgattcatatatatgttcatccctatctctctatatgcactgtgcttgtaatctctactatcgaaatctgtacaaatcagagggcaattagcgaggccacgtggcatgactggattcatgggtttggtccctcgcgcacagccgtcagatcacgcatctacggtgatatatcgtgcggtggatc

SEQ ID NO: 18801 - DNA, 1501 bp, Oryza sativa
gttatctatattgctcagctagcctaaaatgagagttatacaacagtatatatctctgcatataccagaaagccctgggttttcctaagctctaggcagtcgtccttctcagctcccctatctggccatgccaaagaatggcctgtctgcatcattcagcaatcaacgatgaattgctgtgcgagtgtcaaagaaaaaaaaaaaagctacgagaacggaatctcactgtactggtctgttcacatttcagtggaagtgtaacaaagtactcgccctgctcacgccggcatctcagagacctataacactcgaactactagtctactctactgtttgccatccaatatactccacgtatatggagttgagaacagagaataaaattaatgcggaatcacatgaagcaaaattcgtgatgggatgtacttttgtacctgaccgagcaaattataattggttttgtcaaatcgaaaaattaaacgtgggttttagaaatataccactgatgggccattatcccttaactgtagatgcatcgacaaaaacaaatatagttctttctcgcataagggtcgtgttctttccagcttacagattgtagatgatacggcacacttcgtaagcttcaaaaccatactttatttgtaaaaactttaattatgggcatttcttagaaaactttttgaaaaccaacaattcaatattttaatatttaattcattcatttatattctcgaataatttccatacacttaattctatacatcacccataaagaacaagcccttacattatctagagaaattttacggtccttgatgagaaagtagccataggtactaaatttcatactaaaatatctaatagctgaaggtaacgggttttatactagaaaatatattacctcccggtattttcttatggatggtaaaattacccatatagagaaggaactaggtgtaactcctctgaatcaactagaattgtaggctcgctttcactacccttgttctggaaaagggttattctgtctatccgaacatggtacacacaagtgtcccgtgcacactaactaataaatatcaccgaaaattctaaaaaaaaatgtacatgcacttccaatagtatcacacctaacttcaaattcattatacttagagagagagaaaaaaggacaaatttctgacacatttatactcttaaatatataatatttttccttttctattatggctaaaatatactctctctatttcatattataagtcgctttgattttttagtcaaacctttttatgtttgactaagtttatagaaaaatttagcaatatatataactccaaatcattttcattaaatataacattgaatatattttgataatatgcttatttttattagaatgttgttatattttaaatatatttcgtattagaaagaaaaattctaagcgacttataatattataaaacggagggagtaatgaatttgaagttgatac

SEQ ID NO: 18802 - DNA, 1501 bp, Oryza sativa
acttaatagatcaaactcaactgatgtagcattaagtatgaaaagaagaacaatatctagacaatcaagccgctaggtgtttcataaagtggtagatatcttatataatctaagacaacgtcgctatttaacctaatcggctgccttctattaacggatgttagccgattgtaggttagatgacgatattgccaaagattatataagatatatgataacttgacgaattatgtagacaagattagagtgtcataaagatggaagcactaatcccgagaacacaagccgtcataacaagttttacctcttgttgaagatcgaaaccgatgcagctcaaaccgaaagcaagaactcgtcgaaacaaaactaaagcaaaaagttggagatgcgccgagattgtattgaacgtgtgtgttaaaaattacatatggctcggggtctatttatacccgagaattacaagatatgtccataccggacacgaccactatctctaacaaactctaagataccataagtctttgcggcagacttttgcccaaacatatctctaaggaagttacataaaaacatcctaattaatagatacaattgccatctcaggactctatccatgtgcggcaatcatcttgaagcacctcaattcaacccaatgtcatacaccaaattatactgtcagaatcggttgcatcggctcacctagtccgactcagacccagccgatcctaatcgtagccgatctggacttcagccgattcttgctctgttctcggattaatctccaccttcgactccaccttgatctaatctccttttccgatgctgatattaccaaatttggtcgttaacacatacttgatctcctaatttatgaaataacaacaaaaattcatagcttgatagaaactcgagctcggctcgataaagctcgcgagctttgggggaggctcgggctcggctcatctgaagctcgagcagctcgcgagcctcgagattttttgatagcctacctctctccctaaaataaactcaaaccttaacgtcccaaggagtttttaaggagagaaacaaaagaccataatgcccttaattaatgtgaatattgtattgaatgatgtgtaggtgaggggtattgaagtaataaaatttatcgttttgtggattgatggttggtaaaaaaatataagttggtttatttttgacataaatttaaactctataagtttatttattttgggacggagggagtatatactccttccagtcccttttattccgtgcagaaaaatcaaaagctcaaaattgacctgcgaataagtagtagtaaaagacttgaccggagtccactgtcaaccaagaaaaagacgccgcttgacagcaagacacccactcactcaaagccggctacagcctacgagttcccacttctcctgtctccacggcccacacacgcatccctgtctccctcttcccgcctttttctcagtcatggccgccacca

SEQ ID NO: 18803 - DNA, 544 bp, Oryza sativa
actaccgagcttaatttttaagtaaaataatatatacttctgaaccaatgttcccttgcgggtctgcatgaatgagttcaagaactgatcccgggcttgctgcaacattgcttcaaaatccttcttctgctcaggtgtgaatttctccggatcgatgggcacgacgtttccttcattgacgtcagtcaaccccaacttttgaatcttttatttaacagtgcttgggctagccgaggatggcgacaacggtggcttctcggccatgaggaagaattgcttgttgacttctaatcagtcccaccagtgtaggatcgagatgtcgactagagggggggtgaataggcgatttaaaactaaataacacctaatcaaatctaacctaagttgctaggcttggtaagggtgaactctaactaagcaactaagttatgttttgcaaacctagggtgatagtggctcaattatatctctaggaaagtaaatcacgctcctatgtcaatgttttgcaatcctagggtgatatgatctcaagtgtgtctctaga

SEQ ID NO: 18804 - DNA, 1299 bp, Oryza sativa
cttcgtcaaggtcgctgcagcccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcatggtttccacgtgtgcagtccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttacaacctaaagaactgtgtgctttctttttatgtgttgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 18805 - DNA, 1251 bp, Oryza sativa
gaccaggggcggtcagaccgaccacatagtggcggtctgaccggcgtaccctggccggtctgaccggccgcaagaaggcggtctgaccggagcataaggccggtctgaccggcggcatttgcgcggtcagaccggccccctggaggccgggatggtgctgctcgggatggccgatacagagccgacggagccgtattcggtcagaccgagccgaggccggtctgaccggccaccccatgccggtctaaccggcgaggccggtggggccctctgatagggctacaacggctagttttctagccgttgcagagtagcacggtctgaccggccacatacctccggttagaccggcagagcacagagttgggggatttcgcccccaacggctagttttggtggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcgtctccacaccgggtcattgcttgttactcttggaggttgccgcctcctagacggcctgtggaggagttgcccagtgacctccccgagaagattgtggaggaggcccggcgccggtttgtgagtggtttggagttcaccaccttcggagtgaaggaagaactaccacgagtgatcgaggcttgggtagtcctctccgtgggtcggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagagatataattgagccactatcaccctaggtttgcaaaacataacttagttgcttagttagagttcacccttaccaagcctagcaacttaggttagatttgattaggtgttatttagttttaaatcgcctattcaccccccctctagtcgacatctcgatcctacactggtgggactgattagaagtcaacaagcaattcttcctca

SEQ ID NO: 18806 - DNA, 1389 bp, Oryza sativa
agtgcatttggccaccaccggccgctggcgccgccgcgaaccgagtcgccggccggtcgacgtcgggcgcgtggataatgcccgcgtcgtcgtcgacgtcgagcttgtggatggtgtaagtagtagtagcctcgtcgccgtcgtcgagcaccaggtagaggtgcttcatcttcgtatgcgccggccgccgccgcgccgtcttgctggcgcggccatcggcctcgccgccgtcgttcctccgccgccgtgacatcccgggtgatcgatccatccactgtttgagttcgatcacgtgcacgtaaatagtcagggcaagactgctgctccgactcggaaacggtacaaaaatcctcttcattttaagggagaaggaattaaaaaaactctgaattaaaatttgatgggtataaaactctctcctttctaagggaaaaagattttttttaaaaaaaactcggtgttaaaggcctggtttagttcccaaaacttttttttactaaaaatatcacattgaatttttggacatatggatgaagcattaaatatagattaaaaaactaattacacagttagaggaaatcgcgagacgaatcatttgagcctaattagtctatgattagttataaatgctacagtaacccgcatgtgctaatgacaaattagttaggctcaaaagattcgtctcgcgattttctagcgagttatgaaattagttttttcattcgtgtcaaaaactctttccgacatatagtgtaacacccaaaaattttcttttttaatcaggccaaaatttgaaaaactgtgaaaaataaaagaagaacaaaatgcaccagccgggaatcgaaaccgggtccgtaccgtggcagggtactattctaccactagaccactggtgcctcgttgtcaagtaatttacaaagctcttaagtcactaattaccagtaatataatcgtcacaaccacgagattagatatagttgatgactactagatgtcagatatgggaatcgtatcagagtgagaagcacatggcaaataggcaatcgtatcgtatcatacacgttcgtgtaatgcaactagaaaacgaagcccagcaaggactccactctgcaagtccaactaaaatcaaattattattgtggcccagccactaaaaacaaatttaatgactacgaaattccgctaatcaaattgtttgatcgagctacacgcttcagtcactgtagagtacacattctgtatgctgtactagttcagtagtacgtactcacagagaaaagaaaacatttcggaaatttgtatatatttcagactaatagaatgcgcacgttttctgaacttttaaataacgtagttttccaaaaaaaaaactatatatatatatatata

SEQ ID NO: 18807 - DNA, 1501 bp, Oryza sativa
gtcaaatttttttttcacaagataaccaatcaacagatgcagctatttgcctatcaagacattcaaattcagcatatgagcagataatacattctaggacaaatctttaaatgtagcaatgcaaaattagtgctcgctaccttcttgagagagagagagagagagagagagagatgctagctacttacaggtgcatcattttctgggatctttattccttttatatagcagtcgtcaatccattggatgttaaccaccttcttgccttcaccgttccatatcagaacagctccctccgaatagtctccctagcaatttgaattaaatgtcaagaacgaaacatgtgttacactaataaaaatcggtagtaatttttttaccgccatagcaacatgagtgcagatgtcatagtctattgattgcagtacgaagcctcctagtacttcaattttccttttgctctgcatcatttagttcagaatgttaataaaacctggaggaagtaaattgttatcaatggactcccatgctgacaagccagccatattagtggtagaaaccaaaatgacatgctgcacaattttacagggtttcaaaattgaacgcagataaatcttacagagccaatcaacaaaattagatacgattcgactaacaaaattcgataaaggaaccttagatacattagtgaagtatagattactcctctaattcgttatcaggaaaatatatggagataaatcctctaattctttatcagcttgtacccttcaggcccaaagaaagggaaggacaagtcacaaaactcaccagattctcaaatagacaagcagtttggaattttggtgcatactaggaatatggcttgcttagaaggagtaaatactaaggggctgtgtagcagaaaactaagatggactggaaatgagtgattgtgtgatatgttccctactgttgataatcatgagcgtaatgtttcaatcttcagagcactgctttcaggtagaaagaacgcaatcttttcgcggaaagtatataaaatggaacttgttttttaccttgacattagatgagatggcataaatatcaaaatatgcacacgctgaaaatgcagtacgaaaaggagaagttcctgagaagatctggttgacagacacaatacttctgtaaaattgctgatatgttcaatttagtttaaatttcatcattccataaaagtcacatgtgtagattccttaacctgctgataatttgacttcatcctgatagcctaggcaccgataattaatctttaaaaaacaagtgtaaggaacgggatgtgtgctgtgtgcatgttgtggcctgaactaaggcagtaaaaatcaattaagctcgatgtccagttccgcatttcccttaaaccctaactctgcaattcgatgaaattggggaacacacgccgacatgtgaattatgagcaactagaactggggacattatctcacctgttcttttagaaggt

SEQ ID NO: 18808 - DNA, 1501 bp, Oryza sativa
accggaggaggaagacctgattggttcagtccaggaatctgatggaggataccccttgctgatttgtgcttcgctccattattggattggatgcgcagtcaactcgttcgtactacgccaagtgtgcatgcagtactggtagtaccactagcatcttgcaagcaggccccaccagcagtctctgtagtctgtactatgtggctgctggttatctctagatgtacggtcctgacctggatacgcccctagccgggcattagcagggcatcattcatttttgctgttcttcatgtcacgtagattaaggtgctgtttggacttatttaagtccctctcatcctaaacaccacctaaaaacaagataggctacatgctccacagtacaagttacttgtagtgggtctcactagtattattttttttcacttttcatcttcccctccctctcctctctctcatttcctttcatcttcctctccgctctctctcccccctctttctttccccacacaggccaggggtgagcggtgacggccggcggggcggtctgagctatggcgcgcgatgctggtgccgggcggcccgagtggcgatggcgcggggcggcccgagcggcgacggcgccaactccgaatcgacgttggcctcgacctcgagcgcatccgcttctccgatgcctccctctccccttctcatctcctccgccgcgctttccccctcctcctctggctgccgtagcgtagaatggggcgacacagtccgacgtcgagcggagtagtgagctcggcggcgtggagtgcggggatgccgacgaggtctctctcctctctttcctttccctgacggcacgaaggtcgagtgtgggtgtcacgcccagaatttctatccaaaattccaaacgcttacatgtgtgtaaaccctcgtccaagaattagccgagacacacaataacaaattaataatagagtacaattattactctaattaataagcaaatataaagtcattatagaggtagatagttcctctcaaacaataaaaattgaagcagcggaaaataagataaacggcgtaggcgtctccatccgacaagcagcttgaccagggctacgcctaatcctccacaccttcagcatcactgtagaattcctcctctgatgaatgattgcaaggtgagtatatgacatactcaacaagccacgcagcaaatatgcaaatgcaggggataacaaaggatggtataatatagtctcatttgcataaatggcctttaataaatacttcagaatttaataaaacagtaaagtatttacttaaacaatattaatccaacactatacaacatactcgttgcataggcccaaccattctgaacaaccattcccggctgcacagctctatctccaaaccaggagctaaacaagttattaccaattacagcatcatttattatggtgagagctgtgagactaatcacgaaagacattgttagaccaggcgc

SEQ ID NO: 18809 - DNA, 255 bp, Oryza sativa
accggctagcggagccgctttagatagaacgatggataactacccgtctcgtgggcaaacgaaaggtttacaggacaaacctagaaaggattccgcacgatttacgacgcgaatcgataaagatggacggactagaataaaatagattgaaacattgaaaaagcgattcaattggcttatgtgtagattgtagattgtgtatgcaattgaaccggccttgtcccttatataggggttggtcttgcgtcctacagg

SEQ ID NO: 18810 - DNA, 1501 bp, Oryza sativa
cattcatcagaggaggaattctacagtgatgctgaaggtgtggaggattaggcgtagccctggtcaagctgcttgtcggatggagacgcctacgccgtttatcttattttccgctgcttcaatttttattgtttgagaggaactatctacctctataatgactttatatttgcttattaattagagtaataattgtactctattattaatttgttattgtgtgtctcggctaattcttggacgagggtttacacacatgtaagcgtttggaattttggatagaaattctgggcgtgacacccacactcgaccttcgtgccgtcagggaaaggaaagagaggagagagacctcgtcggcatccccgcactccacgccgccgagctcactactccgctcgacgtcggactgtgtcgccccattctacgctacggcagccagaggaggagggggaaagcgcggcggaggagatgagaaggggagagggaggcatcggagaagcggatgcgctcgaggtcgaggccaacgtcgattcggagttggcgccgtcgccgctcgggccgccccgcgccatcgccactcgggccgcccggcaccagcatcgcgcgccatagctcagaccgccccgccggccgtcaccgctcacccctggcctgtgtggggaaagaaagaggggggagagagagcggagaggaagatgaaaggaaatgagagagaggagagggaggggaagatgaaaagtgaaaaaaaataatactagtgagacccactacaagtaacttgtactgtggagcatgtagcctatcttgtttttaggtggtgtttaggatgagagggacttaaataagtccaaacagcaccttaatctacgtgacatgaagaacagcaaaaatgaatgatgccctgctaatgcccggctaggggcgtatccaggtcaggaccgtacatctagagataaccagcagccacatagtacagactacagagactgctggtggggcctgcttgcaagatgctagtggtactaccagtactgcatgcacacttggcgtagtacgaacgagttgactgcgcatccaatccaataatggagcgaagcacaaatcagcaaggggtatcctccatcagattcctggactgaaccaatcaggtcttcctcctccggttgaattgctgcatactagtagtactagccaggacaccttttatttacgcttaattgctttctcgatcggaagcaaaacgctagagcaggtccccatcactgtagctcaacatgacatgaactgagccctctctctagttactgtagctgctaccaaccaactaatttgtagacgcagtagtgcttccaatggtctgcatgatggagattacacgtcctaattgtctagaaaccaattaaagaaactgcgacgcgcaatcaacctgcactaggctaaagaaaattaaggtactaatcaccgacaatatatttctttttcaaaccatcgtactcatcgg

SEQ ID NO: 18811 - DNA, 1250 bp, Oryza sativa
acatcttagaaggaacacacctatatgagtccaactgctagtcacagtctataagatttgggtgatctctagatactcatgaaaaggccgggagtataactcatacgctccaaacagaggggatgcaaacggcatcccagtattagttaagggtttgagtgaaacctgaattacacaagactgacaattcaaggcatagtccattgttcagttgtgatctggtgtagctcttttcctaggtgtaagttcaacttaacagtttccaccgaaacactggtataaaaaacaaatgggctatcgagagcatttctagtgagccatgaaatttggtggggattgttggaataaatgggttaggcctgatttaattcaattaaaatccataggcccgcaataaatgttagaggtaataaaactacctcaggaatttaagtgaagagatctcaatttaaaatagggagctagagaagagcccctgttgaccggttgagatagtgggcggactgccacacgggcgcacgcgcgcgcctgccgggccgggccgggttgaggccgtgggcgtggccgtggcgaggccaattgaattcctttcgaaccggctcaacggatgggaattgaatatgattcaatgcgggcgcgactgttactctggtaatggacgagaagcgccccctcctgcgctataaaaagccaccaccgcgacagagctccggttccgctctccgtctctcacacttcctcctcctgtcgctgaatctcttatgtttcctgcgctgctactctgtcttctccggttctgatctcttgcgcgcatgggagatccaggacgagtaggtgcctccagaactccgtccacctgagaaacctgcacgggtaggcggacgatcaagtttttagggagcatctcgacgtgactgctctgcttcctctgcatcgcgatggcttccactggcgatggtgcaccaggagctggagggaacggcggcgctccaggcgacaacaccaacggaggcaattctgcctcacaatccagcggagggacattgactgggtataatctttctacactacttttcatgtctactaagtttatgtttggcgcaatgtttttagtgcattgccttatggtgaatatctatactttttatatattaagcatgatttatttgttacatctgtttgataattgtactggtttattccctgttaaagtcatgattattatcgtaataatttggattaaaatatac

SEQ ID NO: 18812 - DNA, 749 bp, Oryza sativa
tgacagaggagaagaggaagaaaagtctaagacttttggagaaggaagacaaaaaggtggccgatgctgcagctgaaaggaaagaggctcttaatgctttcatcaacaaaggtaacaaacaaatcccatctatagttgatgaaagtaatttctctctagctcaaatggctagtctgctaggtgttaatttaggatgtgctctagaagctgtggatacaaatctggaattggctagaataaatctgttcttgaaagagaaactaaatacttctcagaaaggggagtgtgaaaatgttggggaaaacttgagtgacatagacataaatatagatgaagtcttacattcagatgattgtatgtctgattttgattatgctgaaaacatgttgaggctttctcaaagcaattcatcaggaaaaaagaggaggaaaaataacagaggaaaccttgagattttcaaggtcactcctaaatgtagtggcaaaaatgagaagaaaaaaacaaaaaagaaatcatgaaaggtttattttggaatataagaggtatgggtgatcatgataaaataaagcatctcaatgatttaataaaagagcataaagttgatttcattggcatccaagaaactgtgaagcaggatttcactgctaaagacttggatttaataggaggagggggtaagtttagttggaattggaccattcccaggggtagatctgggggtatgttggtgggaataaatgaagacaaaa

SEQ ID NO: 18813 - DNA, 1501 bp, Oryza sativa
ataaatttttaaatgagaacaattaaaggaattataaactgcatgtgccattagtttggtttaattaaaagagaaagagaagagaacagttctacttttctaatatttttagagggcttctatgggtaaccatttggcacaacctagggtcaaggaggctctaataccaatttgtcacgtccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgccgacgactccactccacaggcagcttgaccagggctacacctaatcttccacaccatcagcatcactgtagaactcctcctctgatgaatgattgctaggtgagtatatgacatactcagcaagccacgcaacaaatatgcaagtgcacaggataacaaaggatggcatagtagggtttcatttgcataaacagcatttaataaacatttcagaatttaataaaacagttaagtaataattaaacaatattaatccaacgctatacaacataccctgttgcttaggcccaaccattctgaacaatcatcccggctgcacattctgaacaatcatctcggctgcacagttctatctccaaaccaggaattaaccattccaaaccaggagctaatcaaattattaccagttatagcatcttttattatgatgagaagtgtgagactaatcacgaaagacattgttagacccgcccataaccgcgggcacggctattcgaatagttgtgctctggccagaggtgtaccactgtacccacaagacacagcctcatgacatgtcaccatgcgcctcaataccaccacagtacctcggaaaggagctgtgacagtacccctcgcacaacacaatccaccacagctcaccgttcctggatcataatcacccccttataaacaaggcatggactccccagcgacccccgtgggcttatctccgccacttctcagtctggtgctccggaatgaaccatgttatacaaaaggtaaagccgttgcccacgctggcttgtggttggcacggttaatgtttcacaaccgaaaatcgtgaaccggtcctttattgtcatgagcacgaccaacaaaaccatgtgctcacaacccaccattatcaagttttagttggcaatttaattaattaaccaatcacgattgaccatcgtgaactatcattaagccatcattaaataatagtgaatcataagttatcccaatattgtgctaatgtttctaagcatggctaagcaatcatatctgatatctagctgaaccaatatataaagctcaactagtcaagttataataacccaaggtatcaaggaataaagtaatcaagaacaaaa

SEQ ID NO: 18814 - DNA, 1501 bp, Oryza sativa
aagtcattctcattttgtacataatcatacctttagcgacacacggacacaagcagctaaccaaggtgtgatgcagccgtgctcatgggcacgtgatatgaggaggcaggctacaccagtacctgagttggtgacagcacagtatggtaaagctaagcaaatcaacataacgtgtccatacttaaagtgagaagacatgtccatacttaaagtgagaagacatgggactttctaatggtaattttttaatctttatggttcatctctttaagaattgtgcttttcttattatgagaatgctaatatcaaatcctaatattagcatgatgatgatgccggttagttatcaggtcctaatatctctaagagcaggtacaatagcatactataagccagctataaacatattttaagaagataaaagaggagagataagagcagcgggctaaaaatttgtagccaactgcagcacggactccaagatacatgtgtgtataacaggtgggaccagacattaattatgtagtacatgtttataggtaactatcgtatgaattggctattaaattgactatagatgatttggagccaatagttgactatcctattaaacttgctctaaggtattatatgtcctggtacctacccaatatcaagtgatacctatcaggtatcagatgatagctcgtaatatcacctgatacctcataaatatcacatgatacttggtagtaatcacctgataccgggtagaaatcacctgatcctagttagtactactaaaatagctagcaattatcacctgataagaatatggtggatatggtggctcaaagaagcatatggtggatatagctagcaattatatgacggctcaaagaagcatcatgagtactaggtatgcatatggtggatcgctctcatacctcctttgtaatggtaagtagtaatatgaaacaggtaataaaatatccagtatcaggtgatacctatcaggtatcagataatagctagcaagtatcacctgatactagttagtactactaaaatagtgtggtaataatatagtttttttacatggatggtaataatatagttgatgaagcactacaaatgcatgtcccgacctacaaactcaaggaggagcgctcaacgtggagagcaaccattaattgctacatgcggatttttttgagagccatgcacattgattcgttgggctagctgagtccgtctttatcctcatctatatcctaaccttggttagggagacagaggtgtcatctgaatgtcccgttcggacggagcgctatgcgctagtcattcttgtaggttataggtagtgtagtgaatagtgatggaatcatgcagcatgagtgcataataccgctcatcaagttttaaatccaggtgtccactaataataagcatgtatactttcaatagcattttattaagcatgtgcatgtcatattacgtgtaatacaaaattcctacgtta

SEQ ID NO: 18815 - DNA, 1501 bp, Oryza sativa
aggtatcttcttttcaggagtccgaggcttgagttgcctcttcacttctcctgccacataagggtcaagctcctcttgactacaatcgtatggcggctccttgtttttggtggtgtcaactttggccttcttcgttgcccttgtgctggcaggaggtggagcttggtgagaccttgtcttgggaggtgcaggcggacacggtggaggtggaggtggaggaggcggaggaggcggaggagccggaggagatggtgcaggaggaggtggcggaggagccggaggagatggtgcaggaggacgtggcgaaggaactggaggagatggtgcaggaggagacggcggagccagaggagatggtgcacgagacgccgcttgtcgcccagggaggatgatgaaccggacgtggcttgtgtctcgtagatgcgtctcaccatctcctcctaagtagtccaactcgaggtcctcgtacacggcttccaccagctcaacttcgaccctcgagtatcctgctggaatcggcctacagtggtaagtccctgaaatgtccgttgggatgtcctttaccgatgccaccttcacgtgatgagaggttatctattagtaatcaacctaagcagcaacttgcggaacgtacaagtcaaaaatcatatattatatcgagcataccttgattgataagttcttgaagggaatatgcagctcacatggtgtccgttgcgtgatctcatcaatggggcaggtggtttcgtcctgggtttgcatgacgtccatgctatatgatcctacctaccccattgaggcgcagctgctacgattgcctgatgggctgaccattggaggaggtatgtacggctggggatcgtgtgaccgatatgctgccatgcgttcatccaccttccgggccacctcctcttgcatgctgagctcgtagctcgataccctgtactcaagatctgcaatcttcgcctcggtatctctcttgctcctcatctgactcttgtatgtgtggatgtcctccttgaatccaatctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtttggtcgaacgtgtcacgctgcatgcagcgtagtgcagtgcgttcctttatccggtctgtgaccagtcacagaccggtcagatcacgggttaggtggcgactggcggtctgacgcacgccttgccccatcccgtcaagacgaaagcctctaggcactcgtctcaagccagagctagcgtgtaatctcttagagatggcacgttagccctggttaga

SEQ ID NO: 18816 - DNA, 1501 bp, Oryza sativa
tttggtcaaaccgaccttaggccccctcatctccacttttcacgtggaggtccatggagaatggcgattgtgggtgaaccgacatccataaccgtcataattgccctataaaaggaggaactcactcatttctaaaatgcacaataaagtggagtgcaactcacttttatgaattaaatttgaaaatacatatttttttcaatattttgcgtttatatacatgcataaaaaatattggcacaaatatacctcctccgcgtaatggggatacgggatggaggcggtgccgcttttccattccgtgggaccggcggtcgcgcaggacagccgtgcggcaccgcctcgcatggcctcactggagggcggtcctgcaacacggcgctgtgtgaccggctcggtcccgcgcatcattgccgcgcaaccgccctgctcctgcccatctgcgccgctagctgtgccttgattaattctagacctaattgaggccaaaattaacaatatgattaaccagctagcttgtactttctcttagaagaattaagttggcaatgatggatggatggagctgaggagatcaggatggaataattagtaagctaagctagtactccctccggttctataataagctttggacaaggttgatgtcaaacttatataactttgaccataaataactttaaaaatatttggtttaaagaaactagaacaatatatatagatttatctttcaaaacatatatagtaaaagttaacatgcatttattaattttatatattataatagaaaaataaggtcaaacatatattttgtagactgtgtcattgttcaaaacgtcaattaaaataaaaccggagggagtacctatatattgtggggtttggctagatcaactgcgtgcatgcgtgcttgagaggtgatgctttgcatggctcgcgtcgaccgcgacacgcgcacgcgcgggacgggacgggaagcatggtcccgcgccacggcgccacgcgacctgctcggtcccgcgtgcagccgccctctaccacgctaccgctctcctgggctgcgggagtgaggcggtgtcgcacagccatcctgcaggactgccggtcccatggaatggaagcgcggcaccgtttcggtcctgcgtccccatcgtgcggagaggtatatttgtgcaaatattttctatgcaggtatataaacgcaaaatattgaaaaaaaatgtatattttcaaatttaattttcacttttatatcttaggcatcaatttaatagtatggtgaaaatagatagagagtgaaggcaacgtccgaatacctcagtgaatgcttctttaataaagtactatgtcatctttgaacttagttcatcctcgtatattttcttttattttattccctcctcttcttgcctaccatagagcatcaatctattcaaaaccttcctgttacaaggggcgtgttttgtgagccacttttttcttcaaaacccatatccgttca

SEQ ID NO: 18817 - DNA, 1501 bp, Oryza sativa
cacatttttacctgcttgatcactgtgactgctgtagtaccactgaacacagagtcaatggttttatgaaacttaagatccctgtccattacataaaatgcccttaataatgaagttcttaatgcagcaaacatctcggggtagtctccattctcctccgttcccaggggagtttcagtatctctatccatgcgttcggtgccaccaccttcagtcatgctgcttgtgacaatgttagttgaagtttctttgtgtccatctcttcctaaatttgcactcaactttatagggaggagatctctgaccctcttggacaccaaatggccatatggtccatggccatcaaaaacaccacaaaaaattgtatcttcctttgaacagaaattctggaagtcaaacaaaaaacaccatcaaaatcaactttgcggtgcctaaaaatggaatggtagaacaggaaaactggaagtggataattcatatgattacagactattatcaggtaggaattgataaatttatgtaatttatagctgaaaggaatatcattcatggttttaatattacaaaggcttcatagaaaggaacatcagatggtgcattcccatggagatctccaaaaatttcaacaaaccagatcacaaaaaaattgtactttcaatttattatttggcttttatagtatttttttccatggttactagatgtaaatatggaaaaatcagaaaccattatcacaataaagaaattggtagggcagcaaatatgttgccattgcaaaagtacatgaaaggagctatcattctactagctggctcacaaaaacaatagttgtatgctacatggcatgccaggtggtacttcagcaaactgtggagacaataaggctcggtgggttcacatcctctacaataatggtactatcattataggcaccgacgtgtggtgcaatgggagggtaggatccacatactagtgactgtaatggtagtaacattatggtagaggatcctcacaacaaaaggataatactaggtgttatggggcagaacgataagcaaacattaattacacagcaaaaggatggcccaagagctaaactcaatgtgtaaacagataagaataagatcatccataaaaagaagaaaggataaggatgagaatcgtgtggagcacctcccctgctaacaaattttctacatagggagaataataattaggttgtattatattactatctgaaacagtctccaccagcaatatccaatggcaatccatatggagacagaacaaagtggtattctaatatcaagaagtaggggaatcaaacatgcattctacaccaagacgacacatgtatgtcctatgtcaaagttgaaaaaaaaatcaatctgtgtaggccagctcaagcatacacaagaacaacatatattaaaaaaaaatcgcagatatatcagacagttcggggctttcatgtaaacgttcaatcatcaatcaatcaatc

SEQ ID NO: 18818 - DNA, 1501 bp, Oryza sativa
ggtgcctagaccgatctctgcacgctcttgtaaccacagatcaatctgtagcccgaggtattgtgccgccgactcctgcaaccattggatcgatggtgcaccattcaatctactattcaatatttaatatactaactaagtcacttgggcatagttttagatcttggacccacagtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttgaaaaaatgctcgtggcaatctattcgtcaactcgttttccacattggagtatgccgtgggaaaacttgattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggaggtacccttctattgtttgaaaaattcctaagagggtaaaacaaatatctaataaataaacccattcaaacaaagatccgttactctcttacgtttcgagacgtatcttggtcgttttttgttgcgttgttatcatctttcgttgtgatttatgaacagcttctgccagaaaccagagttgctggcttctagaatagcaaaggcagcggcacgcgcggaccaagccagcgattgattggagacccttcccccccccccccccccccccggcgcgcgcgcgcatgtgctgacaattaagcgtcaaaatgaacgtgtgcgttggtgtgtgcgtggacaaatacctaactatcactgtgaattcagccagattggtgcgttatcgcacgcccaagttgcccaagttgccgagatcgatttggaacttgatcaaatccaaaacgaaaagtaggagatcgatgccgcagtgcagcccaaaactacgtacgctaggctacgtcc

SEQ ID NO: 18819 - DNA, 1501 bp, Oryza sativa
ccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccacccctccgcttcgctcgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgctgttatgtggaggttattagagtaaaagccgtttcttttccgttggtcgtgtagacgctgcagcttcggaagatccgctcttcgtggaagtcgaagccgtcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctatttatggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccgg

SEQ ID NO: 18820 - DNA, 1501 bp, Oryza sativa
tgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccaccacgcgtcagcctagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcttggtgacaggtgggaccggtctccatggttgggcagaaacccaacggtctcaaatcatgcacatcggtaatggtgacttggctgtccataatgggcggtctcttcaagactgccacattacttgagcgacgtacgaatctgggtaaaccgatttgcttcgcctggagatatggtaacgttgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaaaggtataaagacactgaggaacggatttgctcccttcctttcgccactattccccttgccttcgccgcttgagctctaactctttctctgctgcgcctttccttcgccacacgcgctcgttctcaatcatcccttcctccggcgcca

SEQ ID NO: 18821 - DNA, 1501 bp, Oryza sativa
aaccaaggaagtatttttaataaatggaattgcatttcatgaataatttaaattggaaaaggtttttaaagttcccatttggctttgtccctctctctcctctccggcccagtcggcccagtcagcctgcagccgcccgcgcgcgcgcgctcggccgctgacaggtgggtcccacctgtcggactcgtcgtcctcctcgcgccgaaaccctagccgcgccgcgccgccgccgcctttccaattcggccgcatctttcccgatccggtgaaatagtttgaggggaaatgctccccgggatcttctctacctttttccttttggaatcgatcgccaattcggtttggaaatccatggattcatgttcgattcggatcgatctatctcctccgaaccctaaaccttccatcgcgtcgccggtcgctgtgggccttcgccgccgcctccttgcccctataaaaggacccccggtgtctccgctatccgtcgccacccttgcctttgcccgccgccatctgtagcaccctagcaccgtgcagccgtgcgccgccgtcgccgccgcagctccagccgtgcgccgccgtcgctccggtcgtcgtcgctgctcggggaggtcaccgttgtggtcaccaagccgtcaccgatctcgtccacccctccgtcgtcgccgtaggtcaccggagcatcgccgtcgtcatcaagccgaaggtcgccgccgcttattccacgacgtcgtcgccgtccgttgatcttccgccactgttttggtcaccggtgagttcgccacgtcgccctctacgtgttggtgtcctccgttcgcgtcgtcgcgccgtcgttcgccggcgagcttgcgtgcccgagccgccgccagtgatgacgtcatcgccgacgtcatcgttgccgtccgtcgtaggccggtcgtagaccgtcagatcttggccgtccgttgtggataggatcgatctcggccgttcgtttccgtgagtcgccgctgtgcacccggtccaccgcggaccctagccgctgacgcaataattcccttttccttttcaaaaataattcattattgcgtcataattcaattaaaacccatataagtgttttaatccgatttaatgtttaaaaaatcataactaattcatcttaactcagatttagttggttcaagtctctaaatttttctaaaattgagatctacatgttaaaaatatctacatgtactgttcatgcttgtttatgtgctgttttggtgattttgctcttttctgtttagattccgacttttccggagagtccgttttcgcaggagaagaatttgaagagttccaaggccagcaaggcaagtcacacagatcccaaccaaccctttgagcatattgatcccgtttaaagctattgtttctattcaactattgcatttatttttgaatgtcatggggtggaattaacctattgtttgttatagcccttttgttcttgattactttattccttgataccttg

SEQ ID NO: 18822 - DNA, 1501 bp, Oryza sativa
gatagaaattccggacgtgacaaattggtattagagcctccttgaccctaggttgtgccaaatggttacccatagaagccctctaaaaatattagaaaagtagaactgttctcttctctttctcttttaattaaaccaaactaatggcacatgcagtttataattcctttaattgttctcatttaaaaatttatttattattcctgtgttattagtaccgtacatctattactgtactaatggcccatttaccagcaaaagttttacaacattgttttatttaatcttgctgtaatgaaataaatttagcatgttgattttataactttcttttattttatttcttttgaaacctgttgttcaaaagtgcaaaatttgtaatcttgtttccaactgtttcaacttatcttgctagcttggtttactttatttacttaccttttactttgatttttctaactttattcaaattaatccaaaaacttgtgctattaattggataaaggtcttaactccctcctttcacttgtctttagatgccgcgctacaagcctgagtacttgtttggtgttgagcgatttgtccaggagttgcgtacgatgtcctttgccataggatttgggactgcccctttgtatgcccagattcctcatgatcgtgatgaagagaagtgccgagtcaaagtcaccttgaacagtaatagtgaagatatcccatcagtgatgttcgaagttggaggaggaaactacattcatgcatgtcaggaggtggcaaggatcgccataggagagctccgcgatcgctacagtgatcagttggccgacactgagtatcgctaccatcctcgccaaccccagggaggtgaccgtggcagctaccttgagactgaggggattgagaatgatgctaccacaaggcatttggttgagatactgtgggctatggatgagacccgcgcggaggttgtgctagcagctcaagatcgtgaagaccggaatcgtgataagatttgcaagctagaggacaatgtggattgtaacatcccggcctagggtttaataggattaatagaatactcataccaataagttgcaacttcttttccggaagccaatctccaaagaactccagggttaagcgtgcttggcctggagcaatttgggatgggtgaccgaccgggaaattctttccgggtgcacacgagtgagggtagtctatgacctatgaaagctatcagatgtaagtgggcccggcctgggggaggcgggacgttacatggatcgtttgggcccggcctgggggaggcgggacgttacatggatcgtttggagaaggaactagccgcattgaagggagaagcaccaccacaaaaggccagggttcgtcttaccgcaaggaagagagctctattcgtccctcgctaccaattggcgccaaaggttcgtgtggtggaaaaagaagctaccccaaccctagcggatcctccggtcgtcaacgtaag

SEQ ID NO: 18823 - DNA, 1501 bp, Oryza sativa
tgcacatgcttaataaaatgctattgaaagtatacatgcttattattagtggacacctggatttaaaacttgatgagcggtattatgcactcatgctgcatgattccatcactattcactacactacctataacctacaagaatgactagcgcatagcgctccgtccgaacgggacattcagatgacacctctgtctccctaaccaaggttaggatatagatgaggataaagacggactcagctagcccaacgaatcaatgtgcatggctctcaaaaaaatccgcatgtagcaattaatggttgctctccacgttgagcgctcctccttgagtttgtaggtcgggacatgcatttgtagtgcttcatcaactatattattaccatccatgtaaaaaaactatattattaccacactattttagtagtactaactagtatcaggtgatacttgctagctattatctgatacctgataggtatcacctgatactggatattttattacctgtttcatattactacttaccattacaaaggaggtatgagagcgatccaccatatgcatacctagtactcatgatgcttctttgagccgtcatataattgctagctatatccaccatatgcttctttgagccaccatatccaccatattcttatcaggtgataattgctagctattttagtagtactaactaggatcaggtgatttctacccggtatcaggtgattactaccaagtatcatgtgatatttatgaggtatcaggtgatattacgagctatcatctgatacctgataggtatcacttgatattgggtaggtaccaggacatataataccttagagcaagtttaataggatagtcaactattggctccaaatcatctatagtcaatttaatagccaattcatacgatagttacctataaacatgtactacataattaatgtctggtcccacctgttatacacacatgtatcttggagtccgtgctgcagttggctacaaatttttagcccgctgctcttatctctcctcttttatcttcttaaaatatgtttatagctggcttatagtatgctattgtacctgctcttagagatattaggacctgataactaaccggcatcatcatcatgctaatattaggatttgatattagcattctcataataagaaaagcacaattcttaaagagatgaaccataaagattaaaaaattaccattagaaagtcccatgtcttctcactttaagtatggacatgtcttctcactttaagtatggacacgttatgttgatttgcttagctttaccatactgtgctgtcaccaactcaggtactggtgtagcctgcctcctcatatcacgtgcccatgagcacggctgcatcacaccttggttagctgcttgtgtccgtgtgtcgctaaaggtatgattatgtacaaaatgagaatgacttatgtttgtatcggaggaagcgatcatacgagactt

SEQ ID NO: 18824 - DNA, 349 bp, Oryza sativa
ttcagaacagatcggcgggcaaaggctgtgatggctgtcgaagaagtgcaagccttccgcaagaagttcgacgcccagcaagcaagcaaccatcatcagccagcccgcaagaaggtccgaaaagacctctactgcgcttttcacggacgctctttgcacaccacggagcaatgcttaaacattaggcaacgtggcaacgcgcaagacccaaggccgcagcaaggaacaacagtcgaagcaccccgtgaagcagttcaggagcaaatacccctagccgaacaacgccaagatacacaacgaagggtaatccaagtgattacaagagctgacccgccaagcctgttgtcga

SEQ ID NO: 18825 - DNA, 1196 bp, Oryza sativa
ctgggactaacaatcaatacataatatataatccctcacccttatcctctccttctcattttaacttccttctcctccctttcctctctttttcctttcttatcctctcatatttcctctctcttaccctcttcttttaacttagcagcgggagaaagcaaggtgagggcagcggcggcccgcgaggggggcggtagcggcggtggtccgcaaggggcccgggactaaagatcataaaatgacgttggtcttttcaaccggggtaaaagatcatttttagtcccggtttttgttaaatcgggactaatgtggtttttggccaacttggcaaagatggtttctctagtagtgataagcggatatgtgatcgagttatatatatatatatatatatatatataatacttcgtgctcccttcgctagatgtttgacttaccacaaactgatagtagtattatattttgggatgatggaagtattttcttaaaaaatatattaaagctctcatttaggccctaattatttcaagttagtaggcagccacgtatccacaagtaggtactactactaaacaaagagtatatatttaattacgatcgtgtaacccggtcatgaagcaagacttaagtaactaaaatgtagtttccggtccatgggggcacatcgactaaagcctagctagaaaccaaaacaaacaacatttatttgtccaattttctcggcattctacctttctactacctccattttttaatagataacgtcgttgactttttctcacatatttgaccattcgtcttattcaaaaaatttatgtaattataatttattttgttatgagttattttatcactcatagtactttaagtatgatttatatcttatacatttgcataaattttttgaataagacaaattgtcaaacatgtgagaaaaattcaacggcgtcatctattaaaaaatggagggagtaccttagaaaaattatgcagatcatatataacctgtttttcctgatggacaggtaacactttttaaagacgagagaaagataaatagttagagcattatgaagcaatgagaaaggaaattaaaagaggcctgcaaatttataccgagctatatcatatcacgtgaaaagaggagacaccatatttttgtgaggatccattagaccttgttcggttaatccctg

SEQ ID NO: 18826 - DNA, 355 bp, Oryza sativa
gctcaaagggtgggttgggatctgtgtgacgtgcctatgctggccttggaactctacaaattcttctcatgcgaaaacggactctccggaaaagtcggaatctaaacagaaaagagcagaatcaccaaaacagcacataaacaagcatgaacagtacatgtagatatttttaacatgtagatctcaattttagaaaaatttagagacttgaaccaactaaaactgagttaagatgaattagttatgattttttaaacattaaatcggattaaaacacttatatgggttttaattgaattatgacgcaataatgaattatttttgaaaaggaaaagggaattattgcgtcacaggc

SEQ ID NO: 18827 - DNA, 1501 bp, Oryza sativa
ctcccatatcgatgtggatgacgtagcaatgttatttggccacatcggtatagctaatgtaacagcatggcgttgtcatggcaaactgccacacccgctggtggcagtattgttttgttacaccaaaagttttagattttggtaataagttttgagatggtttattttaaaattaaaaattaaaaaggttcaaataatgataaaaaaatcacgtttatacttttgtctgattaatttactagccgcttggtccatctgaaaatccaatgcattgctatacattcaaataatatatttgatcgtttactttcactcccggaaaactcttctttagtcctggtttacaacccctttagtcctatattacaaaccgagactaaatgcaacccgggactaaagatggtcgtccatctttagtcccgggtgaaataaccgggactaaagttagatgtttaccaatcatgactaaagatggtagtggcagtcccggttggtcatcatttttttctttttttttcattgtttctttgctgcttgcattttgatttttccttcgagttgatccctacatgattttcccaaatcgagtgccctacatatcctaaaatcaaagtaacatcacaaatcataagttcatataaaaaattctccaaaaaaatacatcacaaatcaaatacatcacagattatatatctcagatccataccatgaatcacaaattctaaaaaaaaagaacaaacaaaatccaccgctgccgctgccgcctcccgccttccctctggcagaggggagggcgcagccgaccgcccgccgccgcctaccgcttagtaggaaatcgtgccgcatgcctgtccaaccgttttgatggaaataacatatacctttcaagttatcctattcctacagccgttatctagattttttttatatatgaggtgaataaaattaacaactaagggttgtccatatttatgttattttaaaccatatcattttttcataaaagttattaaagatgtgcatccatttagtttcttaccaaactttgataaatatataagaaatcctattaaaacttggcaatattaattaatcccctagcgttttcacaaaccagcagcgaacctccacttgccattcaaactcacatacatttgctagttcacggaacacataagattttttttttaaaaaaactaaaatggcaaagtagacgcataaagtaattctaaggctaaaactacgcataaggtatacgtacactgtgcatgcgtatacaccgtagtatatagtagtagaatatttggtccaaatagaggtgtaactttcttccaaaatgggccttcctactctggcccaaatggtcatatggcccatcaaaagtgagcggatccgactcgacaacaagatcccccgcgcgcgcacaagaaaaaggagccaaatctggctaccgatcgatcgatgtcattggagatgaaaacggatacggatggaaactagc

SEQ ID NO: 18828 - DNA, 1501 bp, Oryza sativa
atagtcaatgaggtgaggggctcccctacttatgtattaggtctctttcccttttacaaccaatgtgagactattcatcaatctccccttcacacattggtgtccctcagccattcactcccccttcagtccctcgggtatacttccacggcgcatcaacactatgtcctttgagccagagatgttgaactagctagctctgataccaattgtagtattgtaaaaggtcttttctacccaaaagctagccaatgtgatgaggggctcccctatttatatattaggtttattgcccttccacagctaatatgggactatttaacatgattttcagaggcaatttacttttccaaatctttcacctttctgcatctatgacccctctaaaagtcaggattatatacactaatttagtggtgaaactcttcttcttgttatgatgccaaaccacttgatccttcccccccccccccaaccatctaactgataactgttgatcatcattcttaagacaataagcttatcctgtctctgctgattcagatttcttctaaaatccagcttccattcacccttcacaaaaatatcactcacagaagcctcctgatggtaacttatctcatataaatcaggaaatttaacttttagagacaccttgtcacacgatacatccttccaaaaatacacagattccccattgcgcacatctttctctacaagcttttccaaccacttctgcaatgatgtaaccccttctaaaattgagatccaccgtcagcagaacgaccaaaagaactgccattgttcacatattttttcctaagaacctgaaaacacatatctggagccctattttccaactttatcatccacttactgacaagacaaatgttcatcaccctagtatccagcaagtccaacccaccataatcttttggcctacacagaaatgtaggaattaaaatcataggattgttttctatatgcatcattggtttcatagaaatagatctaaaaaatccataaggattatagtcttattaccttatttcataggattcttagtatggggtaagatctcttagaaaaatttataatgattggaatacatgtgacgtcctaatccaaagcatttacctttctattcctatgatttagaaatcctttgaactgaataagcacatggtgaaattagaatcccatctcttgtactatatggtaggggggaaaaacaccaatcatcatcttgccctcaagactcttcacgatcaatcctgtccagaaagtaaaaccgggatgacaaacatatacttggatttcactgtcaattcagcaatgctctgatggaacccgaatgcatcctttggattatattccctgtcaagctgccaaccctaccaccagctcccctcgatatttctcatctagtagttgcttacaaaacttttcctgtcaaaaagatggctgatttgattaattacttggctgttctgaaacttgg

SEQ ID NO: 18829 - DNA, 319 bp, Oryza sativa
ataacttatgattcactattatttaatgatggcttaatgatagttcacgatggtcaatcgtgattggttaattaattaaattgccaactaaaacttgataatggtgggttgtgagcacatggttttgttggtcgtgatcatgacaattaaggaccggttcacgattttcggttgtgaaacattaaccgtgccaaccacaagccagcgtgggcaacgactttaccttttgtataacatggttcattgcgaagcaccagactgagaagtggcggagataagcccacgggggtcgctggggagtccatgccttgtttataag

SEQ ID NO: 18830 - DNA, 1501 bp, Oryza sativa
taggcaaaaactagtcttcaaacaaaaacaattcatatatattttgagctagcgtcttccttaagtttcgtccaacacccaagctggctagagcatctccaacagactacttaaatttgactctccaaacacctatatagccaactatccatctgatttggcaagtcaaactcattgatcactccaacaacctctctatctacactctctattctaaatctatggcagcgggacccgtatgttagcctctattaccttcttcttcctctttctcccctttttctccccacccatactgctcccttcttcctctactactgccacgagctcctcccagcgccctctacctccgcggcgacagcggattcatgtgtgtgtaaggtgacggtagatgacgacggacaggtgaggcgaggcaacgctcggacggcgaacggtgacgggcgcgcgaggcgatggccatgccgacgacgacaggcgtggatccgttcctcgccgacctctctcgctccccgcaccccggccatcgcgccctccctcctgtccccgggaaggatgaggacggcggctcgtgcaaccgcggaagacggccggagcagagcgggacgatggtggctgccacaacggaagacggcgcagcggctggtgtcatagcagctcgtggccacagcggggggacggcggcgggcgacggcttgatgaacaaggtagcacagctgatggacggcgtcgacggcgctcgatctgggaaggagacagtacgggagaggagagagagaggaaaaattcgtgggcccacgcatggggcccacgattggcaaggcaactttggctagcgcgtggaggagtttggcgaaccagatggcttggccatccggttggcaagtatgttggagtgtgtttttcatccaaaattactaaaatttaacttggagagtaagatagatatgctgttggagatgctcttacctaaattcctggtttcatatgttgtgtatttttttagtggttttctttttcaattattgaatattttttagggtttgtttttaaaacatattgataaaaaggttttaaaaataaaaaaactcataataatgagcatggcgacaacttaaagaataatttatgttccagggtccagggaaagaaaaattcagaaacacagtaccattcctaatacaccgcatatgcaattacaaaccgatggatacacatacactgaaaataatggttgcccagtgaccacaccaccataatgtgcacacagttatctgcacgaacaatgcacagcatgtggcacttggaattgaatagaaatggaggctagctagcttgctcaaatcttctactgtgacagcacgctatttcctccatcctaaaatataaaagattttagatatatgtgatacatatgatattatgaatcttcatattcgtaataataagataggtcacatctatccaaaatataatccctcgtatttttggaccgctgaat

SEQ ID NO: 18831 - DNA, 1501 bp, Oryza sativa
ctggcatatgaagtgaatcaatgcaatacgattcgtaatgagttagcatcccaactgcagagacaggtcacgtatatacgtacgtatgcaggccggcctacttccaaatccaaattccaatacgattatacaattcaccgattgattgatttaatttcttcctgcttcaattcgatcgatcgatcggcgtcgaccagaaattaatcgatcgagtctatctagggaccaatcgaattcatcgagttcgctcaatggcaactgctgctggtagatatgaagacagcggagtcagtgtctctttccggcggaaggcggcgtacacggcggcgtcgctgcttgtcttcctcgtcgccggccagctgccgctctatggcgtcaagaagtacaacggcgacaaggatgtcccggatcccttgtactggatgaattgcatgtttgcgtcaagcaataacaccctgatgactcttggaatcatccctcttcttctctccgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcga

SEQ ID NO: 18832 - DNA, 1501 bp, Oryza sativa
gtagtagaaaagaagtgatgaaaggtgagtagaagaaaaggaaactttgggacataatgcagacaacactggcatctggcctaaaaatattgcagagcatctgaacattgtaaatctcaaaacacatattgtagagttggtgtgtgttcgctagctgtgtcatcttggcaaactggattgaactaataatattggatcagatcatggttaggtttgttcgattagaggcacgcaatttgggggatttaatttagaaagtaaattgcattaattagtggtttatgaacttgtgatgagataggtttaatttagtatagtgtaaaaagttgtaagatactcaaactgatgtaatgacgtgtttagtggtgcaaaacatggtcaaaccctatagtgttttcaatataaagtaaaatatattgatttcatggaaaaggaaatattgatatattgatctatatactacttaaaatataagtagtggtggtgtttatttccacaccacctctatcactaacagctaggccttacaatctatactattagaccacctttcaacaaatcctccactattttattattcattttccccaaatttcaaaatcacctacttattcaataaaaaaaatcatacaattacttagactaattaattaattcaataagctagaaactcaatttgttttccgttataatgcacgggctctagggtagttatacaaaatgatgtattgattttggaggaaggattttcgtggcttagctggaggaagggttttcgtgatgtactgattagagttctttttgttatctcagtgtctttggtcctggaggatttggatggttttttcctatccttttctgtcaccacggtagttagtggggtcacgtaaatatttaaatcttattatttttaatgtaatgatacgtagttctcttgcatattctactttacttttatatatagtacatattatatatatagtacatattttacttttcactgagtatgtttaatgtcgcgtactatggttgcacttttgattttctataattacccattgaaattgaactgttgagatctttattcctaagagttttgtacagtaacatttttttaagtaagtaaagcatacggtcgattgattataatctcatgatctgatgttgcacggcatcttgaggactctgacctaaaattctctcccatgcatgccttatatatggccacctcatatccacacttggttggcatcggaatgatcatggaaaagggctactctgccaccaaaggataggttctgcaatttgcaaaggatgggtgatgaacaattgttgcaccaattcgagcatgaagatgaaataataattaaatgttttacgaaaaaaagtggtattaacgtatgattaattgagttttaattattgtaaatttgaaaaatagatttatctgatattttagagcaactttcatatcaaaagtttttgtacgaaatgtacagtt

SEQ ID NO: 18833 - DNA, 1501 bp, Oryza sativa
atttgttgaaaggtggtctaatagtatagattgtaaggcctagctgttagtgatagaggtggtgtggaaataaacaccaccactacttatattttaagtagtatatagatcaatatatcaatatttccttttccatgaaatcaatatattttactttatattgaaaacactatagggtttgaccatgttttgcaccactaaacacgtcattacatcagtttgagtatcttacaactttttacactatactaaattaaacctatctcatcacaagttcataaaccactaattaatgcaatttactttctaaattaaatcccccaaattgcgtgcctctaatcgaacaaacctaaccatgatctgatccaatattattagttcaatccagtttgccaagatgacacagctagcgaacacacaccaactctacaatatgtgttttgagatttacaatgttcagatgctctgcaatatttttaggccagatgccagtgttgtctgcattatgtcccaaagtttccttttcttctactcacctttcatcacttcttttctactactgctattagattttttttcccctccaaatccctgggtcccacaacggatgacacgttagtcaagtggcatttgtctgaagctaaggtacacttgcacaagaaatgcagccattatttcttggccacattaagaggacttaattagatcgtcgtttaagtttaacctcggcgtcatggacgaaatcaaggaaatgcgtaaggacatgaaatgctacaaaagaggtggttgggaataccctctcaaaggttgcaacaacaagcccccatttttatataaagcctgcaagcctgtgcctgcctgcctgcctgctcttgttcttgatagatggggcattggatcacgttctgtttagcattagaattaatagccttgaccagaccagagttgggttaattttttttttctgtcatggtgatgtaatgtgtgtgtgtgtgtgtgtgtgtgtgtatatgcctcagctcagctggatgaagattaaattggacaagaatttgttttgtgtcattttttttttggcatccattgatttatgaatgtgtttcagtcttgacaccttggcaaattcgacaagttttaggtgaaaattgacgtgcacagtactataagcatatagttgcaggcttgcggcagatttttgtgtggctaagcatttctttccagtttgatggccgaaaaattcagttaggaaatacaaactgaatttttgatagacacgtcatggatactgtttgtgaattggacccgaccaaattctggttccgcacaagtggtcaagcctagcttttagatcaaagaatttgaagtacaagatttcgtacagtagaaagtacaccactactctttgagattcataaatagtatttgacatttcgggcaggattcgatcaaattttcaaattttctattaaaataagtttataaaatctaataagttcatgat

SEQ ID NO: 18834 - DNA, 1501 bp, Oryza sativa
tcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagattggattcaaggaggacatccacacatacaagagtcagatgaggagcaagagagataccgaggcgaagattgcagatcttgagtacagggtatcgagctacgagctcagcatgcaagaggaggtggcccggaaggtggatgaacgcatggcagcatatcggtcacacgatccccagccgtacatacctcctccaatggtcagcccatcaggcaatcgtagcagctgcgcctcaatggggtaggtaggatcatatagcatggacgtcatgcaaacccaggacgaaaccacctgccccattgatgagatcacgcaacggacaccatgtgagctgcatattcccttcaagaacttatcaatcaaggtatgctcgatataatatatgatttttgacttgtacgttccgcaagttgctgcttaggttgattactaatagataacctctcatcacgtgaaggtggcatcggtaaaggacatcccaacggacatttcagggacttaccactgtaggccgattccagcaggatactcgagggtcgaagttgagctggtggaagccgtgtacgaggacctcgagttggactacttaggaggagatggtgagacgcatctacgagacacaagccacgtccggttcatcatcctccctgggcgacaagcggcgtctcgtgcaccatctcctctggctccgccgtctcctcctgcaccatctcctccagttccttcgccacgtcctcctgcaccatctcctccggctcctccgccacctcctcctgcaccatctcctccggctcctccgcctcctccgcctcctccacctccacctccaccgtgtccgcctgcacctcccaagacaaggtctcaccaagctccacctcctgccagcacaagggcaacgaagaaggccaaagttgacaccaccaaaaacaaggagccgccatacgattgtagtcaagaggagcttgacccttatgtggcaggagaagtgaagaggcaactcaagcctcggactcctgaaaagaagatacctattgacccgagcatgaagaatttcttcaagggaatatccaccacaaacaagaaggccttaaagctatcggacta

SEQ ID NO: 18835 - DNA, 1501 bp, Oryza sativa
tatatatttaggaacagaaaataatactagtagtacattcctaagagcaagtttaatagtatagccaactgctagctccaatttatctatagccaatataatagttcattcatacaatagttatataatacactattagtatctagtcccacctatcatacacacactgtgtcttggagtatgtgctacacatggctataaatctgtagcccaccgctcctctctctctcctcatttatattcttaaaatatgtttgcagttatagcctgctaatgtacctgctctaagtccaagtcattattactccgcgagatagatagctgtggtagactggtagctcgtacggctacacgacacgcaacaaactgtactgcctcacacaggagtatggccctctccagcgctattaactgcggtgggttccattaatgtgaacaagtgtgtttgaaactttgaaccgaacgatcaccaccatgcataacacgataactatgcaggagtagttttttttaaaaaaaaatcaaaagaaataaaaacataacaagatattgacgtattgtgtccaagtttgctgaaggagtgaaataattgagggggctagcaaaaaagactgtcaagctactgctttgatcatctcacattcccaccacatttcggtaggagtcgagggtacgtctaatacacgaatgttcgcgtaaaagtcatactaatgctagacacgtgcttctgcataatgaggataatctccggtaatatcgatagaaacgtcatactatattgtacttgttgtttaagaaaaaaagaggataatttgcggtaatagctaatgtaaagctcaatacaacaggttgatatatactccctccatcttttaatatttgaagttggttagttttttctgaagtactaataaacgtagaaaagaaagaacatgggggcagaattaggatcaattttagccattttgttcagttgtgtggactctccggatcaaataatactagtacgtcgaatcgcaacagtaaagaaaaaaactgtctatatatggtgcaccagctgggtatagctgccgcggcagcaagccagcaacagcaacaaatttaggagtacttacttatgttgccgtcgtaactagcactaatgacgatacaacaatttacggcaattcactatggcattgagatttaggccgagtttagtttcaaacttttccttcagattttcaacttttccatcacattaaaatttttgtatacacaaactttaaatttttctatcacatcattccaatttaacgtgaattaaacacactcttattttacttatgacatgttatcctctacaataaatacagagaatttatgtaggctcgatccgtgtgactctggattgtgggtccacgtgtgcgttgcagttagagcaaattcaggagaatagcccactactagctctaattcacatatagccaatacaatagccaatttatacagtagttactta

SEQ ID NO: 18836 - DNA, 993 bp, Oryza sativa
atcctgtaatacatataacaagtttagctattgatatatatgtaatgaactccgcaattgccatttaggatataaatcattgaaaagtaaatatgaaaatactaacagttgctcacttctatcagtgaccttggagctttacataactgaacttgtcgtccaactcaacaaattaaaagttaaaagttagttttaaaaatcatcatcataacaaattaagatttatagtaaaagaataattagagccttgtgtaaagtttttgtgccataataaagctttggagtcgcaacacaaagttgaacgctttactataagaaaaaaagagtttaacgggttatcttcttaatgttactttgttcacatagaaacattttttatgtcatctcttcaactccaataagaaggactaacttgattaacatataacatatcccacaacaaaccaacaaaacaaattgcctaattattctttactacagttttcttgattggtcgtctcattattcatataggtcatagtcagtatgtgtggatcatgaaaaataacgattgtaaatgtttggatacattatcaagaccaataattagactcagaaaattaaagtttctatatgactgtccttaaaaatgaacttttatagtggcagatgctgagacatgtgattgtttaatgcttaacctaacaaccagtgaatgtaatattgtcaagccacacctaccataccttttgtggcgtgttatttgggagttttttttctgttttggggttcatttacacaccgtgggaaggtggtcttgctgcttttgaactagtcgaggatagatgatgaacacttctactaacttggtgagctaatcttcttcagataatggaagagaatgatttttgggtcatggataaggatttatttggatgaagagttcactcatattgtctaattgcattgtatttgatatgtttcattaagctccttcgacgcctcctttccagg

SEQ ID NO: 18837 - DNA, 1501 bp, Oryza sativa
agctaccagtctaccacagctatctatctcgcggagtaataatgacttggacttagagcaggtacattagcaggctataactgcaaacatattttaagaatataaatgaggagagagagaggagcggtgggctacagatttatagccatgtgtagcacatactccaagacacagtgtgtgtatgataggtgggactagatactaatagtgtattatataactattgtatgaatgaactattatattggctatagataaattggagctagcagttggctatactattaaacttgctcttaggaatgtactactagtattattttctgttcctaaatatatacatcttgattgtttaacaaaaatggtactactacattggttgacaaatcaaaatattttttattacctcattggttagattttaaattgtttgtactcttctgattgatccatttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgag

SEQ ID NO: 18838 - DNA, 1501 bp, Oryza sativa
tacaaacactaatacattgattattcaaagataaacttatttttttaaaaaaagtaaaaataatcatataaacttattttaagaacaaaaaagggtaaaaatgatcatgttttagtaataggatgaatatatatagcatttggaaatcgagaaaatattaaagacgccaaataataagaacggagtgattaatctcgctaagagcaagtacaatacacttttttaaaaaaaaattatttttgtcctctttcaaaataaacctaattttaagtaattattgtattggagtttataaatttgggaacaaatatattagaaatagataaaatgaaaacaattattctaggatttgataaaattaagatattatactctctttttttttcttttatactgatatactactagttcgtgggatgggcaaataaataaataaaattatttaggaaccgacgtactgcccactagaaccaattgttgccgctgttgtgcctagctgcactctgtctgcatcagccaccaacccctcattggcatcagagatcagattcagagtcacacagtatttgtactcgccatcaggcccatcaacagcaccatgccagattgttaattactcacgcacgaattcctaggccatatactagtacacatctccaagcccgtgatggccaagcagacagcagattaagaaacagagaactcatctgatttgtgggtttggttggtagtaagttgttggttagggcctccctgacagacagcgttccaatcagtttggtgatcacatttttttctcatcagagcttttggttttgcaaccaatggcccctcttggcgatacagcatctgatgcttaatcttctttaataaatgatccttcctcattgtggttcaacacgcactgtaacaactgtagtgttatttgacattttcatccctaacctagttagtatttttgtaaatatttctcaatatctgcaatatattcgcccttgtgaatatgtccatcagagttgagacctcctaacttcccctttgaaacacaggcgttttacaaacagtttatacttcgtaagtgatataaatcttttctatgattgcgaaaagtaaaccagatatggctcgaaaaatggttgccatttttttgaatgatactttttcctaaatcatagagaatattaagggtataactgcaaacacaaaaaaatgtaggaaagtgccccactaaggccaagagcccaccaaaaaatttttttcttcaatttgcaacctgcactaccaaccttttctgcatcttgcttatatttttgccaaaaaaaaagaaaaaaaaaagagagaaaggagccaccaaacccagaacccgcagagaaaagaagagagagagagagagatcagaggagagagagagacagacagagtgcggcgccgaggaggagaggagcaataatccaattccaatccattcctccgcgacctcgtcgtccgatcatggccatgg

SEQ ID NO: 18839 - DNA, 1501 bp, Oryza sativa
  unsure (1)..(1501): unsure at all n locations
tttatctcaactcctgaaataggaatctccatgtcagtgttttgtcgtccatttcaacgacccgttaacaggaggcttgcatttaaccctatcaatcctgctactccaatagatcaacattttgtctcctcatcagatggcccaacagtgccaggtgttcagtcccttcctgcagtgcgcggtaaaggtaagcccctctattaagaattaatctctatttgattgtgctcaagcttgctatactaccattgtatcattttagattcataaatgccagttcaggtacctgtgcnccatagtgacatatttgttccctttgtgtctgctcatataaaatttggatgcttctcacattggcataggtcctttggataatattggtttgagactgcctcgaccagatccatctattgctacggaagcacgcaagaagcgtaaagtcacaatggttttaaggagaggacataagttacccatatccaatattttctccttcaactaactggcttatttgttgcttccattggttcctacatttctatttgatttcgttcagcaagtgctgattcgaccaatctatagctcctcaatttgtgattgttacattaggagctggacctgatgatttctcatcttcatatcgatgtgttcaacgatgtatttccccacaagttaatgccaggcattgtgatgtgcggatagccaggaataatgggatgagtactactattggcgcttctccttcatctcacattgcccaaaatgacacctccttgcatagggtgaatacatgtcaacgaagccgtgtagggcggtccagagctgatggtaccttatttagtttgctatgatttttccttatttttacctgtttgggaatatgtgattacatttggcattttctgctttctaggaaattttgtaccccttcttgccagtcgacatcgccgtaagttcttttcttgcacatgctttgatgcactaaatttatacataacatctgcatgctcaagacttataggggtgttcccttattattaccagctgatcatgatgctgctcgatattcaggctcaacctccacagttcatgttccgaagtaatttttgctgctcaacactaatgttctatctcgatgatcgtaaagcttctcgacaataatactccacccaatgatcttttttctatggtgaaaccacttaaccatgttctaatttatattatatcatccttttacaagattttccattctaatttttctcttattcctttctattaggtactattttcacacctctcaatttaggaggccctacccatacttgccaacattgtggtgctcgattctggtatgaggaacgcgtacgtgggtgtggacgaacagctttgcaaatttacaacaaatgctgtagaggagggagcatttatttgcctccatataggccaccaccagaacctttgctctctcgtttaactggacgagatcgtgttttgtccaacc

SEQ ID NO: 18840 - DNA, 1501 bp, Oryza sativa
agaaaaacatcgaggtgagattaattcaaaaggtggttcacggcaaaaaactgtgaaacatgtaaaacttcaccaaaaaaaaaaagattctccataatgagttgataagatcttacattgcttgtccttttcaattagacatgttgacatggcagtaggaaaaaaaacatttacatttattttgaacagtgtatggtttgtcattcatttgggaagcacccgtttggccagttcttttcttttcctctccttttcatttcggtccttttctgctttggttggttcgcctcttatatccttttttttctttaattaatttcttaaagattataaaagctcaaatctatggtagaaaacagaatgcccgaactttaaacaaacaccaaatacactcattcgtcaacgatgtaatggccatcatagacgaattagcatttagcaaccagactattgacaatcccttcttctccttctccaccttcccattagccaacaaaaaattttaaacaaagtgaatgaaaacgagaatctttcttccatttctcaatttaaaaacaaaaacaataatttaatgacaggagaggtgaggttgggggtccacaaccccagagagtcgggagggcgagagatccgattcggtgcggggtaggcgacccacctacccattctagtaccctctctccctcccattttaaacgtagctataaattttcgtgtttaattttaatcgttcattttattttataactaataattttatatagttattagatgataaaatatgaatattactttaagtgtgactcataattctattaaataattttttaaatataacagacaattaaaattagacacgaaaactcatagctgcgttttttaaatggacagagggagtattctacagtacaacattttccttttataaaaaggagacgagacgagtcgctcgcctcgccgccaccttccccttccccccctccgccgcctcctccgccgcgaaacgaaaggcgagctctctctctctctctctccgcggcgcggtcaaaaccctagcgcgcgaggaggccccccccatggcgcagcagctctccgcccccttccgcgccgccgcggccgccggatcccgcgcctccgccgccgccgccgatcccgccaaggtatcgccctcccttccattcctcctgtgctccctctccctcaccttcttccccaccccccctccggaattttccggtttgttccgcgtcggggttcgattggcagagggttgggacgtcttcgttcgttgtgtgactagttgtgttgctgatactgcgcctagatttcgtcttaagcttggtttccgtgaatctgggaaccttgggttggggggggggggggcaaatgctggggttcgtttcttgtttatgtgcgttctccctggttgcttcgtactataatctgttcatttctgtgctggagtatggaggttacttttatacatactagtggagaatca

SEQ ID NO: 18841 - DNA, 1501 bp, Oryza sativa
cgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgacta

SEQ ID NO: 18842 - DNA, 1501 bp, Oryza sativa
cgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgactacgacgatttcagctaccactacga

SEQ ID NO: 18843 - DNA, 250 bp, Oryza sativa
tctacgactataattaatctataattaaattataattattttaaaatttctaaactattaacctccctattctatttccctttttccttttttctttcctttccttttctcttttcttttctttccttttctcttttctctccctctctttcttcttctctctttcttcttttctctctttctctccctcccggcttcttctcccttctctctctcggctctctggcgacggcggccgaacaagggaagg

SEQ ID NO: 18844 - DNA, 1501 bp, Oryza sativa
tgaaaatcttggttgtcataacaactgtctccattccaaaacataataacttatagcaatgaatctaaatgacaaatctataaaagtgtttatacatatttgtagttagaagtattgcatttaaggacgaagagagtactgtatatgtatgtaccactatttatatggtatgatcagggttgaaaataattcctcaattcacatcgcaatattcacatatactgattaagatgttaatatcagttctccacttctacctattaaagatgtgttcagtaatgcatatatcattctgatatgtaatatgtacagtacagtagtagtaatctctttgaaagaaatgtactccttggtaaggaatggcagttggaattttatactctcatctcatgtctcaagtctcaaccgaaagcctgaaccagggatggcatgcttgcatcaactgcagcagttgtcagggatggcctatgcaactgcctacccccagctggcaaaggatttgcagtagttggactgtaggagtaagtattcaagccttcaaaggacctcacctcatcacctgctgcccaaagacaagggatccaacaaaaaacacagagataggttgctagtgctagcccagccttgatcctaggcattcatcacgattcacacacaccagtactgccacatactgtaggtgtgcaacctctgtcgtctggctctgaccttggtcaaagaatcattggcattggcatagcatggcaaccaattcagatcctgtgcggtactgctcactgacatgtgggcccgagggtctgtggggcccacatgtcagtgaaggaccctcactccatggcaacctatctgctttttattttctgtctatctgcagcagagacactgctcagctctggattttttttttacattttagccatttttgaaaggttattttacaattatacatatataaaaaacttattctagagattgaccctttttctcggagctagaatcattgacgccaagattcaatgtcttggcaccaatgacactagcactgacaccctcgaccccttggtagctaagtcgttgatgtgaagggggtcgacgcttatattttgaccctttcataaaaaaatattttactaataggttcttgccactggtctatttagtgccgaccgctccacaccttggctgctaggggcaagggtattggcgctcagatgttagaccttggtgccgaggttactggcgctgagaaaaaagaccattcttggtgtaaacttgtctaaagatctatttatcccttgtgtattgtactactccatattgtactccacaatgattcttgtgtattgtactactccatattgtactccacaatgattcttgaaggctactttgatgggaatggccaggtttacttatggtttgttcagatttcaagaccattgcaggtaagcggcggagctaggaaatttttagagtccgaacaaatctaactacacagagc

SEQ ID NO: 18845 - DNA, 1501 bp, Oryza sativa
gatcaaggtggagtcgaaggcggagattgatctgagaacagagtaagaatcggctgaaatccagatcggctacgattaggatcagctgggtctgagtcggactaggtgagctgatgcggccgattctgacagtatgatttggtgtatgatattgggttgaattgaggtgcttcaagatgattgccgcacatggatagagtcctgagaaggcaattgtatctattaattatgctgttttatgtaacttccttagagatatgtttgggcaaaagtctagagtttgttagagatagtggtcgtgtccggtatggacatatcttgtaattctcgggtataaatagaccccgagccctatgtaatttaaaaaaagaacacacacgttcaatacaatttcggcgcatcgccacctttttgctttagttttgtttcgacgagttcttgctttcgggttaagctgcatcggtttcgatcttcaacaagaggtaaaacttgttatgacgacttacgttctcgagattagtgattctatctttatgacactctaatcttgtctatataattcgtcaagttatcatatatcctacataatctttggcaatatcatcatctaacctacaatcggctaacatctgttaatagaagacagccgattaggttaaatagcgatgttgttctagattatataagatatctaccactttatgaaaacccagcggcttgattgtctagatattgttcttcttttcatacttaatactgcatcagttgagtttgatctattaagtcgtgcttagaatatcaatctctagcctgtcctctggttgccgattagggtagtatcggagtttcagccgatcttatctgatttaaccatattcgatctatatgcttcaatgacatgttaaatccgccctttatgtcaggatcttattgcatttaagtatattaagcttttgtttggtatattatatttgttttaatatctttatataaagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttaatatctatttataaccgccgatcgattcatatatgacatcggctcaaagataaatgatatgtcatcagcaccttaccgatcgactatcatttatagatttaaccacgaattctttgtctctatttcttgttgattacaggatcaaatcaactggcacgctcatacattcgaaggcgagctttggacctgcactggagttaagcagatctcccaggcctcgtgttttctgtcaacacgcttttggcacgcctggtgggaccaattagaagtcagcaagcaattcttcctca

SEQ ID NO: 18846 - DNA, 1501 bp, Oryza sativa
atatctctaagagttcgatcaagtgcttcaaaacagtgcttatggtttacaggtgcctcatcccatgtgattagtgatgttctttctatgagctcagcgacatgtgtatttttcttaatagcacacatggaatactcttgaatatctataggaattctaaaccgtgagtgtggtgttcgaccacctggcaacaacaaagctgctataccagaagatgcaactgctaaggctatctttccacgacttcttatattattgagaagtgcattccacagaaatgttttgccggtaccaccatatccatatacaaagaaagtgtgacctgaaccattcagaactgagtgttctatggcatcataaatagatctctgacttgagtttattgttaagttgctcatttgcttctactaaagtagcatcaaggtcataagagagctcatccactaccaacctgttgttcaaaacattgtaatcatggtgttctggctctggcaagttgaagtgacctaggctatatccagaatctttgagtaatttgtctaattcatccaagacatatgacctaatgtgttgctgcactaatggttgagagataccttgtgtgggccgaatagtacgatatgccaaatcttctcccattggcttgatataatcttcaagcaattttattgggtcggtgactgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagtaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacaacaatttcacaagcagtagtcaaacaaaactacgctaggaatcacctcacatccgcccatgaccgtgggcacggctgttcgagcagtttgttaacctctgcagagggggtacactttacccaca

SEQ ID NO: 18847 - DNA, 1501 bp, Oryza sativa
atgcagtccatatggtagcgcgaggtcggcggttgaggatggcatgaggagagagaacctccatatttggcttgggaagggcttggtttggaggtcctccaaaaatggcgtgtgtgatggaaggtctgctggagcgttgtttttcacctccgtgcgccaaaaacgggatggaggaccggatagaggagctgctggggatgctcttagtttttcttattatctatatttaatgctccatatatatatatccaaaaattcgttgtgatgtttttggaactaaataggccccaaaggtgccttgtcaccaaaatacaaaatcgtccgtcaaccgtaaaaccgatacaacgcatcctcaacttaaaaaaacagtgcaaatgagtccctcggcagtattgtgtaaggttttggctgacgtagcgcttacgtggctcttttgactaagaaaattgacaatataccatcgtcaaaacggggtttcgctaaaatatcactctgcggttaggattcgccagaataccactcacaacaagggggcttcatcccaaatatcattctctttcaattatctctttcctctcatctttgccgaccaaaatacccctagttgaaataattcaagtaaatcaactatgtattttacagagtacatatcgtccaaatatcttgacatgtaatatatttttcctctacaccagattatagagtatataacacaatatctccacaacataaataaaaagaacttttatatcactagaaaccaagagtttccggttgagagtgttttttatattgtggtgatagtatgctgcatactatgtaatctggtgtggagaaaaattgcatgtaaaattatttcgacggtatttactttgtaatctacgtattttttatgtgcttaaattgatttaaataggtcaacaaagatgcgaggaaagggagaatcaaaagaaaatggtatttcggcgaagcccctcaattgagagtggtatttcggcgaatcccaactgcgaagtggcattttagcgaaaccccgttttaacaatggtataatgtcaattttctccttttgattaggtctttgtcccatgtggtattgacgtggcgcatacatgggaattcaatcaaaaaaaaaattaaaacatgggcccacatgccagttacattagaaaataaaaaaatgatgggccccatgtggggcccacatgtcatcctcctctactttctccttcctccttcctcttctttctcctcaccacacagcaccgggtggagcgagcgagcgagctcgccagccacccctctcaccggcccagcctcctccctctccgtcgctcgccgccagcctccccgcctccctcgctggccccacctcctccctctctgtgagcgctcactgccggcttcccccactccctcgacgaccacgccttctccctctccgtttcttgccaccggcctccccgccctctcgttggctcacctcctcctctcccaccca

SEQ ID NO: 18848 - DNA, 1501 bp, Oryza sativa
ggcgcgccgttggagcggcgcaatccggcgacggaggtaatcgccgtacaccatggccccggtgagcccttgggatcgcaggcccgccaggcggtcgaggacggcgtcgtactcctcccccagatctaccggcgcccgccagctggagacctgcgccgggggctggcttggaagtcggagacgcgcttcgtcggcaaggggggtgtagaaccagtcgctcttccagtcgtcccaattcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaagggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgtgtgtggcgaaggtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacttcgctccctcgtatctcgctatctcgctccctagtttcccgtgcccacgcttccactaatcccattcgcccgcttacggcgcatgaagtggatatgcggttgtggcaatcgaaacggattgtatcgtgcgcgcgttaattacgctcgccgaccgaagcggcgttaccgtatctccgagcgagacaaatctgctcgcccagattcgcgcgctgctcaagtggtgtggcagtcttgaatagaccgcccattatggaccaccaaagttaccagtaccaaggtgcatggattgagactgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtcgggttgcgcttgccccggccccgagggccggggcaccccgaccccttaaagaagtct

SEQ ID NO: 18849 - DNA, 1501 bp, Oryza sativa
  unsure (1)..(1501): unsure at all n locations
aaatcggctgcctccttgacaatatctctgcatttatcatcatcgaaccatccaaattttgtaattcgacagacaagctgaattagggatttaatcacaaacgtctgcagtttaggtcccctcgtagcaagatagtttatgacataattcccttcaaacagatcacaatatattgatttaaaattagcagtagacaagggcacaaaagtacacaaaatagatttaagcattgtttatacacatgtatttttgcaatttagctacattaacaatgcataaaacaacaatgaataaatggaaataaatatttggccattctaatctgctgcaaaggcataaatgaagtcaggaatagaatgtaaaatatttgtccattcaactcgagccatattcaataagcataagacatcaaaggcaacagaaataagttaaggaaggaacaacaaagattaaaatatggccacttatactagatggcactacaaacgagtgcttactgctttctgtagtaacttgcaacgcagaactaatcataactgattaaattggtagagacgtaaatgaaaacatgccatgcagatgcaatagaaaagcaaaaatagctgaataactgatttcatgatagatttttggaaaggaacattacggatatcaaggcgcaattgcaatgaaagactgcggtcgttgacttggttcaacaagcttgaactggccagcatcagggcatatggtgttgaggcattgtccaatatatattggcactgtgaaatgtagtcactgttctccgagaagcacttgaggatgctttcagcgtgtgctcgctcagcagagtctctagaattgtaaagcttttcacacaacagctctaactgtgctaggctctccattgatgacatgaataaggagctccaattttccagttgaccaagtatccaatgttaatatgccaccaggttctggattaatatccacgaatttgcatgaatgtttgtcacaagcttagagttaatgcactaggtattcggttcaacaggaaacttgaaaagtaccataagagctttgaagctgaaatatatgattctagcacaggagaaggatagtcacaaactcaatacattcatattacaagagaaatgtttcaacaaaagagttttctcatgtacagtcttttcaatgacgcgtaatcaaagatgaagaccaaagacacaagagaaaacagctaacaagcttatatcgccaataccagccacaactcagcctgggtagagttatctgcaagagtggaaatgccaaactcagtgacagctaaagcagcacaatggcagaataatcatctaagaaganctttatgtcnccattgactaancatttctanttnataacacanctaaatatactacacaaacatatccatttagccgtgttatgaactagaaatgcttagtcagtgccaacataaagttcttcttagatgattattccgccatataatgatttataa

SEQ ID NO: 18850 - DNA, 1501 bp, Oryza sativa
gccaatgcgaggttatcaaaaggctttgccgtgacgcgtctcatgtgttgggacgaggctcatgtgttgggcagtcgcggagtgcgggtaaagtgtacatccactgcagtgtgagtaaaccaaatctattcgaatagtcatgctcgcggttattgagcaccgggacatgtattacacttggctagactctaaattcttaacttgtgtggaatgggatattgcatgatgatttctatgctgatggagccacttcctgagaggcgggaaggtggacgtcctcagaaaaccatgacgactcaatggcgggaagctatccttgggatcacaatggatggtggacagaaccgtcattgtataatatgaacactggtactaaaatttgatcagtctgtgctaggtcttaggcttgtgaaaagaattacaaaacttgctttgcgcaaaagaaccatagccatcctttgaatacccttgtcatatgcattgttgttgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcctgtggcaatggcgtgccgctgccttaactccgctgccttacctacttctgtttttggaatgtattccggaccgctcggtccgatgatttaagactatgcttgcgggcttatgatgtaataattcgtactagacactcgtgtatgtgcacttagtatttcagctatgaattcgtgtgtaccagactacttgatccagggaaatggtactgtttacatgattgattcctgttataaaaacgggggtccacaccctatttatgtcaggatcattcaatcggttatgtcatatgagttttgctgaaaagaggttaatatcttgtgccgtactgcaccattcagttgttcttgccagatcaagctgcctctccattgctattcaatgctcatgaaattctttagtacaccgggtgtgtttagatcacatcaaaattgaaagtttgattgaaattagaacgatgtgacggaaaagttgaaagtttgtgtgtataggaaagttttgatgtgatagaaaagttggaagtttaaaaaaatagtttggatctaaacaaggcccaataaacttgcatgctatcaggtcaataacctaataactctaaataaaataaagcaatcagtatatatcactagactatcctgcaaaaaaaaaacaataatctgcagtgcaaaaaaaactaactcaagaccatgctgcgtctgctgccaagcccagtgactcggtttttgcagtgcagcacctcagcgcaaatcaagtactaactgcttttgtatatagggttcgcgatgttgatcagttggagttttcgagcgtaccaaggggagggtggtgactagagatcgaggagaacaggtggagatcgatca

SEQ ID NO: 18851 - DNA, 181 bp, Oryza sativa
gtccaccccctcgccgagtccgccgaccgccggaacgccgtcgaccccgtcaacccgagccgcgccgccgcctccctccgctccggccgcctttttcgtcgtcgccgtcgacctagggtgagccgtggaccaccgcctcttttcccccttcccttctcctctctcggccgccgctccgcca

SEQ ID NO: 18852 - DNA, 1170 bp, Oryza sativa
ctgtagcaccatattgtcaaatcagggcgcaattaggcttcaaagattcgtcacgcaatttcctggcgaattgtgtaattaattctttttgtctacgtttaatactatatgcatgtattcaaacattcgatgtgatagcatgaaaaatttatttcggaactaaacaggccagtattatcgccagtattgagtacttgctcggctcggctcacgagccgacggctgggctcactgagcgagccagagcaatccggctcagataaaagcgaaaccctccctcccctctccaagcggaaacctaccccctcttcttcctccgcttctctctctctctctctctctctctctttctctctcctcaaccgtgcggctgcctcctcctcgtcgctgggcatggatgtgcacccgccgaatgcggccgcctcctcgctggaggagttgttcccgcaccagcccgccacggtcagtgctccgggcctcctagctttgttgcttccccctttctttccccccttcttgctgttgctgtgtgtgtgtatgtgtgctttggtataagtttttttttcttgccaagaaccgggcgtggttgggttgctcttccgtggggaggaggaattggggaggaagatggtttctttttcttggggagtattggatgttttctttggggattttctttttttcttctttctaaattggggatttcttgggagtttttgtgttgggggttttgggggtttttggtacaagaatttggtgcggttgtggtggcctattctctagtttcttgatattattgttctaggacctagggtttgggtttttttttcctttcacttgtgttctttaccgtttagatgaattttctccactattatgtttgcatagaagaaaatgggggattttcctttgtttcttgaactatcttaccttcctattcatgcgtgctgcatttcctcgcccttttcttcaccttttcctacctataaattggaaagaatttttttggttcatagagaaacaaatatatttacagttgttgagcaattcattcagccgcacacttttttccagcagagcttcatagggaaaataaacaagactatgttcatgccaatcttgcatcttgtttttggcttagttgtgaggtcacagggaagaaatgcatgt

SEQ ID NO: 18853 - DNA, 1501 bp, Oryza sativa
  unsure (1)..(1501): unsure at all n locations
cgcgcggcctcgactacttctccgcctcctcatttcctcccaccgaaagaaaagcttagggttcggccgctgctgctcatcgccgcctcatcctccgccgccgggcgtcggcgccggctcccctccatcgccggctccctccgtcgccccccctcagatccgtcggctgcccgccttctcttccactgtgaagtcctcgttctctccgttgagcccatcttcttcgtcggttttcttcctcacgccctctcctcttcggttctctccgtcgagctctccggtaagtgcaaggatggtatgccgccgcccattgtagggttgggaatcctctcccctttcctacccccttcaattttgtgtccactctttctttgatttctgtttttctttgtggatgagagcacatgtccccttcataaacaaacctagatctactaaaatgtgatggattttaggttgatttgggtgcaacaaagtgctgcataggcttggattttgctatatatttttgccatgttatgcactgttggtctattttctagatgttgctaagcatgactaaaaatatatttcttggtcgatctacttatctttcagttttgtacacatgaatatttgttaaatcgattgcctcgtagctcagatctgcactggttgtttgtgatgtgctcattcaagttagatctgtgaccctgttagttgtgcatattactgtgccccttttgttatgtctgagcaaatttccttggatgtggcagccgtggcatgggtgcataaatattggatttgcaatagttaatatgccaccaggttttggattaatgcccacgaatttgcatgaatgtttgtcgcaagcttagagttaatgcactaggtattctgttcatcatgaaacttataaatcattatatggcggaataatcatctaagaagaactttatgttggcactgactaagcatttctagttcataacacggctaaatggatatgtttgtgtagtatatttagntgtgttatnaantagaaatgnttagtcaatggngacataaagntcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttatggtacttttcaagtttcctgttgaaccgaatacctagtgcattaactctaagcttgtgacaaacattcatgcaaattcgtggatattaatccagaacctggtggcatattaacattggatacttggtcaactggaaaattggagctccttattca

SEQ ID NO: 18854 - DNA, 938 bp, Oryza sativa
tgcaagaacacgcatggcggcatgggtgagtttcttcagacaagtacaggattgagcttctcggccaccatgatttatgatttacagagctttaattgtcagtaaaattgcaagcatgaatatggcagaagagggccaaccatgtgcaaccaaaaaaggctccaacatgataaaagaacagcagaaaggtagcctggactagaccttcctttcctttgctttaacttttgagtggacaggaagactacaagcacagctgcatcattgttcgtcatctccagccatggaaattgtctcagtgtgcaagagtagagcctgcagagagatttctgaattgaagacaactttgtggtctgaaaaaatctgaaatctgcagggcattgattcatgcagtctatctgatctactgttgagcagaatttgctaccaggaaaacaatcagttatgattttgttgcatttgctaagattttgttgtcataagatcagatattaggtggactataacagttattaatcaagatatttaccatgtagcttgcaattttcaggtgattggcctgaattttagcacactaacaggaaacatgaaccctaaatctatctggggctcatggcatgtccaaggagatacgatttgcggttttgcaccccaccaacaaaaccacacaatgagaagctctcattccacttcagaaaagaatgacaaatactactataatgagaattatgaacatatggagaagaggccaaaaggggcatggctgaagtatgtgcaaagatcatagatggtgcaggatataatctaagaggcttgctctcattccatcttgcagacacattcagcaagtatcacagaacatagtctaagaggctgctctgaattctgatttccatcttgcaaacatattcagcgagtatcacagaacaagcatgctg

SEQ ID NO: 18855 - DNA, 178 bp, Oryza sativa
aaaactatgatttatgtgttgctttgatttgaatgctcttccttagaaaagcatgctcaatagtttgttttactttttggtttcacaacctgaagttatgacatgtatgcatcaacaaataagaaatatatagaacagtttatgctttaaacgtttccgtttttatctgaagtcatta

SEQ ID NO: 18856 - DNA, 1179 bp, Oryza sativa
aggctcaaaaaattcgtctcgcggtttccaggcaagttatgaaattatttttttttcatttgtgtccgaaaaaaccttccgacatccggtcaaacatccgatgtgacacccaaaaattttctttttgcgaactaaccaagccctcaatgtaaacttaagcactctgcatcgatcaaaactcaagcaacacactcttcattcctttctacctccacctatggtaggggcgtagggcgattgacttcacttgtacgaagtcgtgagagatagatctcatcactgcatgcaccatcttcgtctcggtcgccggccggcccacttcattcaatgaacacacgcggctggccgttcgatatatccattgattgatcgtactcgatagctagccgccggtgccctgtggccacggtgacaatgcacgcgtgatatcgctgtgcagtccaaagcctaagctaggtacatgcccgtgaatggcgactagctagctcggccacagtgtactcagtacagctgcctctctacggtgtacacagtacgtaccgtagtgctgcacgcaatgcatcctagctagctattcactcattttaaaatatactctctctccattttatattattactcgttttgatttttttttctagtcaattttttttatgtttgaccaaatttatagataaatttagcaaaatctacagcaacaaattaattttattaaatctatcgttcaatatattttgacaatatgtttcttctgtgttcgaaatgttgttatatttttatataaatttgatcaaacttttaaaataatttaactatagaaaaaaatcaaaatgacttataatatgaaacggatgaagtagcaaactagtaaatctggatggatcattataaaaattcgtagcattaaaatatattttataactactatccggccatgacctatgcacagcgtggatggtgttctttcctcattaatatatattttacctcgatttctgttaccatattttttaaactgctaaataatatatcttataagaaaaaaaattaaatgaaagttgatttaaaatatcaaataaatctattattttaactttgtaataattaaaacgtctacggccggcagaggagaatagaaataatgcagtgagggtgacgagagcttttgtcaaggccaga

SEQ ID NO: 18857 - DNA, 1501 bp, Oryza sativa
tttttagttgaaacatcttatttttatatagatattgttaatcaaagtagaatctcgaagactgtgacgaagtccaaaaatactggtattttgagacggatggattatttatttcctcttacatggggctccgccatcaccttccctctgtataggagtagtattttttttccgtagttttttttaaccttagcactttagcggtctttctgtttcctttctcttttttccttgttcccaagaaatggccatttggctggttgtgttgtgtaacaaaaactatgatttcttctaatacatcgaaattcaatctttttacacgttcgcagaaaaacaatttcctcttacatattagaaactatcacaggcacgcttcctaaacttataaacggtgtgaatatctaagaataatattaaaacaactttaattttcaactttgtactagaaaattcattcatttgtacccttaaaacattattacaaaatcagataacgtatcatttactatataatcagacaaaaagaatagttgcagagaccatcgtggctccatatcatcatataattaaagtcataagtacaaaatacggactttaaacaataaagtactccaatttcgtcatgcccaaaataaatcatggcaaaataatacggtttaccgtttatgtgacaagttgacggatgtaggaagccggtttatttttttgctgaatggctcaatagctaaatgatttttggactcgaaagtacaaacaaataaattaattattataaagttgaaaagtaaatttaaaacatattttaagacattcacatatactatagagttttatgaaaatcacagagagctgcaggtgaatgcaatccttccattctttagaaaagaagatacctttaccttataacggttccttgaaagcacatcaagtagtattaaagtaaatttattcgttgaaaggcacagaataaaattgaatccggcatgcatgtcggaatctttagtttgggttcgttttctaataaaaactagtaaatggaaaataaattgaatttcataataaggcactgcctactcctacctagctaacatttgataaaatattcttaaaaatctattaaacctaattatggcataattatgttgtaattataatataacaagcatatgccattacaatagatttcctcgattttctcttaatttttctagcgaatgttttttttttgcggggaatttttctagcgaatgttatgtaacaaattaatccgattgtaaattaatatatgcagtctgcagaatgaccaccatcaccgtcagtgttaatctctggcaacaaactgctcttggtcaaggatgcagacgccgggacagtagccgtacagctgcccagctctcgatcaacttggttttccatcaaaattaaaagtttggttaaaattaaaacgatgtgatggaaaaattaaaagttgatgtatgtagaaaagttttaatgtgataaa

SEQ ID NO: 18858 - DNA, 1501 bp, Oryza sativa
aataaaaaaactaattacagtatccgtcagtaaaccgcgagacgaatttattaagcctaataatatgttattagtaaatatttactgtagcaccacattatcaaatcatggaacaattaggcttaaaagattcgtttcgcaaattagtcgcaatctgtccaattagtttttttagcctatatttaatacttcatacatacaggtgtttaaacgttcgatgtgacggggaaaaatttttgggtgggaattaaacagggcctaaactaaatggtgatcaattaatcgatcgagagccagtacttcagaattaaatgtaggcttgatcaatgcagagattaattaaccttacgattgcctgtccattcctgactgatatctgcattattcagtgtggtggccagcaaaagcaagagatcagataaaaccatgcattgttatatgtctcctttaattttcagatctcattctgtcagaggttgcatagattgggcgttcggatgcatttgctgctggaaagttggcataaattgggctggaatttgagcgtctctgtaactgtagtctgtactgcaaattgcatgtgtgcaatctctgcttgcagtagtggagctacaggcatgaagggtggatatatgagacactggacccaaccgtcctttttttatcttcaaaatcattaattccttttggaggaccacaatttgttaacttttcttctggtgaaaagaaaaaaaaatcaaagctggtttttagaaggaaagataacaaaagcactagctagcaaatatctgacagggtttgcattatcatcggtccaacgggcaaccggacttaccattggggtgcagtaacgaaaaccgctcggtatcgaccgagttcaaaagaatttaaataatattttaaattccgataaaatttatttggtttttttatcggttttacttgataactggttactgcggttactgtcattattaccacataggaggggtaaccaccctctgccacgtaatataagcattaagcacgtgttttgattacctacatacagtgataatggttggcttgcacgcatggttgcaaggcccgtgtttggttgccctttgcccacattacctccaggcccaaggttccctgagccaaggcccgaggtgaacggccgatctgagcttctctccccatcctggctgagcgcgtaaagggcccaagcccaagcccaaaaaccttaccaggcccccaaaccaggaaaaaaattccggcccattaccacgtgggacccacagcccacagagctgtcagcgaagtgggccccaccggtcaggcgagcgccccccgctcctctgtttctgttcttgatggtgatgatgaagatgagcatacaaaagctgtgattttgaggccaccgtgcatcgcgccgccgccgacgacgacctcgacccactcacctcgactgcgacgcgtggcggcgggaggagaggagaggagagggatatggagggcg

SEQ ID NO: 18859 - DNA, 1501 bp, Oryza sativa
acaagcactgatcctagtccccagccatgaagttggaaaactcaatttccaattacacggcttggttaatacgcacggcgagaactcttacacgaccaggtcttacatggtctttcgtctctgaaggatccaacaaggccttatcggctctaggcgtccctagccgaagttccctcaggttcatcggaggccttgtcaagacggcgtaaagggacattaggataggtttcaacgttaggtgtcatctgggtaagggatctctgggtaaaacccttggcgatcttgtgcacctggtatcaactttgttgaagcaggggtagtgggagaaacaaacgtcgctggtcgaggaccagacagtagtcgtaactcgaccactgaaagtagaagtagtgggagaaacgctacatcgatggttgaggaccaggcagtagtcgtaactcgaccactgaaagtagaagtagtgggagaaacgctacatcgctagtcgaggaccaggcagtagtcgtaactcgaccacttaaagtgaggcgagagagatcactacattttgctggttcgagaaccaggagtaggagtctcttaatcacctataggggcgctaaagttggtttattacatgtgcatatcatgtggccagcatgactcacatacccaacttatagcatatccggatgtccgctcgcaatcatgtcgggtgatcaagccgacggtgttcgtgaggagttatccgttaacaaccttttctcgagtagtccagcgatggctagcgctatgagataggtcgtcggacttctttggtaggttgggcgcgacgactctgcatttgtcgagatcgttctcgataatgcggtgtactcgaccacaatatactcgagtgctcaattgttcctgaaaaatattttctagaagacaagatatatagcatgggatatcgagtatgtactcaaaaactgcatggatcttctagtattatcaggatataatgagcagatgtaaatgtcaggcattatgtaaaccgtaaacaagcatgatttatacagaagaaaatagagcgagccccctacgttagaccgtagtcgatttaacatcggggacactcgcgcaacagatattattgtataaagaacatgctctaggtaaacataataaatcatggatctgacaatgatgtatgatctgaataggtacgataaattgcagataaaatattgcgtacctttgtagatacatgccggatgtatttacgaaattagtagatcaatttgaaaaaccaatctaccaattatcttattgcgtactcgttggacatcatatgatctgacatcttttggtacgtcgcgtatattgaggcttggatgatctcgatagaccaagttgtcgatgacgatgatggttccgatctggttaggttggatctcagctggttgtcggagagttcatctcttaaacccatctcgtcgaaatcctgaagcaccaaaatccccctacctggcgcgccagt

SEQ ID NO: 18860 - DNA, 1007 bp, Oryza sativa
aaacatgtgctaaaaagtcaacggcgtcaaacatttcgaaacggagggagtatttgttttttttctttcaaaaatggctacgaccctgtttagatcccaccctaaaatttttcatcctgtcacatcaaacatttgaaaacatgcatgaagtattaaatataggctaaaaaataactaattacatatattgtgactaatttacgagatgaatcttttaagcctaattgctccatgatttgccaatgttgtgctacagtaaatatttgctaatgatggattaattaggattaataaatttgtctcgtggtttacagacggattctgtaattagtttttttattagtgctcgaacaccctatacgacaccatatataatacctgatgtgacacgccaaaactaatcacatcacaccaccacaccccatgtcacactagaccagaggtatgaggacaatgctcccaagacgggttcgccccttaattcttttgcagaatataagtctattttggctccatcatcgtaaaaccgggtataaaatctttcctaacttcgaaataacctccttttgaggttttagaagtggtttatgctgaaatgacagtttaaccatggttaactaactaaatcagcaagcgagaaccatatgtaaatgacttcctgctcatctcatcctcttcttcacctctcccttctttctctccttccctcttccctctcacccttccagcggcgggagccaccttacttaatctattctcagaccttcctcaccggcgcagacggcgtcctctcatgttccatccgctgaccagcctaaattgccacatcaacataaactactttttaaaccaccgaaggagttgatttacaccggattttgaagatagagagacattattgttggaaactttttttggcaagaagaaaaacatgattgggacacctaaaagtattgcggtgatatggagtcgctaaccacctcaatcaagcaaaaactagttcaaaa

SEQ ID NO: 18861 - DNA, 1501 bp, Oryza sativa
ttgttacatgtgtgacagctcaggcatttctcccgttctgctagacacatgcctgagctgaagaaaaaagaaagaaataattggaccttctcctgatagttagtagtaccatgcatgcatttaagcgctagctaatccgagtacaactcactgcatatatttataagtataacaaccaatattagtcattgccacacataggatgtttaatactctctccgtactttaacgtatgacgtcgttgactttttttatcaacgtttgaccattcgttttatttaaaatttttgtaaaaatataaaaatatttatgtcatgcttaaagaacatttgatgatgaatcaagtcacaataaaataaatgataattacataaattttttgaataagacgaatagtcaaacgttggacgaaaagtctacggcgtcatacattaaaatatgaaggtagtagttagattaagctaagtctttttaaaacaaagaatattttaatgagtagtaaaccaaataattggctgaatcgatcgctaagatatgaccaagttgtaggatcgcacagcaagaatcgagcccaaacagacatgggataacggttgtagtaacaaaaaaaccaaaacttttagcaaaattaaaagttatccttgtagctgatggagatcggtctgaccggagtatatacaccaatctgaccaatcgaagacctccggcctaactggtgttgaagctctagtctgatcgcctaccgcgccgccaacacctgtcatcgccgccggtccaatcgccatggtgtcactggtcttatcgccggtatgatcgtcaaacctgagcaaacacaaattgaagatctctcaaaagtaaattgaactttattacgtctattcgtgtttctaaagtgcaacaacatcactcctcccacaaaatttaattaaactcgaaacattaacttttctctaaactcaactatgtcaaaatcaatatcgggaggcctcaaccccctctctatttataaccaacttgtacaagaaattctaatccactatgaaaccttcacatgcaggacacaaactttacaaactccaattatattaaatttggactccttccaaattcgactccttatcccatacacacacaatctccctatcatatgccacaaataatttttatcaaccacgtacattgttctttagcctaagcatcctgcataatatcataatcgtccggacgtcattttcttccaagttgattcccgatccatcaccagcaacactctcctgaagcattaagactcagctgcacatgaatcaacaagaaactatattcgagcacaagttctctccaacttgactcaacattagtacacaatagtattatatacatataataaacatttagaagtcataaatataaattaatcatgaatatcaaataaataatccgaaactgaaaccgacacaaatttagccgatcagaccgtccgctcgcataactccggtctgac

SEQ ID NO: 18862 - DNA, 1501 bp, Oryza sativa
agaacgagagaaactgtagaattttccagcacaaagagctatctaccggaagtctgttggctaaaattaaagaggaggccaaaacatggtctcgggcaggggcgaggtttccagcacaaagagctatctaccggaagtctgttggctaaaattaaagaggaggccaaaacatggtctcgggcaggggcgaggcatcttggtagctggcttgctttataattttagctcatttggaccgaaggtcctgagccttgtttttcttacttgtaaagtttactccttctctattcaatgaaattggcagcttgccgattcgttaaaaaaactactaaacagtatacatatatacatatatattttaaaattttataagaatgttttaaaaatcatattaatctactttttaaagtttaaaataattaataattaatcatacattaatgactcatctctttttcttttattcttaatttcccttttttactcttctcaaagacacagactgcccgaacagatggagaagattgtgttcccttaagctctcctctttgtattcaaatcaataatccacataagaaaatatagccgggtcactagagctattatcttcagaaagacccaaacctgataaaaatctatctattaagttttagacgatcgatcatagctttaaacccctcgtcgaacaccggtttaacgccgaaacttgtactatcattttgttcagtatcaaaatggaattaataacccgtcctcctcccgtaaagaattacctaaaaatacataatgatcgtatcaatgttgaaatgctttggtaggaaaaagaaaaacaacattttcatgatggaattcgattatatatatatatttattatttgcagttaattatgttacaaataataataaaaaaataatacaggaaggttagcttagcagtaactcgtttgtttttggtacattcatgccgtctgctgcatctatcacaaacctgaccctagttacctatttctgacgcacatgattcataaaggaccgatatcttcccttcgagcaaccccaatcaatgcaagaatatttattttgaaggtagaattattcagaagttactggcattctctctggtactccttccgtaaaaaaaaaaaaagcaaatttagtttgatgggatatattacagtgcaacgaaatctgaacatacttctcatctactctatccgttctaaaaaaacttaaatccggatttaaagtactatgatgtgctatattcaactaaaattccttatattttaagatgggggagcactatgtaagagtagtatatgagactctgacacgtacgcacagctagatcgaagccctggtcgagtttataaattgagatatatccgtcctccattctcaggccagttcttgcaagactcttgccgtgttgagactgcagaaacgagagctagctagccagaggctgcaagaagattctgcacccatagatcgtctacca

SEQ ID NO: 18863 - DNA, 340 bp, Oryza sativa
gtctcgcgattttctcccctaattgtgcaattagttttttcatttatctatatttaatgcttcatacatgtgtccaaagattcaatgtgatgtttttgggaaaaaaatttggggaactaaacggacctgagtggtgcacatatgataaaaatagataaattatatcttgaaaaaaaattcttggttggattcctggtagagctagaaagttttcaaagccagaacaattaatctagctaactgtttacacccaattttagcacctagaattaaaatagggaaattgccaaagtttggacgatctgccggttttcctctgagagggccgatctgaccgcca

SEQ ID NO: 18864 - DNA, 1501 bp, Oryza sativa
agtgtctgttgaatcggctgctgctgtattggatcaatagcaggttgaggcggcagaaacatggcagcaatctgatcttgcgttggccgattcacaacctgcccactatgctgtggctgctctctcattaacaaccgagggtttaccagctggcctggtgccaatactgacggagtaggtaagggagtcgatgccggctccgtcggctgagctgatggtgcgacggggggaactgcctgaatagatggttgggtattagtgatcaaaggccgataatttggaaagacacctccttgaaaataaactgggcctgcagcctgatgctcaactattgatccatcggctattgacttcatcatgtttgataaggtattgactaacaccctagactgattgatcaaagcatggtgcacagcatagtcgacccggtcttggaaattattgaaaaaatcttgtgccgcatcactattctgattaagatttctcccttgcaacccctgagcaccatcaccttgaactccatgcactccatcgccttgaactccatggaccccttgagagttgtcaccttgacttcctagagaaccgtcggtagcccctttgtcactcagtcgagccgagccatctggagcttgtttcccgtcttcacctttggaagaactggtcccagggtcatcggcaactacctttactttatacttctgaaccaatgttcccttgcgggtctgcatgaatgagttcaagaactgatcccgggcttgctgcaacattgcttcaaaatccttcttctgctcaggtgtgaatttctctggatcgataggcacgacgtttccttcattgatgtcagtcaaccccaacttctggatcttttctttaacagtgcttgggctagccgaggatggcgacagcggtggcttctcggccatgaggaagaattgcttgctgacttctaattggtcccaccaggcgtgccaaaagcgtgttgacagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagtcgatcggtaaggtgctgatgacatatcatttatctttgagccgatgtcatatatgaatcgatcggcggttataaatagatattaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactttatataaagatattaaaacaaatataatataccaaacaaaagcttaatatacttaaatgcaataaga

SEQ ID NO: 18865 - DNA, 1501 bp, Oryza sativa
tcgcgtggtgcatcaacgagggctacgccaacggcaagtgcttcgtgtcgaaactagatttcggcaataataaaagggggtggctatcaagctcggaaagtgtatgggtttggagacaaggaatttatacaggttcaggccttcttataaaagaaataataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacagtagcccccgagtcctttgcagtcgaccatcatagtcttctcaaagatagtaatccgagtgcttcaaactcttcaagccaaaacctgccgagtggactgtaaagggcgaaaagataaagaatatggtgcatcgaatagatgcacctaattaggtgtagcccccaactatgtgattagttaacaaactaatcatatagttgaaagacaaaataataacacaattgtgcattatatgacaaaagcatacgcggcgcctaaataggcatgctagccgaccgctttttagccacaataaaagaaatccgagtggattacactctaaaaggttcacgaatgaacacacttgacaggcatccgaatataaaaactctaaagattacccatcaagtattatgaagattatggtaataaataagtcgaatagcctaggccatgactatttaccataatgaaaataggtatatcacataccaaggaagtgactatagtaaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaa

SEQ ID NO: 18866 - DNA, 1501 bp, Oryza sativa
gcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccccatgaagttcgggaggcgagtgaacagaccgctcgtcgtggcccctgctcctgcgattggatcctgctccagtgatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggaacgattgagctcgttttggttgaggagggtgtcgagaagggtgatcgcggcaaccgcattctgttgaggggtgcggaaaaccagtgtcccttcgacatcttgctgaccgatgagatcacgtgctcggcgccctgcttccaaagctcgctgacgtcgatcctcagcctccttcgcagtccgctcacggtcctgctgctcgcgccgtagccgttcttgttcttgtgcttgatgctcctcctccagtcggcgtcgttcctcggtctcctgggcttggcgttgctcctccgtctcattattggccatgaaaacgccaaagtagagaggggtgtagttgtcatctaggcttccgtcgaagtcgtcgaagtcgttgaagtcgttgtatcgagaactaaatttgtcgtactccacgatgtcagtaggacgtgagtcgacggtgggagagctgttgtagtcatccagctgatctgtcgaaaccgtgccgagtggttggaggatgacgccgacttccctgaagctaggcgaactcggtgttgaagccgacttccgcctaggcctacgggatgaaggcgctgtcgtggtgaagacggccgctaaatcgtcggggagcttcatcaggaccggtgggtaagccccatcatcttgatctggtatcgttggagaagatgcgatctcggccgagtggtttgaagccgactcggttgagatggtcttgaagtagctttcagccgcgttcgggaatccaagcgggaccgaaagccggttctctcccgactggtctgattccgagtcgaggagagaaatcttgccgaagttgttggtgatgaagtcgaggctgccgaaccgaaacgcctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctcggaaagtgtatgggtttggagacaaggaat

SEQ ID NO: 18867 - DNA, 537 bp, Oryza sativa
ttgaggtgtgtgagtgaagtgaggagaggaactccttaaataggctgccaatgacggttgtggtagttggaatggtcggaattgccctccaaccgtcattgtggagtgatccacgccgtccagccaaaacctggatccaacggcactaaggagggttcggctgaaccccctggttcaccgaacctagggccggcccaatccaacccaattttggctggcggcctcctctgttgcttctcttcgtagacttgtgaattttggcccaattcatcgtgtcaattctgagttcttggcccattcatacataagtctgattcttgatatcgtccgattgatttatcatctatgttgatgtcgattctcctccactttattgtcattctctgcaaaaaggttagcaaacctaatactagtggaatattatatatatatatatatatatatatatatatatatgcattgaaagcatcactagttctcctctattttggtaatattgacggtcaagactgatcgataatgaccgtcaacaagaac

SEQ ID NO: 18868 - DNA, 177 bp, Oryza sativa
cctacccgcatttattgcgggttgaacgagcgcgtcacgccgcatgtaatgcagcgcagcgcgctcgcttatccggtccgtgaccgggcgcagcgtgtgaccggtcatagaccggtcagatcgcgggttaggtggtggcaggtggcctgttacacgcctcgccccgtcccgtcggat

SEQ ID NO: 18869 - DNA, 1501 bp, Oryza sativa
actcctgtgttttggtggatctgtgtatgaatgagttacaaagtgtgagctgacttctcccccgttctcagcactcaatccgggaaagaatcaaccccctctcaatgggcaaggtcctccttttatacttcaaggggataccacatgcacccttccctttccaaactggactgttctttttctctttaatgggcggagattggtatggctgctgtccgaacgacacttcgatgggacagcccacacctacctccactcccggcggagacgggcgcaacgtgagatcgtggctgcccgttgctgatgcgatcagtgtcagaccggtcattcttgtccaccacgcgtcagtttaataacatgcatgtttccccttcttcgtgtaacacctcgcctgtaatggttaggatgaagcctggtattcatctaaccagggctaacgtgccatctctaagaaataacacgctagctccggcttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgatgcacgcaacgtgacacgcttgaccagactgcaatgaatgctgttaggtgagcacagctgtgctcacttatcccatatatgtggcgcagacttctttaaggggtcggggtgccccggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacagtctcaatccatgcaccttggtactggtaactttggtggtccataatgggcggtctattcaagactgccacaccacttgagcagcgcgcgaatctgggcgagcagatttgtctcgctcggagatacggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaactagggagcgagatagcgagatacgagggagcgaagtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctaccttcgccacacacgctcgttcccaatcatctcttcctccaccgcca

SEQ ID NO: 18870 - DNA, 434 bp, Oryza sativa
ttaaacaagaaaagctcttaacaattataattagatcattaattgattaactaattactgaactgttctttgtatcatttaggaattgagctccgaaaaatccgagaaaatttcagagagtgtaattaatcatggagaatttaataaaaattaaatccatccatgctttaaatttaggaaattttatttcccacatttaacttcacttgaaaattaaagaacatttaatataaattctaataataatttattaaataatttataaatcctgaaacaaaaatcaggatgtgacaacacacataggggtgagaccacccacgtactagtcccgtgccatgacatctcgactaacggacaccggcccgtgtagccttaatttgcctagacatctcgattaccgagccgcagctcgcgtagccttcatttgcctcaga

SEQ ID NO: 18871 - DNA, 1501 bp, Oryza sativa
tctcggtggtcgccggtgtcttgttgctgctgctcaccatgacgcagaccttctacggcacctacagctactacaggccgatgcattgatccgcacaaaatgcaggggctcgaggcaatccaaaatttgatatttttattttttgggtttggcattgtgcgataggcatcaagtttagctgattttgtgacagcgtgagattgctggctttgcaattacagctttgatggggagaattcttccttggacttcggagtgcgttgtgtgggagagaaggatttgattagcaaatccttttgtcaaaaagttgcatgttgtgtacatttcaaaaacacagccacatacaaaggttaaaaagggttttttgcatagggaaaaatactcgtatgttctttaagctcgtttcagaccgactaaattaattcaactcaaatatatgactgttaacagccttgcaatgaggaagtctcccaaatattcctgtcacatcggatgtttgacactaatgagaactattaaacgtaaactattaacaaaacccatttcataaccctggactaattcgcgagacgaatctattgagcctaattaatctattattagcctatgtgatgctataaagatgtgctaattatagattaattaggcttaaaaaatttgtcatgtgaattagctctcatttatgtaattagttttataagtagcctatgtttaatactccaaattaatgtcaaaacatccgatgtgatagtttaatccgtggatccaaacaccaccacggaaaacaaagcaaaatattagcacataattgatgaagtattagttaaaaaaatcttgacaaatagattaatataatttttttaaaacaactttgtcgacgggggatacccgtagaccggatatagagggtattggggtccgttggtatgaggatctacgtagtacgatatcaagcaaacaaaagacaaggattatactagttcaggtcccttggtaggtaatagccctaatccagttggtatggcattatatgatggaaaccacagattacaaagggaatagcagaactcgatgataccgataagaccgcagtcgagttggtccgactatatctcccggcgacttggctcctgcacgctctagctccgtaggctgtggtgggtgtgttggcagtgatatttgatgccttaggtcctgcccagggggtcccttatataccgcgggtcagttgatctccaagtaggactcggagatatcggacccctcacgatatggtaaagacccagttttgtccgagtagaactccttccatccgtagataccgtctctatcacgtgatagatttccttaacgtatacggaaactattcgtatacgcgcgggtataccgtatcagtatacaacatacatccaaggataaagggtataccttatccgtaaccctgacaaacttccctatagaaaatcttcgaaaaaaatgcaatttgggaagtgtgcgcgga

SEQ ID NO: 18872 - DNA, 361 bp, Oryza sativa
gagcctcaagcttcgtgcaaggagcgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaa

SEQ ID NO: 18873 - DNA, 1501 bp, Oryza sativa
ccacgtatcgagaaaaaaatagaagagagagaagaaagcgggctatatatttgtagccagctgcagcatgaatttcaagacgtatgtgtgtatgagatgtgagaccggatattaataggagtaatatatatttttataattaactattatataaataagctattaaattagttatagttaatttgaagtctgtagcgggttatactattgaacttgctctaaatacgcgcccatgctgctactgcaggccttccaattaattgcccgcaggctgcctccaacaggcccagcctgccaccatcggcccaccgcttccgcacccgcctgacgtgacctgacctgacctggcggccatcttcatcgacgcgtacatttcgtagcacgggcggcgtgatttttcgccagtggggcgcgtgacaatatgccggcagaaggcttcagctgggtgttccggctttcgctgggtgagtgaggatgtgcgttcatcgtggcgtcgcactagctcgtcacttccgatccccgagaggcaacccaacggctatgggaatcaaggggatacatgtatgcgggcatgcggccatgtgccggactgcctcgccagctttcgctggtccacgattcccgaagcgtaaggagaatcggttgcctctgggcttctggttggcgctttgctcgggtagagtaatcttctggttcagatcgctggtcagtcgcttgtggtaggtacttctacgatgttagcttgtgtgcggttacagtgcactggatcgaactacatgtctagatcctctccggaaaagaaaaactctgagattgttagggtagcgaactacttcctctatttcataataagcctttctagtattaaccacattcatataaatgttaataaatctaaatatatatatgtgtgtctagtccattagcatctatataaatatgagcaatgttggaaagtcttatattatgaaatggagggagtaccgatcatacgtgtcgtagttaaatactcaatccgtcttaaaatataaaatattttaattagatggaatacatcgttatattacaaatccaaagtatctatattctttatattacagcggtgggattatcgtgcagtcgccaattagtcttcgacggaatggagtacgtgcaatgcagcgtaagttgctgatgagcgcacatcgcaggctggcagcaatgtccatcgttgaaaattgcacatgatcgcaagaggaaactttatttaattttgtcaaagaccacacaatattttacaacaagcaagcaatcccaaaaattccactatcaatcatcatcagctgataaaattatcgttctaagatattcataggtacattgcttgcctcgcctccctctcgagttggcttgctctctctgtcccggggccactgatcttggcaaccacgagacgctactgcggcgagccccacgccgccggcgaagccgctgcacctgccactgccagcctccatctcga

SEQ ID NO: 18874 - DNA, 1501 bp, Oryza sativa
aggaatctatccattaaccttaaacatttcttctgcgaaatatcattgatagatataccatgtgaacattaaatgctccaaaataattgtcgtgttttgtgaacatgttctaggtatttcaaacttttacaacttatattgcaaattgggggcatactacaatattgataaaataaagtttttagctttaactgatagacatatcttcctctatataaggttgcaccatttaatatgatagatattatgttcctgatatggatgtagcatttgatatgatgtatcttttttcctcacaagagtgcaccatttaacgggacaaatattttgtttgttatatgcacatactatttaatctgatacatattttctatatagtatctacctttatatgatgtatttttcttcctcgtgaggtcctgttatttatacttaaatatgtttactcagagtcccagagtgttctagttgcgcggcgatgccccccatcgtcatgttccgtagcggtatgagaggcgtggcatgctacgacatctagtgcaatgagaaggatagtctcttgaccacttcatcacctgcactgctgctcatcatttgcttcatctgtcctaaaatgttactatacctagtacttgattagatactccctgttcagattctttgtactaggaagtactccaatcagatactaggtagcaacattttatttgaggatgaacaaagaagtagtatgatgtccatgtacttagtactcccttattttggttgaaacaaacatattctaatattacaaatctggatagcctcctatttcccatccaaacaaaatctggataggcatcgctccctcggattctgaaaaagagaaggaaagttgatgcagtgcattgataccaatgcctgagatgatgcctcttcatacataactcaagaggcccatcccttctgtcattagctcagggaataagttcacttcatgaccctcaaaagtgatcgaaatctaattcgtaaccctaaaccacaaaaccgaatatcttaacccccaaactcgtaaaaccgatgcaatttgactccctgggcggttttggagggcggtttcgctgatgtggcgcctacgtagcagtattgactcggtcttctttccacgtggcgttgacgtggcacttaggtggcattagaaataaaaaaatgtgcgtgggacccattagtcattcacacataaagaaatgtgggcctactgacatgtggggcccacatgtcagtcctccctctgaccttccttcttcctcctcccttccttctctctctctcccccttcttcttcccctttctattctcctttccggcaccggcggtcgccatggatggcggcgggtgggagcaagccggagccgccgccatggattccatttctattctccacataaatcccttcttctctcccttttctctctctttctctccctttctcatccattctcccccttctgccggcggcagg

SEQ ID NO: 18875 - DNA, 1501 bp, Oryza sativa
taggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatcccatttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgata

SEQ ID NO: 18876 - DNA, 1501 bp, Oryza sativa
aatacaaaacagttttcgggatccgacacgggctgaatccggcccatccaaacatgttctagacatggatgggccgccgaatggtccggtaatgggctcaatttaagactgctaacatgtggattaaaccaaacatcctcctcgtcgtcggccgtgtcattggcggcgccggcgccggcgccccaggagttctcgacgccgccggggaggcggggagctcgtcgtcttctctcctcctcctttctccgtcccccgacccccgaccaccgccacccttccatcctcgtcagcgccctctttgcagtgccgggccccttcggcatccgctgccgaccccgcgacccgagcacatccgccggcggcgcctctccgccacctatctccgactactcagttcacgctggttgcgcttgcgcacatcctgactaagggcacctgataggtaaaatatttgggacttaagtctcagtttcccccacctgaatttcattaagaaatgaattgtacaggattttccagattacatagagaacggatttccatcttgcatttttcccctcatatgtagcatggcaacatatcctatgcacacaggccctcacgtgtacacacgtgcacaccaactaaaaaatgtcaccaaaaaatctagaaaaaatcatacacatactttcaattgtattacacctagggttaagaggttaaaatcttaacgtcaaattcattatattttagccgtaacaaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgattttttctaaaattttttgtgataatttttagttggtgtacatggtgtgtacacgcgagggtctgtgtgcataggatacgctcccatgtagcatatagctcatgtcaaatgtaaagtttgttttgatatggagcatgtcagtataaattttttttgcaccaaaatccaggatttgggacgtttgaagaacaaattttgtgatatacatgacatgactttactatttgcgtcatttatgcagcttcagcagaatattgcagtttgatagtttaatctgttttcgtttcattatacctgtatatttccaattctgtgtgttaccgtagatctagcagagagcaggatcttttgtttcccgaagtggggcagaatagagcacaccacaccatcacgcccacctcctcctttttaaaggagggaggtactggggattgtcactgtgatcgtgagctggagttttgcatctgtgtcagcaagcaaatactcaacaatgtgtacaatgtgtgttgtttaccttgtcagtaatggaacttaatctcattatactcgatttttattatttccaccagggcaacagtgattagttccgtggaaaaggacttttggatacggtttagctaaaa

SEQ ID NO: 18877 - DNA, 233 bp, Oryza sativa
ccaagcgaatcggccaatgaatttccggaaaagaagcgatcggcgaatgatcatcgatgcatatgcattcgatcgttgctgtctatacgtcacagatcacagatcgaataactactccttgtgttgtcgcaaagtaaaagagaaagggaaaagcgaaagtaaattttgttccaggaatgaattccgtggcaagtatacatacagggcactcttgtgccgcacaagatagaaaa

SEQ ID NO: 18878 - DNA, 1501 bp, Oryza sativa
tcgaacgcgatcaggttgaggaagagggacttggtgccgtcgtggatgaggatgcgcgggatctggagcacgccgtcgtggaacctgatgtcccagaagcggtccgtgttccgccgccggcaccggatgccggcctcccggagctccgacacgcagtggacgaactgctgccgccgcttgtccgccacgcgccggagccccgaccacttcttgagccacagccgcgcggggggcggcggggtgggctgcagccccgcgcggaggaggctgcgccggaacacgtcgaggcaatggagcatcgggccggacagcgggtcgaactcgaacgccgccgccgccggtgaggcgccgatggaggactccagcttggaccggtccttgcggagcagcggctcgtcggtcggcatgagcgggtcgaagaagcgcacagcgaggccggcgacggcgccggtctgctccgggttgccgagctggaggccgagcaggaggtcgagcacgaacaggggtatctggttctcgagcaggatcatgtcgttgcggatggcgtgcatcgcgccgcgcatggcgaagatggggtcgtgccgcgagtaccccaggtcgtcgccgagaccccttcccgccgtcgtgcgcgccgcggaagagctccagcacgaaggtcccgtccagcaccaggcactcgacgagctcgttcccctgcatcccggcgacgcggccgtcgtagcaggcgcgcgcccgctcctccatcggccgcagcgcgtcgaggtaggcggtgacgtcgtgccccgtgcgcttcaggacgtggtgcagcgcgcgccacttgtgccgctccatctcccgcagccgccgccggccgcggtggagcgggccgatggacaccacctgcggcatgtacgcgcgctcgtcgccgtcgcggagcgacttgggcacgcggtacacggacagccgcgcccacgggcacgctgcctcctcggcgcgcgcctgcgccagcttcccgcggatggccaccacccattccgggtcctgcggcttcgggctgtgcgccggcgactgcacctggaccttcacctcccgctcccgctcctggcgcggcggcagcgcgtcgcctcccgctccggcggcctcgccgttggtgagcagcggcaggttgcggttcagcgcctgccacagcggcagcgcgccgggcggcggcgcggacttgttgaggttggcatcgacggtctccttgagcttgaccgtgatcaggtaccagctcaggacgtccttgttgaagacggcgaccatcgagatggaggctggcagtggcaggtgcagcggcttcgccggcggcgtggggctcgccgcagtagcgtctcgtggttgccaagatcagtggccccgggacagagagagcaagccaactcgagagggaggcgaggcaagcaatgtacctatgaatatcttagaacgataattttatcagctgatgatgattgatagtggaatttttgggattgcttgcttg

SEQ ID NO: 18879 - DNA, 1501 bp, Oryza sativa
gacatcgtttttgtttctgtctctactcttttgatttcgtttttgaggaaaaaaatgtttttccaactgttttcatcctcttaacaataacatgtgttccctactattgtagcgtataacgtctgattggctgcgtccttctacgtttgaaggggacctacaatatatcctattctttcacaagctgatggataccgtggagtgtggtaacacagaagatacagttctagccaaagccatcaccattgcaacacaatcttatcagaagatgctgtacttccaaattgaagctgctgtgcaagattgcttggagcttcttaaggaaatggagaggatgaatgatagatacgacttctatcatttcattgcatctgagatcctcttcaacaacaagtcatatgaagatgtgctcaagcttatacgcgatgggcatgtagagttacactacacggcttaaagagttcagcactccccatgctgatcaccacatggatgatttggtttgtgctattttcaaatagacaatctaatgctcttgtgcctataatattcatatttgtttgacatttgtttgtaggttcatcgccttgtgggcaggactcgtgcttatgtatgtattattgtatctaaatatttcctttttttattttttttcttaggagtataaaatttcgtctcctttcattcatccagatgcccacagatgcacaacgagagtgtggaatgttcaaggactgggtgtgtcagcaggttgataaggaggtaacttcgttttatgccaaatctattgtctatttttgtcgcataatggtgtctaattcttttgtttcttctgtccacagtatggatctcttggttatctttacatgcattttcttgataacaagatgagagcttggtttgccccatttcctgaaggtaaaattctcaactaaatttcatccacaatgaaaaagtaaaatctattcccttttgaaagtatacgatattcctttttgagggaattctaggatattctgtgccattggattgggtgcaatagtctcagccaccacctctttttcactgcatgaaaagtaaaaaaattgcacctacaaaggttcttgctatgccatctttgttgatgcttgttttcacaagcataaattttccatcttgtgattggataacaactgcatgccactaggctcttcttgagtaatggcaaattcttgttcttgagaaattggctattatccaatatatgattggaaataatgatttatttttctgttttcatatatacaaaaggcaaaaaaattacatattggactctttgcagacctcaattccagttacatttggcgtgctacagtcacatctataaatcgaaagtaattgcgcacaataactgagccaagggaagagcttattatctagatatgcaaaagtaattggacaaatggtgatacgcagaagcacccataaatttgtttcagggtgccactaatttgaatggttc

SEQ ID NO: 18880 - DNA, 294 bp, Oryza sativa
  unsure (1)..(294): unsure at all n locations
ggagtcaaatgtatatgttttaaaattattaagggttcaagatatcttgtatttcggttcacggattcaaatcaaattcgcccncaagttaaggaagtcaaagtgaacttattccattttatgcccctttcctcccttatgtttgcgcgaatgtacgaacatagggttaggggtggtaaatggtcaaggctcactactctttcacaagccccttcaactcttaaatttttgagcacaagaaaattattaaatttcagcacaaccctttttggcccaaccatcatattttgtagg

SEQ ID NO: 18881 - DNA, 1501 bp, Oryza sativa
ttaaaatataaggaattttagttgaatatagcacatcatagtactttaaatccggatttaagtttttttagaacggatagagtagatgagaagtatgttcagatttcgttgcactgtaatatatcccatcaaactaaatttgctttttttttttttacggaaggagtaccagagagaatgccagtaacttctgaataattctaccttcaaaataaatattcttgcattgattggggttgctcgaagggaagatatcggtcctttatgaatcatgtgcgtcagaaataggtaactagggtcaggtttgtgatagatgcagcagacggcatgaatgtaccaaaaacaaacgagttactgctaagctaaccttcctgtattatttttttattattatttgtaacataattaactgcaaataataaatatatatatataatcgaattccatcatgaaaatgttgtttttctttttcctaccaaagcatttcaacattgatacgatcattatgtatttttaggtaattctttacgggaggaggacgggttattaattccattttgatactgaacaaaatgatagtacaagtttcggcgttaaaccggtgttcgacgaggggtttaaagctatgatcgatcgtctaaaacttaatagatagatttttatcaggtttgggtctttctgaagataatagctctagtgacccggctatattttcttatgtggattattgatttgaatacaaagaggagagcttaagggaacacaatcttctccatctgttcgggcagtctgtgtctttgagaagagtaaaaaagggaaattaagaataaaagaaaaagagatgagtcattaatgtatgattaattattaattattttaaactttaaaaagtagattaatatgatttttaaaacattcttataaaattttaaaatatatatgtatatatgtatactgtttagtagtttttttaacgaatcggcaagctgccaatttcattgaatagagaaggagtaaactttacaagtaagaaaaacaaggctcaggaccttcggtccaaatgagctaaaattataaagcaagccagctaccaagatgcctcgcccctgcccgagaccatgttttggcctcctctttaattttagccaacagacttccggtagatagctctttgtgctggaaacctcgcccctgcccgagaccatgttttggcctcctctttaattttagccaacagacttccggtagatagctctttgtgctggaaaattctacagtttctctcgttctagatttcccagttgaccaggagtgttaacgtgtggagtgctttctttggggctttcttcaagttagcggtggcctctctgtttagcagtttgaaaagtgtgcacgtgaaaatcgagggacttttgtgcctttttgtttttcaaacgaacgctcagttcgggaagtcagattcctacccaaaaccacttttgaagtctatgtatttcttgat

SEQ ID NO: 18882 - DNA, 1501 bp, Oryza sativa
tttctgaagataatagctctagtgacccggctatattttcttatgtggattattgatttgaatacaaagaggagagcttaagggaacacaatcttctccatctgttcgggcagtctgtgtctttgagaagagtaaaaaagggaaattaagaataaaagaaaaagagatgagtcattaatgtatgattaattattaattattttaaactttaaaaagtagattaatatgatttttaaaacattcttataaaattttaaaatatatatgtatatatgtatactgtttagtagtttttttaacgaatcggcaagctgccaatttcattgaatagagaaggagtaaactttacaagtaagaaaaacaaggctcaggaccttcggtccaaatgagctaaaattataaagcaagccagctaccaagatgcctcgcccctgcccgagaccatgttttggcctcctctttaattttagccaacagacttccggtagatagctctttgtgctggaaacctcgcccctgcccgagaccatgttttggcctcctctttaattttagccaacagacttccggtagatagctctttgtgctggaaaattctacagtttctctcgttctagatttcccagttgaccaggagtgttaacgtgtggagtgctttctttggggctttcttcaagttagcggtggcctctctgtttagcagtttgaaaagtgtgcacgtgaaaatcgagggacttttgtgcctttttgtttttcaaacgaacgctcagttcgggaagtcagattcctacccaaaaccacttttgaagtctatgtatttcttgattctttattattattattattattattattattattattattattattattattattattattattattattattattattattattattattacacacgcacaccctacccctatgagcacctccgtaagactgggccggcatgtcttgagattgacgaagtcaccataggtgcctcgctgtcgacgagtacgtcgtctaccactgaaaaaataattagccgtaaatgcgagcacccgtgtcaactctaggatttgaacccgggtgggctggttccaccacaagtaacctaaccagttgagctatgctcacttcgcattttttattttttattttgctagctgttttaatcatatatacacatttattgacacagattgtttccagagtacataataaaaaaaaatagaactacggctcgagaacgccggaatgtcaaccagaacattcagaatggaattgatgacaaagtatggtgaccacgttcgcatgaatgttatgtcatatccattaatttgaataagttattcttttcactacttgcgtattctttcattctaaaataaacaaatctaaataatacaggataatatatatctcggtatagatttacagtatcaaaatatgttatatgccgtacagtattacgatataatatatacctcggtactgttta

SEQ ID NO: 18883 - DNA, 989 bp, Oryza sativa
tatggatattaaacattagtagtttcgtaaagttagtacaaaatttaaaattatgttgttattttaatatatttgaatgatacattgagaaaacatatatgctattatatgagagaaaatataatgatgttagccgcgcaatctgcgcgggccaccgtgctagttattttttatttaaaaaggaagttccggttaaatatattttggtttttattttttagaataaatctcctaacatagccacaatgtgctctaaaactagatagaagccaataaaagatattccctctagtttttaatgtttatgtcacgtatgtttaatcatttatcttatttaaaaatatatgtatttattatttatttttgttgtgatttaatttattattaaatatacttttagcatgacttattttttattttttttaataagataaatgatcaaatatatgtctaatatttaaaggtgttaaacactaaaaactgcagagacattttgaatttttaacaacaaatacatgttgtttttatttcctgcatcgagttttacttatgaattggtaaagatatattggaaaattattaaaaaaccatcctaaatgttaccttgagtttgaggagagagaaaaaaaaggtgcgagcgacaacaactgaggaagaatctcaaaataaccaaggtaaattagaaggggatatttgtaataaattagtttatataaaaaaaatctcaaactcaaatgacatttacagagtgattcttgcgattttcacattgctgtaagagagatagctacgcaggtgtggaagaaatcctcccattttgaacgattgacctagccagagtccaatatggcgggaagcgacggcgacgctcgtatgaattcacgcgcacgtggctttggaggtgcgacgaacccatttgctggtgttttagccactcgtcgtatcacaacagttcgccaatgaaggcgtcgactgcccacaatcccaca

SEQ ID NO: 18884 - DNA, 1501 bp, Oryza sativa
taatcaaaatcatacgtctcttctagtagctacaccccacccaccctcgtttttctcactttcttttttcttgtaatctcctagcctttttggctattgtacagtgtttccccttctttaatacaaatataccccgtggggtttaaaaaaaaaagatcccgcactgtagtctgtatactgtggagctagatataagagatggtgtttctgttggggctttacggcggctgtggcagccggaggaggacggccgcgtcgtcgacgggtggcgtggagaggcggcggttggcagcggtggcgatggcgcggccggtgaggcaactgtaccggaagctgaggtcaaagtggaggagctcggcgtcgacgcagccggggaagaaagccggcggcgcggcgaggttcgggtacagcctggagagctactcccgcaacttcgatgacggcctcgcttctctggctcctatatcttatagttagctagagaaacttcttctgcctcttgccattgctagagtcagggggatccaagtccaatacaagttctgctagcacatttgtgattttgtacacattgtactattgttcatatatatacaggtcgctattgccatggattagacagtgcaatgtctgagtacttatctagctggtcacaaaactaatggagatttttacttttttaaaaaaatctttagctgcagctttcaagcaccatattctccattgtttcgcttattaatatgtttatccgaaatgcttattagtgaataaaaagttatttgtaagtaaaatttttatgtatatattcttagtgaattaaaaacaaatgctgtaaaataaacaataatgaactaataaaaatcaaatttaaaattaagtttttttaatcttagctttataagtataaatataagcgaaataattacagaaaaccaagacaatggtatcccgttggaacgcgataccttctataagacagtatcggatacctgatatctgttgtggtactagctgcatggtacctgatacctgttacccggtacctgtgatacctaaaacctgatacctgtgatactcgtgcaagagaatagttaatatgcctgtcccgttgcaacgggatcccgttttgtagttgccctcaaataattaatgagcccctttgtatttgcatgaactggatgttgctgaagagcccatcgttttcctgagaaggcccatcgacagaagagcccatcatcctctctaagcccggcccatcgtcgcctcgtgacgtcaccacccccgtcccgtctccctcaaggcttctcttttgcgcctcgcctctcctttctctcccacacgcacacacaccgccgtggacgccgaggactacactaaccggcggctgcggcggcaactccggcggatccacccgcagctaggccgagtcgcgctgccggggaagaggcagcgggaaccctagccggccgagcctagcccgggggaggaggaggaggcagga

SEQ ID NO: 18885 - DNA, 1501 bp, Oryza sativa
cgccagatccgccacccgccgacgccatcgacgctgtcgccatccgccgcccggctgctctgagagagggagagggagagagaggagagagagagagaggggagtgtaataaattaattaaaaggggagagaggagatgaggtagaaaaaaatttaaagtggtgggaaaatgatttcatctgaaaaagaaaatcactttgtcggatgaagaaatgacaaaaatagaagttatagatcttgatgagttatataactttgttattgatgactttttccgatgaaatcatttactgcttcaaaatattatttgaacttttgaaattcaaaattttaattgataaaacaaagtcataagaaaaaacagccaaaataataccagtaagaacacgatattctatcatgattttagaaacatttagaaaaaaattattcaatttggagttcatatgagtgagatacactagtttcaaattttattttcgcatacggcttcttaagtggtccgtatggaaaaatcgatttttccatgcggggcgcttatgtgagccgtatgcaaaaatgagctcatttttacatgcggccctcttaataggtccgtatgggaaaatcgattttttcatacgggccacttaagcaaccgtatggaaaaatgactctcgatttttacagacgccactagttatggtccgcatggaaaaatgagggggcctcatacagaaaaatcactttttttaagtagtacgttaattgtggttgtacgttacctacacaaattaagctcattgttcatgtgacgtatacgaacatctcagtatggcacacatgcccatagaaatgaccacattgatcgatcgatcgatctagctcttaattagctctgcatgagtttcgcgcacacgcacgcatcgatcggcatctggtcgcgccgctttcgccgtccactccgatcgagcagaaagacatacaccgagcgagcttggagcatcagagactcatacgggtttcacattctctattatagtaatactattattataaacattaacatataaaataataaaaaatagcatagatcaattaatataatgatcgtgatattatgacagagaatccatagtcgatcgaggattcgaggccaggccgatcgaccaactctatctcttccaatcctttcatttattttgttcctagctttgggcgagggtgacggccgcgttcgccattgccacctcactgctcacgctaccgcctctaaagcaaaaggacgatgctctccccctcctctttcgtcgtggctatctccatcgtctctttccttgaccacagcggcaatggggtagagagagaataaaagatacctgaaatccactttagcccggaccattcctgccggccggtgagtggctcgctggccccgccgccggcggtgatacccacagccatcctgcgagctttatataagccgcaggtgagggagacgctctcgcaccgcagagcaaga

SEQ ID NO: 18886 - DNA, 1501 bp, Oryza sativa
gacactagtatgcttttccatttttttttaaaaaaaggtgtgtttccttccctccatctcctaacagcttagtacaggacagtactagttttgttcttcttttgatatcgtaatgatcatgctgaaagttggtatatggtagaccgtcgtagccacagatcgatcagcagatgttcagttaagcaaaaagtaattagccagtcggtctcggtctcttttgtgcaaaggattcggttgttccacgcggcgctaatcagcgccagtgcgttcgtcagaaattgatttagaactcgcggcttacacgttacacgtcaggttgatccatggaatggatatggcacacaaacccatcggtcatcatgcgcgtaaagcgtctcgatgcagtcatctccctgcactttcctctcatcctatccatctacgatcatttcgtagctgcttcctataatcttgatctatatattgctcaagtgcttatgctttaatttagttaattaattacattatatcaccgacctcaacctttctctcgcaacatcgtcgtacgtggacggtcagggtcttcgccgtacatttgcagcaaggatcgtggatcgtgtgttatcgtcaccatgcatgtcaggctgaattacatggtgatggatggtcgtgagatcaggcacttagacataaaaccctcttaaaatggattgagatattctatctttaaagtcaccgtacattttatcactcagatgtggattatccaaggtttattagattcatatatttttttatataatggaatttaacgtcccagcctttgctaaaaaagagctacaaccaattattatacagtagcatccaagagtgtagttcagataaatagaacacaccaaacaaaaacagaggaaactaagccaaaataaagagaacacatttattgaagtctatttatgaacctccattcataattggcaaatagttgcataaccatcgactccaacttgcggcatgcaacctttaggaactccgcatcatcctcacacctttgcagctgtgcccaaaaccggagccagtgcgttgccctgaaaattacctgcataaataaaatagatggtgatttgttaaaaaccaaatcagttctactcaaccataaagcccagcaaatggcagaagcttcaaccagtatcagtttactccttttcttgtcaacccccatagttcagtattagattcatatgtcaaggataaaatcacgtgacttcgaaggtagagtattctgattcacacagaacatgcatcagattcagatatatctcccctaaggctatgttctagtgaggttgaaagagaaaaaatttctctagtttttcacatacttctcaaattgctaaacaatgtatttttcttaaaaaataatataaaattgttaacagtgaaatttggtaagcccaaagttaccatcggcttagagtcagtatcggcttcaaagttctagaatcagtcgatgggagtcaag

SEQ ID NO: 18887 - DNA, 1501 bp, Oryza sativa
agtttattttttagcctttgcttttaaattgttaagaacatatacaataaaaaattattcacaaactattttttgtttgtaaatatatcgtcgaataagcaaaatgatagggcttatagtaaggactgcaccaatctcggtccgtccaacaggctcagaggaaaatgagagattcaaaaaaagtgaaatcatatatgacatgccagataaatgctttagcaaactttaatgatctgtttagaacatagaatgcatacagatcctgcataatgcataagtaaattggtaaaaaaaaacccatacaaatcccataggattaactagcaccattgctattgtttgttgttgtagtcatgtggtgctatctgatcagatataaatgttgctgttaaggtggcagcttctgtgaatctgatgagcttaagaaagatgtcatgctcgaatctgatcgccatgctcgaagctgatcgccaagtgactcggataatttgacttgtgctttttaactatactttcctaatcctaaagctgccggccatccgtcgtccttttgtgagatctgtgaatcagccgatcaggtcggtgagtcatcagctcatcatctaatgtcactttgatctcgtagctagatttagctttagggcttagtggttttccttttttcgctttcctgagatgctcactactacgacctagaaatttgttaattatgagtagataagatcgtaaggaaaggctagataaatgtcatcatgtcactaagcagatatgtacactctgcaacggctgaatgtgttgttcttgctgacgaatgaatataactaattttttttaataatggattaaaacccgacctatacatcctgcagcaggatatacgcagccccaaagatacatagtctgagtatttaagctcgcaatataggtttcgaataacaaaacataaaagctaggcactaggcctcaaacagtatccagcagcaattggcctgaaattggaactgtttagttgtactagctgcgtataattcctttgccagaagtctgaaatccgaccgttgatgtgtggttatgttatcactctatagcactataattaaacagaagtgtttttacgtcatagctagcagcttgagcttagtaggacgctaggacgtactccctctaaaagttataaatatttaacgtttaaaataggatttaatcaaacttaattttaaaactttggccaccaataatttctgaatttctttgtttaaaaataaactagctgggtggctcgcgcaattgcgcggctagcacccatataaaattatatatttttaatatgattttacttcaaatttattaaatagttatctcgttgtcttaagatttttaaagactaaaccttattatcctcgtgtttctaatttccttagtttctaaagtcacaacaactgctaccccttacttctgtcatattattctttatttgcttgctcgatctaccaccgttttc

SEQ ID NO: 18888 - DNA, 1501 bp, Oryza sativa
ggcaattggcaaatgctaatgctctgatcagattttgctagagcaataattgttaggtggctatcatactaaagcggaaaggggcaccagatcctgcgaaaatctttctgctttttggacctcttgcagtacagatgggaatcgatgcctcgacttgatagtttctgcttcctaatctccacgagctttatgacattgcgcattggaatttttgattagttgcctgatcctaacagtaacattccccccagcatacggcatacggacctatacctctactgttcttgacatcttcagagatttcagatttcagatagaacagtataatttgcaaatacaacagtatggcatttgattccttgcaaaaaaagagattataaaagaatcatagaaatgggtttaaatagcctaatacaaatctgtaaatcaccgttttgtcaattcaggattttggcgatgaatgtttgcattgcacaggcctgtagaagaatacagtttttttttctgaagaaagaaatggttacgagttggtggtttgatggtttttgtctgaattttgtttttgtttttgcaggatggcatctcgagcccgatagcgcagcacatctatgacttctgcgacgacggcaacggcggcgacctcttcgcggcggtgaacgcggcggcggcggcagggtcggacatgttcacggcctcctcggaggacgcgtccgcctcgtcgtcgtcgacggccaccgcgcccatcgccggcggcggcgacaccctgtcgccgccgctgccgtcgctggactccacgctctcggctctcctcgagcaagacgagccgcccggcgccgacggcgagctcctcctccccatcgacgactacgcgttctccgccgtcgacgagacgcagccaccaccaccaccggagcatcagcagcagcagcaattcacccagatgcctctcccggtgatgggcggcgcggcggcggagcacccggcgctgcaggcgcagctgagcagcaccgccaccgagctgatgcagtacgccgggttcaccgacgaggtcttcgcggcggcgttggccgctggagccggagctggggcgggagggtacatgggcctggacgacccgctctgcccgcagcagcagcattccggcgcgatgctccccgccgccgccgccgccgccggcgaggcgttcttcagcaaggacgcgcacgcggcgcaggccgccttcttcgccgcggccggcggcggcggcggaagcatggtgatgtcgatgatgggaatggacgagatcggcgagtaccagcggatgatggaatgcggcggcgcgcttctcggcgccacccacgccgccgacggcgccgacatggccttcggcaacgccgccgccgcagagttgcaggtaggacattgccgccatgcaagaacctctcgcgcacgcgcagcatgacgccatgaccgtttcaccatggtggtcgtggtgccacagatgggcggaggcgggagtagc

SEQ ID NO: 18889 - DNA, 1501 bp, Oryza sativa
ctccccgagatcgccagtaatctcacggcggtgaccgcacgaaacgcccgcccggccggatgccgcaacgatgcattcgcatctcagctactcgatcgtctactctgcccggccgcggctacctagcttagctagcttaattagctaccgatccgagagacgacgtacgagtagggagcgcgtgcggcggcttatgcctagtactacactactggtatcgcgtaggagtattcgcgtaggtgatcgacgtgacgagacgcgggcggccgaccggattcccccactggagcagcggcatgtcgatcgatcgtcgtgggcgctggatcatatcgctcgcgctcatcgatcggcacgcacggttagactctgctatatgtacgtgagccggtgatggtgaaaacggtggtgaatcggggggctccgctcggtacataccatttggtgattagattatgcatcgatctctctctctctctctcgatcgatcgaattctcgatggattgacacctgcctaatcagcacgttgatctagttctttggcagattttgcaccgccttaggtgtcgaacactaatgcatagtactctgatatttatgatactagtactctataataaaactggctatatgtaatggtattaggtagtatacaactttccacaattttttgaaaaaatactttcaaatatctatactctttactacttaaaatgttataatagtgggtgtcctttcccacatcatcactaccattgatatgtgggtcccctaatctgtactattacaccatctttatgagtcatctcctattttactattggatctcctcaaatttcaaaatcacctacttgttaataagaaaaatcatcatattacttggtaaataaatgctaattaattgatctaatgaggtagaaactgattttgttttccattgtaacgcacaagcctctaagctagcaactataggtggtgtttggatttagggactaaaactttagtccctgtcacatcggatatttggacactaatttagagtattaaacatatactacttacaaaactaattacataaatgagaactaattcgcgtgacaattttttaagcctaaataatccataattagcacatgtttactatagcatcacataggctaatcatggattaattatgctcaatagattcgtctcgtgaattagttcagggttatgaaataggttttgtcaatagtctacgtttaatactcctaattagtgtctaaacatccgatgtgacatggactaaaatttttagtcccatccaaacagccccatagtatgagcaattggatagagtgactttctcaaattacagtaaggtacaaaaactaaaagccctatcatttgtccttccgcttacaagccattatcaaatttaaattttaaattttaatcttgaagttgattttggaagatttttttaattgtagtttatttttcagcattagcttttagtgtcat

SEQ ID NO: 18890 - DNA, 1501 bp, Oryza sativa
cccgaacctatataaaccacctgtcccaccttctttctcttgcatcctggccacaagcttagaacctgcaccttggccgaactctgaagggaaggtatcttgcattcccactagaggagctccgtgctccgacacgttgtctagaagagggatgagatagcgccattagcctgataacagtttgctcattgagcttttttcattttttcccctgtgttgttgctatttgtaaagagatcttttacagtgtttgcgaggtacttggaggtggaacaacgtgaaccattgataagagaggggcaaggtacggaacaaaaatattgtaacatgatggcagtggagtaattaacttgtaaaacatgggcattatacgttaattgaatactaacatccatctgtcagtattcagatcggtaagtcagtatccagatcggtaagccatcagagaaaagagtaaatcacggatatcaatccgattgatccgtaacagatcgcatctccattcttctttcccttgggttcgttcttgttctagggtttggatgtttcactggaaggagacaggttcgccaaaaggagacagagagaaaagttttggcatggttgagggttgaagaggagactagatcgcctggtcaacgtcaacctaacgcatcggtaaattatcctatgcttatttacagagttgattaattatttatgtatagttcataagttccttatataagggatttagaatttttgtcaatttgtggtatattaaacgagatcttctccaatggtgttcttctagtgttttaacgggtgtacccacgaggagacacggttgaggaagaagctctggtatggttgagcgtttgaacaggaggcaagatctaattgacatgtacaggtgtgtgtataagtaagatatcctatgcttatttacgtagttgattagttatttatgtagctcacaaatttcttcgtacaagggatcaaaaagagatatcctaatatgttcttcatattagggtttgaataggtgaacttgcttggtgacataattgagggagaagcattggcactgtcttgtgtttgaatatgagacataatctgattgacacgtacgtaacaagtgcataggtaagatctcctatgcttatttacgcaattgttatagtttttaccgagttcatggatccctaagtttacttgggtagggcctgaattgacacatattgaattttcttatttacatagtttagttcttgttaatgcagtgcactattctttcgtatgtaccgcatgcaaattagttgtacactaaattagcttttgtagatttgtttatacaaagcaatttgctatgtacaatttgagttaaaattataaattaactcaagatggtaaagggtgttctaaaaattaaatgttgtttcttgtaggttttaagctctgatggaggatacagggatatcggttgaggaattgttggagtaccaacaaattgtcagcaaga

SEQ ID NO: 18891 - DNA, 1501 bp, Oryza sativa
tttgctcaacaataaggttggattcgaatgtgtagatttagtggcgcggaaaatacaacatatgtttcgctcatggtaaattgagtatgaaatattataaattaaaaaaatgaatttgtttgattttataaataaacttctattagaaaatatatgaaaaaaatattgtttagcagttcagaaatgagagagtagttaaccggataagctctttagaacgcaccctcacatatgtttgatctctaaacaattccatttagtcttaccaagttttggagaaaattgaaaaaaaaaaaagctccacgagtaacattttttgaactgaaaatttcaagtccaaacatgtgtccagttaaaaccggtcttaccaggtacagtacttgtgttttaaaaccttgattagcactgataccatttctttattaaacataaaaaaaattcatgcatttgtcctataaaaaactggtaattcgttggtgtacacacggtacattgcgtctgcatgcaagttatttcaaacgaagcttagattcatagcctgtgtttagttacacgctaaaattgaaagtttgaaaaaattgaaacgatgtaatagaaaaaatttatatgtatagaaaaattcgatgtgatggaaaaatttaaagttcgaagaaaaaaaaagttagaataaacagggccatagacaaaatagtaacctgagccacacgcccacacctacacacatccacaccggcgatgaggatccgcatcctatgcctttgctcccaagtcccaacggcaaaatttgccttaccttcaatctgaaccatccattaatggatcaatgatgtttccattgcccatgggacccacctccactaacactaaacaagagaagatacattgaaggaaaagctactttcctgcttaattaaaagaaaagacttcagaaaattaaaaggaggtggagattggaaaaaaaatcactgtaaaaaaaagggtttatgaacatatatacatttttctacgccatttgtttgacgtctcctctacaagcatccttgcaagtaatgaactgtttttttttcactgtattacttcgtaggagtatttcactatttacttcttgtggacaattttcctacttcctctgtttcacaatataagtcattctagcattttccatattcatattgatgttaatgaatccagatagatatatatgtcatagattcattaacatcaatattaacattaatatgaatgtagaaaatgctagaatgacttacattgtgaaacggagggagtagtcactatctttcattgtttactttttgtggacaattttcctagtcactatctgctttagtttcttttatttttcaagttaatattaatatatagagttcaatatcgtgtcttgttttaattaattgagcaggaaacaacaagttctttccgcgtactccccctcagaatggtagtcgaggcaaatagtagtcaattaaaacatgcatcatcc

SEQ ID NO: 18892 - DNA, 1501 bp, Oryza sativa
tttatactgaacggtaattattgaggacatgtgttcctaatacacaacatatgaaacggtttcaatatgaacaatcttacggttttcttcattaccacttgtaccttattacttataagaagttcaactcaatcaaagcaagatcaatttcagaaggggcgacatagaaattctcattctcaggtctgaaatacaaaaccacgatgaatagttgggatctgaccgatattcagttgaagtcccatctgagtagcttgtattctttggtgaaaaccacgccagctttccaagaccttacacaattgtcggcattctcctaagttaggtgagtaaaatgaaccagcaaattgggtatacctgaatatgcaaaattattgaatgggaataataataatacagaaagacggaaaacggaacacagtgagaacgaaagctaaccttgcagtgggtaattcctttagaacaacgtcaagtgctcgcagggccgctcgactttctcggtttggcttcccaccacggaacttgcgtaaagtccataaggaaatttttgcagcaaattttaaagtgaccacaaaatctctcactctcaagtgccttgactcttcaggactgtcttcaatactatccagcagaacaagaaatctatgtgaatcaaatggcaatggaccagatgtgtatagcctcttccttccatcataggcaggaagacggccacccaaaccagaatctttctgctgttttaccaactctctaataacagcacgattgattccaacctcaggagtgacacatacctgataaaaataacatcagatacgaatactaatggcgcaaataaatttcatgttatagacaagttatgtgaatcagaaacttacatcatattcatagatagtctgatcatccaaagactccagatgaacactgaaacaatttgtcctcacaatgcaactttcgccaatcataccttctgaagagagatttggacgttttgctaatctataagttgatagaatggcttgtctttcagctttattatgtttcaaggagtggtgacgatcgtagagccaggtcattctctgactctccatgactaatgttccaaggcaaggtacaaactttagcactgtaagcggtaagaatagcaatgatcagagactgaagcatcaagacacatcgacagttgaaaactagagtggcatcatcaattttcacgaacagcacagcattgcagtgacctccacacttgtattcacaacagcacagggaaaagcaaaaggtacgatacgccgttgttttcaggtaaatgaatgaaggaagataaaagggattgcccgaccagaccaatatatgcactcgaacattgggggaaaaattctatctaaagagaggcaaacacgaaatcgatccccccagagctaagatgaaggaagaaaaacagtaaaggcaaattgttattagtattaaggttagggcaaatttacagaacagaggctagggt

SEQ ID NO: 18893 - DNA, 1501 bp, Oryza sativa
agatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaggtgtaccactgtacccacaagacacagccccacatcatgtcaccatgtgcctcagtaccaccacggtacctcggaaaggggctgtgacaataccccttgcataacacaatccactgcagcgcaccttccctggatcataatcacccccttataaacaaggcatggactccacagcgacccccgtgggcttatctccgccacttctcagtctggtgctccgcaatgaatcatgctatgcaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttgacaagtaattaattaaccaatcacgattgaccatcgtgaactatcattaaaccatcataaaataataatgagtcataagttatcccaataatgtgctaatgtttctaagcatggctaagcaatcatatctaatatctagctgaaccaatatataaagctcaactagtcaaattataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggaaaattttaatatgtagatctttattttatacaacttttgcaacttgaaccaccttaaactgagttaagatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcaacggttcacgggaacggacggccgagatcgaacctatccaaaacggacggccgggatcaaacggatccaccgcggctcacggagaacgacgacgatgacgtcagcga

SEQ ID NO: 18894 - DNA, 848 bp, Oryza sativa
cactagggcctcaacctcttggaacactaactgacctctcgacccgctaccatgacactacatcattccttttgagcagctcgagactacatccctcctttcgagtagctcgtccacaagttgctgcacgacttggctgactcagacaattacctgccggcctcctcactaaagaagagaagagagaacagagaaaagagaagagaagaggagaagaaaagaaaagaaaagaaatatgcgcagctgacatgtgggccccacatacttatttatttattttttgttgactaggatgtcacgtcagcgaaaccacccatatatactgttaaggggtacaagtttaggggtacatatttctagttttgtggttaagggaccttaaaaaatcttgttgttaagttgagggatctccggtgaacttattccttcctcttaacttttgttcctctacttgagctgagctgcaatgtacaagatgggccaagatttcctgatctgatgctgtgccactggacttggctgggtcgctctgtacaagatgggccaagatttcttgacattaaaaaagaagggactagctaggagctccaatgttaggaataagttcactttgtgaccctcaaatgtgatcgaaatctaatctgtgaccctaaactacaaaaccggatatctcgacccctcaactcttaaaaccggtgcaatttgactcccttagcggttttggtgctgacgtggcacctacgtggcgatgttgactcagtcttcggtccacatggagttaacgtggtgcctatgtgtactagaattaaaaaaatatgtgtgggaccatttgtcattcacacaaaatg

SEQ ID NO: 18895 - DNA, 1501 bp, Oryza sativa
aatctttgaaaattcataactaattctttgtaactcagtttaatgtggttcaagttgcaaaagttttataaaataaagatctacatattaaaattatcgataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagcctttttcctcgttttgcgtgttagcttgtcgttcccatcgtttcgaaggttcgcaagtgcgtcagaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattatatatgattgcttagccatgcttagaaacattagcacattattgggataacttatgactcattattacttaatgatggtttaaagatagttcacgatggtcaatcgtgattagttaattaattacttgccaactaaaacttgataatggtgggttgtgagcacatggttttgagagtcgtgctcatgacaattaaggatcggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcactgtggtgagttgtgttgtgtagagggtattgtcacagcctctattcgggtactttccagtatcgcaacgcatggtagacatgatgttgaggctgtgtcttgtgggtacagtggtacacctctggccagagtaaaactattcaaatagccgtgcccgcggttatgggcgggttgagcaatgtttttcgtgattagtctcacgcctctcacaataattatagatgttatacctggtaataatttgcttagctcctggtttggagttagatctgtacagccgggtatggttgttcaggatggttgggcctatgcagcatgggtgtgctgttcagtgttgattaaaatttctaattaattactccactgttttacttctcttaaatgttttgctaaatgctgcttttacaaatgagcctatattatgccatcctttggtatccttgtgcacttgcatatttgctgtgtggcttgctgagtatgtcatatgctcaccttgcaataatc

SEQ ID NO: 18896 - DNA, 956 bp, Oryza sativa
atacatattttttgtatcttgcagaaaagacgtgttgtcggagttgtccctcaagccggagtggaagagctagccctagaaggaattcgtgcaggcaagtgatgtaataatataaatgattgttatatttgtaatgcaattaaaaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcatgaaacacttagcatacatgactattttggtcttagcatgtaatattatttgagttttaatataagattattttatttgtaattagacttactatataattattgactacggaattggtgcgattcctagcaattgacaattttagtcttaattagacttagcatatacgacagttacacttagcatacatgactctttcagtcttagcatataatattatttgagttttaatataagattactttatttgtaattagacttagtatgtaattattgactacggaattggtgcgactcctagcaattgactattgtagtcttaattagacttagtatatacgcacgaaacacttagcatatacatgactattttagtcttagcatgtaatattatttgagttttaatagaagattattttatttgtaattagacttagtatataattatttactagctagggttgtataatatacgtcatctagacttagcttatatcacgatttgtaattagacttagcatgtaaggttgtgtagggttctaatgtacgacatttacacttagcatgcataacttagattgttaaaacataaatgtctcgtgacttagcagatgtttcttgtatcaacaga

SEQ ID NO: 18897 - DNA, 1395 bp, Oryza sativa
ttttattacaaacttttatgcgtggatgatatttttgaaatattttttgactctattttaatcatgtgttcgttaataattggtttgggcatattacttgatactgtatatcctcaaatttattttaaaaaatgtgtcacaataatggagttggttcatatctatttgtattatgtgtgattctttctttaaaatttttggagtttccaaactttatataacattttttttattttgtatgctatagatgactttaagtaacattttaattttattatatattaatgaaagatattttctattaaaaatatagctaatgatactacttcatctaactaaagataaattatattacttatattccttccatcacataaatcaaagaaattggattttattccaaaacaatagaagaatttatatgtaacaagacaaagtgatttttttaaatactaccacgataatctccaaagtaccatattatattttgacagatatcaatagtgtagtgcatgttagttcagtgtctagcttgttttcaatacctactgtttcacatgagacacctttagtaatttggagaatacatatgtacattagcgttgtatattcgtcgagtgttttttacaccgaaaatatgatgtgaaatgattaccataaaattaattactccctccgtttcataatgtaagtcattctagcatttcccacattcatatggatgctagtgaatctagtcatatacactaacatccatataaatgtgggaaatgctagaataacttacatagtgaaacggagggagtattacattttggctccatatgttgtgatgtatttagcctatagacacattaatagtttatttatttaaaggaatacaatacgatcacaaattgaatatataattttaaaataatttaaaagatagaacgcttaaaaagcattgaccggatattttataattatatttgtgtaaatttgaagattattatattttatctttgaattgtagataattctattttaaggactgtcgatattttttggctttatcataactacgttttctattctttcttcaaacgatacgtaagcattattttttttaaatcacatgtacgtacaaaataccttttctagtcaataatttatatttctcatgtatccgtatataggagaaatgtattattttaaatcataaatctaatataatggtgtaaaataaaacaactaaattgtgttgttttgaattttacatatgtaaatttaaattagggttgtatattcgtcaagtccgatatttgacaccctaaaatatgatgtgaaataaaaaaggaaaaagtacgaattacccccctccccgaactatcgcggtcgtctgaattaccaccc

SEQ ID NO: 18898 - DNA, 588 bp, Oryza sativa
ctacctcttgtgatgatcttgtggatatgcctagctctagctctagctcttgtgtttctatttgtgatgtctcacttgttgttgagaacaatgagcttaaggagcaagtggccaagctcaacaagagtttggagaggtgtttcaagggtaagaacactcttgacaagattttgagtgagcaacggtgcatccttaacaaggagggacttggattcattccaaagaagggtaagaaaccttctcaccgtgcactcattttgtcaagagcaatggtaagtattgcttcaagtgtcgtgaggttgggcatttggtgaatgattgccccggtggtaagccttctaagacatgcatgtttgattctcattatatgcttaggaaggctcatgattgtagtattgttgctagatatgtgggttccactatacttagtggtaaaaagaatgccatttgggtgcctaaagctttggtctctaacctccaaggacgcaaacaagtttgggtacctaaaagagcttgatcttcttttgtaggtgaactaccacaccgatgggagccattgggtgcttgatagtggatgcactcaacaca

SEQ ID NO: 18899 - DNA, 1501 bp, Oryza sativa
aattgggctagataaaatttcattaaatactttgcttaattctataattcctagatttttctgggatttatttgagctaaggaagtatttttagtaaatggaattgcatttaagaaataatttaaattgaaaaaggttttaaaagtcttcttttggctttgggccgaaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctacctcttcttctttggaagcttcgcctaaatcggtttggaaatcgatggattcgagttcgaatcggatcggttttcctctctccaagccgagctttccttcgccgtctccgccgccgtgggccttcgccgccgcctccttgcacctatttaaggacccccgagctctcctctacccgtcgccaccctcgccttcgcctctcgtcgtcggaagagctctagcgccttgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccacttcctcctcgtcgccgtcgccgtccgttgcttctccgccgcttctttggtcaccggtgagttcaccgcgtcgcgctctacgtcctggtgctctccgttcgcgtcgccgcgccgtcgttcgccggcgagcatgcgagcccgagccgccgagccgccgccgccggtggtgacgtcatcgctgacgtcatcggagtcgtccgccgtgagccgccgtggacccgatcgatctcggccgtccgttttggattggttcgatctcggccgtccgttcccgtgaaccgtcacccgtgcgcccggtccaccgaaaccctagccgctgacgcaataatcttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattcttttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagt

SEQ ID NO: 18900 - DNA, 1501 bp, Oryza sativa
acccggctgtacagatctaactccaaaccaggagctaagcaaattattaccaggtataacatctataattattgtgagaggcgtgagactaatcacgaaaaacattgctcaacccgcccataaccgcgggcacggctatttgaatagttttactctggccagaggtgtaccactgtacccacaagacacagcctcaacatcatgtctaccatgcgttgcgatactggaaagtacccgaatagaggctgtgacaataccctctacacaacacaactcaccacagtgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccgatccttaattgtcatgagcacgactctcaaaaccatgtgctcacaacccaccattatcaagttttagttggcaagtaattaattaactaatcacgattgaccatcgtgaactatctttaaaccatcattaagtaataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacacttctgacgcacttgcgaaccttcgaaacgatgggaacgacaagctaacacgcaaaacgaggaaaaaggctaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatcgataattttaatatgtagatctttattttataaaacttttgcaacttgaaccacattaaactgagttacaaagaattagttatgaattttcaaagattaaatcggattaaagcatttatatggattttaattgaattatgacgcaataatgaattatttttgaaaaggaaaaggagggattattgcgtcagcgggtcgggttcacggtggaccgggtgcacaggaacggtctacggaacggacggtctagatcaaccctatccacaacgaacggccacgatcgatccagaccacggcggtccaagagacacagcgacga

SEQ ID NO: 18901 - DNA, 550 bp, Oryza sativa
ttctccatatttagcgccggttatacggtcatgataggttttcgtaaggaactcgacaacccggggtgatctctggaagtaccaggtgttggtatttcttaacgacattactagaaatataattcccagcaatggcgcagaaatacttctgatatattatggttacagagttcatccgcaagcgcacggatataccattgtagcatttcacccgagagtattacaagggtatagtatttattttatcccgtgggaagatcatgtagagagaactcgactaataatttatatattacttgtgataatcatattctaagcaggggttaagataatccagggtagagtgacacacaagcattaactactcattctcataatatatcatctaagctaagtgcaaagaaaagagaaagaaaatctattcctatacttctaatatacatactatacatacattcaagttaaccgatatactagctaatacccactatccgatgccctcctggtactttgagaagccacccctgactgccgagttcattacgacagc

SEQ ID NO: 18902 - DNA, 1501 bp, Oryza sativa
agcgacgatgacgtcggcgatgacgtcatcaccggcggcggctcgggcggcgcatgctcgccggcgaacgacggcgcgactacgcaaacggaggacaccaatgggtagagggcgacgcggcgaactcaccgagctcttggacgacgacaaacgacgatggatgacgacggcggcgaggttgaagcggcggcggtcttcgggtcgacggtgacggcggtgctccggcgtgctacagcggcggcgaaacggtggatggggacggcgacgacctcgcgatcccgatggtggcgacggcgaccgacgacggaggctgcaacggcggcgcggcgcggctgaaccgacggcaacgacggcgacggctagggctacgcggaggcggcgctagacgcgacggcgggctaaggcaaaggtggcggcggatagaggagagctcggggatgcttttataggggctagcgagcggcgacggaggcccacggcgaccggccgcgagatgaaaagctagggttggaggagagagaagtcgatccgaatcgagctcaaattcgtcgatttccaaacgaaattgaccgaagtttctataagagaaaaggaagaggagatcgaggagattatttcccctcgaacgatttcactggaaacggaaaggatcgaccggattggaaagcggcggcggctagggtttcggccggcagcggcgcggggaggaagacgggcctgacaggtgggtcccgcctgtcagcggctgagagagaggagggaggggcgcggcggactgggccgactgggccggggagggagagagaaagagagaggttttgggccggctttcggcccaaagccaaaagagacttttaaaaacctttttcaatttaaattattcatgaaatgcaattccatttattaaaaatactttcttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttaaggatttttaaacaagaaaagctcttaacaattataattagatcattaattgattaactaattactgaactgttctttgtatcatttaggaattgagctccgaaaaatccgagaaaatttcagagagtgtaattaatcatggagaatttaataaaaattaaatccatccatgctttaaatttaggaaattttatttcccacatttaacttcacttgaaaattaaagaacatttaatataaattctaataataatttattaaataatttataaatcctgaaacaaaaatcaggatgtgacaacacacataggggtgagaccacccacgtactagtcccgtgccatgacatctcgactaacggacaccggcccgtgtagccttaatttgcctagacatctcgattaccgagccgcagc

SEQ ID NO: 18903 - DNA, 1501 bp, Oryza sativa
ccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccg

SEQ ID NO: 18904 - DNA, 1501 bp, Oryza sativa
ttccccaatccccatcaagaattcaagaacagccggagcagcggctgctcctcgatcgatgttcacctcctgcaatcaacgacagcagcagcttcgaaaatgtccaaaacatctgtaattctccatctttcccttggccagtaatacgagacaacctccttcccatgtccaccttcgcggccgtcatggcttcttgtgtccattgacccattcttgccatagtccggcgcatgcttctcctcgacgccgccgacggtgacaagctgcacatctaacgctacttggtagagcagcggtggtagcctggtaggcggtggcaacccggggtggaggcagaaagcgacaacgactccctcaatatggaggttgaacgaggattgacggcgaacgggcaggcggcgtcctcctgctcatgagccgctcacgctcagatcgagccgggacggatcaagcgccatcagccgcatgcgcatagatcgggctcgggtgagcctggagccgagcggagcgccccgtccgatcaatacatcatccacgcgtcaataatccagagctgggctgtagaagacggggcttgcatccggtctccaccaaattatccttagctacccggcctctctacgtggaagaaatccgggaatcgcgcgcgaggatgatcgacgtagcggtgtgtgccggtgttgcggcaaagcggcgacagtcagatcccccggtttggcctatgcacattccatagctagtggtaaagctaacactactcctgcactttcgatctcagacaccatactttcgatcgccttctatacgtttcggcaggcgacagcaaacacaggttcgacgtatgccttactgcattaaacatgctactatacgcaatggtaaaaagctagtgtagtcggcagctggcccacggcgatttggcctattgacgaacggatacaagattcctatcagaggtatatatgtatctacctagctacttgcaaaagggtactagctagcgtgcatggcgttgtgaagaacgttgtgaagaatcacgattgatggatgtgtgttgtgcacgggccgtgcaatgcatggctagctatggcaaagctaagctaagctaagctggaagataagccctcatgggggtgacaagagggggaggaagctgcttttgggggactgatgggcattagttctgtctggtaggctaaggtatagctttatctgttcgatctcatggactaatgtaatatcctttgggtgctaattgttgttgtgttgctgacaggattgatttttaatcttggacattacacgccgccatcgcatccatctcgcgcgtacgtggttcctttgatccttaatcctttcctcacttgcaggtgtgtacagtacacctgcaattaatggtttaatttgttcctagtgtgaagaaatggattagcttaatttgagatcgtacagttgattcacgcttccttcgatccgggttatgatctctaacacacatatg

SEQ ID NO: 18905 - DNA, 1501 bp, Oryza sativa
aaaattatatactctttgatgataaaataaatcacagaaaaataaataatacttatataatttttttaataaaataaatggttaaacaactcgttaaaagttggcgttgcacgttaattagaaaaatcgagggagtatataagatggtggtggcagctaacctaacccaacacaacacataatatattaatgtaaactctcgatcagctggtaaactaacgaaccaacgttcgcggtttgtaagacgaatcgctgtagcatatccttccgggaaatcgacttgctgcgtacgttgttggagtgtgtgacatttttcttttcaggggaaaggactttattaaatcacacgagacatattacaatcattttcgatcaaaaccatgagatagaattggactcaaattaatcaaaacatttagaaagtaataaataaataaattgcagtaataatcatgtttgatattttaatatcttaatgacaattagaggagaaatagcgggcgggccatagagaagtacaatggtgaagtcgttgatggtttggtgggacttttacaaagtaaaaaaaataaacccaacgataattatgtttcattctcaatggcagtaaaagaggagacaaacatatggatcgtagaggagtacagtaacgatgtttgacaggtgttctgaaaatcgtaaaaacgaaacccaataagacgatgaactctaaaaatgcaagatttagtgtttaaatgtcccaagtaggatgaatagaagccgtggtagattaagcaaatacgagtaacacaactggtagtgtgataaaggagtaactggtaaaaactatacgattagaaacacgggatgataatgttcggcctttcaaagatgacaacaagatacaagctatttaacaaattttaaataaaagtcatatataaaaagcagataaatttgtacatatgctagtcacgcaatttgagcgggtacccagctagttaccttaaaaaaagaaaataaaattgatcaaacaaatcctcaggttaaggattacgctcgaagtgtaggtaggctgtgtttagtttctgaaaaaagttggaagtttgtggaaagttggaagtttgaaaaaaaagttataagtttatatgtgtaggaaagttttggatatgatgtgatggaaagttggaagttgaagatagttggaggtgaagtaaacacgaccttaccaaggttatatttggctgctagctagtgctgcttctggcagcgagccgtcaactgtattgggtcaacgaaacggtggttggaccggccggtcaaacatgcgtgcatgattactgcattgatccgaccaatcaattcgaagcatacacacataccagagttcaactcgccgctcgcgcactatataaagcgtcccctcactcccagctcatgctcattcccaccacaagctaattaaggtaccagcaactccatcacatccttaatttgcagcagcaggtaattgtacaccggc

SEQ ID NO: 18906 - DNA, 247 bp, Oryza sativa
tggtgcacaggttcttctcctgcacgggcgccacccggccgccggcgcccgagaacgctgacatcaccctcgtctcgggcccttcgtgctggtacgcgtctcgtactctcgtctcacagctccttttccaccatgaatcaaaccgaagctgtttgtcgaatcccgtgcgttccgtgtcccatccccgatgctgcggcttggctcactccgctcttgctccgatttcgccgcctctcctggtgctaga

SEQ ID NO: 18907 - DNA, 1501 bp, Oryza sativa
tatggaatgccaaacatcaccgtacgtgttgtatatttaccaggtttttttttcgcaaaacaaggttgattatacttaaatactgagtagccgcgggcatatattggtaagcttgcaaaatcaaaagacactcatttttcctttttgttttgttttgttttgcaagttttccatggattggggtttgagtatttgacgggcatatatatagccggtgtatatgcatgtatcatcactgacacggcacgccaatcacgtgcagcggcagcgcagttgacgcgacaacaacgcgtcgttgtttcggtcggacccggaccggaccggagtggatcaattcagttcggtggtggaaagtttggttggtgtacgtaaaggttatccatgatcatgaagatgcatgcactttcagatgggctcctctcctctcatgggatttgaatagatgtgcagaaacatcgaagaaatttcatcggttcccagtccatgcgtgcctagaggttgcatgcaaatgtgcaaatacacgatactggtcgtgtttagttctttggtcattttttttaagcatacgaatacacatttaaagtattaaatatagactaataacaaaataaattacatattccgactgtaaattatgagatgaatttattaaaattaattcatggtacaattagacaacatttaatgctccatgcatgtgtccaaacatttgatgtgatatttttggccaaaattttttttatctaaacacacccataattaagcactacatattatattctgtcctttcttttacgtatagcgccggatagtctaaatttgaacttaatcaacatcatataataaaatcagagggagtattagtataagatggtgggagctaacctaacccaataacccaacctaaataataacgtactatgctggtaaacgaaccaatgcctgctgtttgtaacacgaatcatgtcgctgtaggcctgtagcatatctcgatcgcctagcttgttgcgtacgttgtgcgagtgtgtgatactgacgcgttgtttcatatttcctactccctccatctaaaaaaatcaaatctaatgctagaatataacatatcctaatataacgaatctgtatatagagcatgtttcacataatattttagtactaggttaacgtttttttacggagggagtaggtcctaatatataataatctgaaatatatttaatatattttaagactacgaatctagacaaatatatgttaaaattcataatcataaaatgtatcaaattcggttctaggttactacggagtatatattaagacaggttagtacttcacttttccacacaacttgtgaccacagctatgatttgatattttcttcgaaaacgatatatctttaatttgattgacatttatacaaaaaattaatagaaaatcgtactatgcgtacatgagatatatcattttagctggaaaataaaaaagatattactggcctgga

SEQ ID NO: 18908 - DNA, 1231 bp, Oryza sativa
attcttcttaatacgtgccatatttgatacttctccagttgtagcctcgacttgtgcttgagaagtctccccttgatctgaaacaaggtcagcttcatcgaatctaacatcaccctgaccccaaaggcttgcctgcaacctggcctccctttctttgttatatatggactgcagctttgacttgaaatatggcaaaacaacctacaaacatattaagaacaccataaaaaaaatattccaaacctgagaaatttcatcataacataaataaaatgtgacacccattttttatgagcattttgatagtgatatccatatgtttgtcgttttacttgagtcactgaggtagcacatgaaattgtatcataaatgccaaaaataacaacttcatcaagagcatcgctaatacatttaacaactacactaagttttggtgctgaatacgcattaaaggataatagaccaaagcaagattgaagactcgaaacttttttttctaatctgcaccaactttcaataagaaaataactgaacacagagatccagtaagagcatcgtagcttgtaactaaagcaaaaggacattctgtattcatactggagtagtacatagtaaaaatagactaggcattggtgtcagttgtaaaacgttgataaacaaggccagctttaataaaagagcagctcagggcacataatagaaccatgcaaaatcacacaaggttaacatatgggttagatttgtttctaggtgttcaactcttgaagtcatgataaaccaatttaatcaaattggtagagagaggtactgttttcgtagattttgatagtagctgcatatgcagagtagcaagacagaacagctcaaaagtatttaccacgaaaacaacaaagccaataccaaaaaaaaaaagcagtaatatttgacactaaagctgcttgctgctaaacgacatcataccaaaaaaacaacagaaaggactttctggcgcttccttagaacagaatcataggctttatcattggattctgcaccagaactacttctctttactgaaaccttaacaggtctccgcctgagaccatacaatgactccgaaaaagaaccatctgaaaaaaaaaacctggacagttataatcacagaggcgttgagatgtctcaaagaaaagttagtacaaaggtcatgaacacagcaaatcctttacagcaaaagaaccttatgtttctgtga

SEQ ID NO: 18909 - DNA, 1501 bp, Oryza sativa
taaacaaggatatgacagaagtaagtggtagcaactaatgtgatttttaaaaactataaaaattagaaacacgaggataataaggttttgtcttgcaaagtgatcttaagacaatgagataactatttaataaattttaagtaaaaccatattaaaaaatatataattttgtatggtgctagccgcgcaattgcgcgggccatctagctagtttgatgcaaattagttgtgccggccttgtgtttggaaagagtcccctcgttttaaattacttgttgctctgttaaatcttgcacaaactaagaagatttgacagattacatggttacccatattttactgccacgtagtcgtcacgtcagcgaaaccgtcattcaaaaccatccagggagtcaaattgcgctggttttaacagtttaggggtcaagatttctggtttacggttcagagtcacggattagattcgggtcacttttaacatagtcaaagtgaacttattccgatgagctaccttcttttcccgtgagtgtaattaaattgctaaacataattttttttaaaaaaattacgtatactccctccattataaagtatagaaagctagtactatattagacacaatatagtactacgagatagacaacctagtaatataaacttagtcaagcctcacaacgaaaaccagaaagttgctatttggagttgccaagaagaactcagcctaacggttcgtttggtagtgctctaactcctaaatttagtttcagaaattgggtctgtagtaaagttgtggggtaacctaaattcagctttacctctctagttcatttcctctcattttatcctgttcacctcaacgactaattttattgtgcttataactaattaatcaagtaagtcataggtcatggattttatttttgactggattgtggatttttctttcgcgaacgcgtaaaaagcttacatgtcaataaatggatctattggtatagcatcacgaaagactttagcgtggcaaatcttctcttacatgactttttggttacattacggacacttttcaagttatcaggtgtgatcctatcctgctcaattgtttcaagtttcaactcaaataagggagagagtgagtgggtgtgtaggagataaggtcgagagaagggagggaggggggtgtagtggctgggagacatatggtcgagaaaaaaaaatcatccctttggctggttctactatttactacaccatctgttttaaaattctactatttactacaccatctgttttaaaatataaaaatatttgaatgaatgagacatttcctattatccgatttattaaaaaacccggcatggataagacggcactgaggaacattttttaagtagtgagcagcagcagcagcaggtaactgtataccggcgaatttcctttaaaaaaaactgtataccggcgaaggagaggattggaggagatggccaagccaagcgccggtgcg

SEQ ID NO: 18910 - DNA, 1501 bp, Oryza sativa
tatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggaga

SEQ ID NO: 18911 - DNA, 1501 bp, Oryza sativa
atgcattgttaggttcatttcgcatcacgagttctaattaataattcatgaagctgtatatattgctgaaaattcggaaggaaacacttcatttttttgacgatgtgtggtagacgacacaagcaattaaacaacacgcatctaatctagttcagtaagatttagtacgcgtatagccttatccaggcttatacaatagtgcattgtcaactcctggtactaccaacgacttagaattttttaaatattatatattaaatccgacctatgcttcaaattaacggcctaactactagcttgggaatatcaagaacatttgtatatatattactcgttcgctacacgacttcaaaattaattacgatctgcattgctaaagaccccttaattaatctcgcatcgctaatcttgtaaatctccaaattaatgtgtgtatggtgatggtcaagttaatctgcatgatatatatgccccaaaattattagccgccgtcggtttcgtttgatctgacggttgtaaacacctgcaaatcaaatttgggccttctagttcgcttggcgatgacgtccggcccatttaagggactcagcgtgtcgctaaatgggctaattgggctgatcggccaatttgcgaatgcactaaggccctgttggatcaagctcatcggatcaactacctcctttttccgtgagtccaatttctaaattactaatccttttttctaaaaaaaaagaagcatactccctctattataaaatgtagattagtacaatattagacacaacatagtactaccagatagataacctactaatataaatctagtgaagcctagatcggtacaaaaaaccgatatagaatttcctctgatcctctcccttatcccacttctattcgacggctaattattgtgctcagccttaattaattaatcgagcgagtcataagcagtggagctatataccaatggtatcacgaaagactttggcatggcatggcatgccttctcttgcatgcatgaattttggggccctctcggaagtctcgtttgaacacataatgcaagttagaatagcctaccaggcttgaatcgtgatcatttccagttcggtggtttcaagttcgaagcacacagtttgctcaacaaaaagcccccttttttctggatttatttatttaacctgtgtatcagtatagtagcagcagcacattatacatatgtgaatgtgatgggctgattgggctcaatgtttgcgagatctcgatcaagatcgatctcgtgggggttgaagactaaatcaacggttcgtttcgtaagcaacagcacagaaatgtcgcgagttcgtagtaaattaacatgggtgcttagctgtgttgttcgcttgcattgcataccagatcaactcgccgctcgcgcgctatataaagcgtcctcccactcccggctcatgctcattctcagcacaagcagtagctagctagcaactctgatcacatcgcc

SEQ ID NO: 18912 - DNA, 1501 bp, Oryza sativa
actgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataaga

SEQ ID NO: 18913 - DNA, 1501 bp, Oryza sativa
catacatcatctcaataatcttttgtttggctctctaggcctttgcatagcttatggtgtacttgaatttgttctcgatgtgcctaataattgattttggtttaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgttgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgggcctgatgaaaacaataactgcgtaacctcgcatttctgtactacaccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaatataacatattagtacaaatgcaaaagatgtatgggagcaaacctgtgatgaagtgagcgaagcagcagggcttcgccgctccccttctgctgccctcccctctctctctttcgttttttttggatttttagtgaatataatgaaatttcagagaggggggactgggcttta

SEQ ID NO: 18914 - DNA, 1501 bp, Oryza sativa
cacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaaaccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaa

SEQ ID NO: 18915 - DNA, 1501 bp, Oryza sativa
aagctggtccctggagcagtcattggttaagcatcatgataatataataatataagacggaatcagcaatcggcgctgcagactagctggcattcaaccaacaagtacctacctgactgtcattgcataatctgaagttctggaccatttggatcgtgtctctgtagtttttttttaaaaaaaaggaataatattcaaatcaggcagattattgttcaggcaatcaagccagtgggtagcaagctcgggcttagctgtatcagactatcaagcagagccagcagagatactgtttgttatgtcaagctaccgcttatattaataaagtcgcccaaactgttagttatgacacaaaagatacgatgatgattaatataacaacaattataattataattatgataccattttttttgctggtattaatagccagatatacaagatgctaatagcagttgctgcatcggatttcaggctgtaatattcagacgttgacgtaactgtcggctgcagcaggtgcccattttggccaagctaattaactaatcatacttaacttgcacattagtacaagtggtggatttcctacgttatctcagctgttaattgcaagtcaacttacccagaatccgcgtcaaaacaatgtcacgacaaatgtaaatggacaaacgtacattacagttctctccctgattccatattaattgatgctttagataaagttgatatcaaacttttataattttaaccatcaataactttaaaaaaatattaagtttaaaagaactaaaacaatatatacagatttttctttaaaagcactataataaaaatagatatatatatatttattatatattataatagaaaaataaggtcaaaaatataagatatattttgtagactgtgtcattgttcaaaacgttaattaaaataaaaccggaaggagtacaagataaatccccgtataattgattctcacacaaataattacatggataaaccaaaatccctgaaaatttcgtacgtttttttttaataaagatcacgcggtttcatgcatcaaagctctccgtaatgttggaaacttcgattatggtttgaaaacaaattcagagacagcagactcgcacacgcttcgagagaagacgaaggaaagaaatctgaatctttccttctcgaagaccggtccccttcaaatccccatagaaaaaaaaaattcaaatcgagccattaaattaaactaatgaaaaatcaaacgaaaattaatcaaatccaaccaacgtaatcagaagcagatgcaaattaaacacctcctcctcgcacagttaacccctttctcctcctcctcctcctcctccttccccaaccactcgcaaccaaaggcgcaccaaaccggagccaatccgagcgctccggcggcggaggcggcggcggccggacctactcgctgccgtgggtgggggctgggagggagcgggctggtggctcgtcccgtccg

SEQ ID NO: 18916 - DNA, 1501 bp, Oryza sativa
aaaattgtcacgcgaattagttctcatttatgtaattagttttgtaagtagtatatgtttaatactctaaattagtgtccaaatatccgatgtgacagggactaaagttttagtccctaaatccaaacaccacctatagttgctagcttagaggcttgtgcgttacaatggaaaacaaaatcagtttctacctcattagatcaattaattagcatttatttaccaagtaatatgatgatttttcttattaacaagtaggtgattttgaaatttgaggagatccaatagtaaaataggagatgactcataaagatggtgtaatagtacagattaggggacccacatatcaatggtagtgatgatgtgggaaaggacacccactattataacattttaagtagtaaagagtatagatatttgaaagtattttttcaaaaaattgtggaaagttgtatactacctaataccattacatatagccagttttattatagagtactagtatcataaatatcagagtactatgcattagtgttcgacacctaaggcggtgcaaaatctgccaaagaactagatcaacgtgctgattaggcaggtgtcaatccatcgagaattcgatcgatcgagagagagagagagagatcgatgcataatctaatcaccaaatggtatgtaccgagcggagccccccgattcaccaccgttttcaccatcaccggctcacgtacatatagcagagtctaaccgtgcgtgccgatcgatgagcgcgagcgatatgatccagcgcccacgacgatcgatcgacatgccgctgctccagtgggggaatccggtcggccgcccgcgtctcgtcacgtcgatcacctacgcgaatactcctacgcgataccagtagtgtagtactaggcataagccgccgcacgcgctccctactcgtacgtcgtctctcggatcggtagctaattaagctagctaagctaggtagccgcggccgggcagagtagacgatcgagtagctgagatgcgaatgcatcgttgcggcatccggccgggcgggcgtttcgtgcggtcaccgccgtgagattactggcgatctcggggagatatatttgttgggatcctgggtagaaaagcctcggcccttttgtctacctagccaagcatctccagctaaatttagccatgagtaggagagtaccatgctatatggtgtaggagacctgcactgcataatatacatgagttcaacacactaatgagttatattttcaagcaataatgagttatattacaagcatatgtgtgttagagatcataacccggatcgaaggaagcgtgaatcaactgtacgatctcaaattaagctaatccatttcttcacactaggaacaaattaaaccattaattgcaggtgtactgtacacacctgcaagtgaggaaaggattaaggatcaaaggaaccacgtacgcgcgagatggatgcgatggcggcgtgtaatgt

SEQ ID NO: 18917 - DNA, 1501 bp, Oryza sativa
tgatttgattaatggttttgcttgctttggattggatttgttcagctaagcaaggtttacatggacaattatgcactttatgaaatacctggtagtttgtagcttgagttttctactgctagggggggggggaaatccttgttgcgtatggagggaatagtgccggtttgtgatgtacaagtaactgcatatcataaaccatacatgccggtgctgtcaatgaaaaggatgcacgcttaagggtatttttctttttttagttaatcaagggtaattttattagataggaaaaatattgacattttttgtcgcaactctaatacaatcaaaattttgcaagttacaaaaggagtactaggttagtatattgtgggggagaattacatgaccaacccagtgtgtaattaggtctttgatgcgtttgtttatgtaaaccgtacggaggtgggcttccgttggatggatgggagcagagagtcgttgacctgaatgacatgaatgtcccttctgtactcttctgctcctctccacccaaaatgtccttttggattcttcgcactgcagcatcatggatatagggctgtgtttagttcagtacaaagtttagattttacttgaaattagagatgatgtgactgaaaagttacgtgtgtatgacaggttgatatgatggaaaaggactaaagtttggatctaaactttggatctaaacacagccatagcatgcctcaaaggcaaatgaaaagtccacataaatttaattcaatagtttgtgtggtttgtgatggaaatggaatgcttcttacatgaacttttgatggatcaaatgaaacaccattggtatgtgagggcctcagtatgtctttgttttccaagactgtctaatgttcaggttagcggaacttcactatggttctgtcaaatgcttcgttcgtttctgactcaacttattctggcatgggtaacgagttctttctctgggttgataatatttgttattttggacaagagcacgatctcaaaaaaacaactttgaccattattttcattataatatgtataaaagtgttaacaaatatatgattttattaaagtactttttaagactaatctatacatgtagtcaccatatttgaaagataaatattttaaaaatgatccataattaaagattttaaagattgacctcacacttatttaaaacgacaagtattatcagtccggaaggagtataaccattaatcatgtaagtattaactattatatattaaaaaatatttttgtttcattttaataattttttatatattttttacacaaaatatatcgtgtattagttcgaaaaacgtgctctctgtaaacgattgagtaacctagtctctaagctcattaagaacgcagccaagtcttggccatcatttttttaggaaatgtgtactgatttctagaacatatattctagttttaatttcaataaggagagatttcatgtggctgaaaa

SEQ ID NO: 18918 - DNA, 1501 bp, Oryza sativa
ttaagatttgagaagtaatccaacttgtgaaagctacaggtgtggagtgacgctgcaagatcatatcgatgtgaggcgagcagtacactactattacttccatgttataagactttctagcattactcacgttcatataaataatttattaatataagtaatgctaaaaagtcctataatataaaacggaggaagtagcttacaatataactccatagttgtacacttgcagcattattgtttatctaggtcacaagcgaatgacgtgtgaagtttcttcaggcttgctctaacagatgctattacatttcttcagagatgctataattaaagagagaaaatggttgtcttcagagctgtactacaaaggggtttcttcagatatgctctaattaaagagaaaaaacgggtttcttcagagctgtagtactgaaaggtttcttcagagttgctcaaaataaagataaaaaagaagcaatgtctcctcaatcttgtgcacgtcacttgtgcaaggttgtgcaaatctttattggattctataagttcgttctagataccggcagatgcagcatcgcagcaatatccactgtgtgcgtttctagttgaaagccattcagtgaactgcaatttcttcttttttttaaaaaaaaagaaaaggaagaagaagaagaagaagaagaagaagaagaagaagaagaagaagaagaagaagaagaagaagaaagaatctttgcaatgataagtcaaagcatatattggatcaattcaaggtaaggatcgtgtcaagcttgtagaaaagtttggcacatatatgcaagaacgaacctacgagtgtcgtgccgtggcgcggcagcagtttgcaagtgtcgagcgtacgtacgttgcgtggtttaccagcacgcatctgcaatgatctcttggagacttcgactcgtgcaatgtacttcttgtttggacatctctcgttggattttggccgtttatattctttgtggatatagggttaatgaaaaatctatcatctaaaaaataatcttttgttggactactcggaaatcggatcagatgcatgcttatcgccactcgagacccgtctctctctactgctattttttcttttcaatttttaccattcacagcacaaatcttttactatctgaattatcgatgaactgtcagcatcgattttttttcttgaacggtcatcaatctccatcctttagcagatatttaggagccctttgaaacacgcatgacaaaaaaaaagcatgaatcgatgtcctcccacggaaaaaaaaagggaatagtgtatatttttaatcccacataaattcaaaacacataaattgggaagagtagtcatttgattgcatcacaataaaaaaaactgaaagtgttccaacatcttggttattttcctatggtattggccattgcaatgcagttctatataacaaaaaaattctaccctctccctatgaatcaaaggactctattaaaa

SEQ ID NO: 18919 - DNA, 255 bp, Oryza sativa
gtgaggttgagcatgtggccggtcaaatcggcggagtccgactccaagtccagttttatcggttctctggttttcttgcttgagctgagatttttcgagtcctaattggtttctacacctaattgaacgtagagaaggtcctgaagaaggcaagaccagtctctttataagagctatgaccagttcaattgagacacaatctacaaccaacaccatagccaattaaatcattctttcaatatcgtatctaccagg

SEQ ID NO: 18920 - DNA, 657 bp, Oryza sativa
tatgttatttaactatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacgggtgctaatttatctgagtctaggtcatcctcatatctttatttttatttatttttcttttattcttttccttga

SEQ ID NO: 18921 - DNA, 503 bp, Oryza sativa
tcatcacttgcctctcgccaaggacctcgccgcccgccatgggtcccgccgccggcgctaccaacgtgaagtctctcccgttcttcaagaccctcaacctagccctcctccgttcgtcgcgcccgcttgtcgtccctggcgccggtgccgcgtcactgcaccggtcgcagtcgtgcaagcgggcgccgacaacgttgccgccgccaatgaagccggcctgcccagagtacagagagaagatagagagatagaggagcaggaggaaagagagagaaaggaagaggctggcctgctgacgtggcatcctgacatgtggggcccacgtgggtcccatgctgactcagctgccacgtcgaacaaaaccagggtcaaacccgccgagggacctagtttgcactggttttgtaagttgggggacatgttgtatccggttttgcggtcgggggacgattttgtaattcgatgacaatttgagggaacttgggtgtactttttccttttct

SEQ ID NO: 18922 - DNA, 1501 bp, Oryza sativa
ggagcggccaccgtgggaagccccacaaccgccgccccaccggagactcgccggagcgccgtcccacgctcgctgccgccgcgcacatgcccgaactgctgccgccgtctataggtctagggtttcgggtgtccacaggcacagccacactcagtggggaagagagggatttcatccctatccattcattcaggggtagaatggtaaattatattccataatactctttttaatttccatttgtgtttctttaacacataaatgtgggacccaccaagtgggcgttacaagtgggggcaaacggttggttcgtagtgagggtaaaatttcaaaccataaaaagtaagggtaaaacaacagttgggattaaaagcggggatatagatgcaattatcccaaacatcatatatgaaaacaagttttggaagagtttattttttaaaaaattcaaattcaaatgatttagaaaataataataactcttgaccaacaatgtgatagactactttaggctttgttctacagtgatgattcagaaccatctctctctctatgacaaaaaaaagttactcactagcgcatgattaaaattagcacatgataaattaagtattagttaaaatattttgaaaaatagattaatattttcaaagtaactttgatatataattctttttgtgaaaaaaaaaagtttcattgaacaatttaggaggcatatgcatgcgaaaaataaggaagtgtatgtcgagaaagtggagtgcccaactcaagctaaggctccctttgaatcacaagaatgaaaaaacggaggaataggaaaaacataggattctcacaggaatacaagtgtaaaacagaggattacaaaacacaggaaaaacatagaaatgaccgtttgattgagccgtaggaaaaacacaggaatttgaggagagataaaagactcaaaggattcttaacatgagattccacctcatgctaaatttccatagtattcattcctttgattcaaagggctatataggaaaaattcctataggaatgaaatcctttaaaattcctatgaatttcctttgaatcaaagggggtctaaagcggcttatttccatataaaatacaaattgacagctcatctccatttccatccactgtacccggtttttctcatagattcatgtgcattattagaatcaagaacaaacgaagaaagatactttgcaagatatttaggttttgctctaaatcaaacttctttaaatttaatcaaatttatagaaaaatgtagtaacatctataacaccaaattggttacattagatctaccatggaatatattttcctggtataattattttgtgtaaaaatcttttttctataaatttaagcaaacttgaaaaagtttgacttacagacaaccctaaaacatcttaacacagggagcaaagtataggaatgtcatgacttgttaaacggcattcggaacaaaaccaaagagaagccc

SEQ ID NO: 18923 - DNA, 1501 bp, Oryza sativa
cggcttggacgatggatattacacttgactgcacgctggtatctgaggatcctactcccccagtcccccgcgagcgagcagaggcggcgccgtcgctcgtcctccgccaccgccgccggcgccgatacccatccatcccgcgccgcgagcgagtgcttccgccgcatccatcctggttagcacaccctctttcccatctctctctctctactcacgcacctaccgaattcgcgttaaccctagcttctgttctagaaattttgccttaaccttagtactaatttcttcccaaaaaggtttggggtgtcccatgttagatccgtccatgaattaagctgcctgtcgaaccggttattctctggtataactcctgtcaatgtactctgcctcagttcttgattgggaaacctttccttgctagttgctacctaattttcagtttttcatcattgtacttcagcttgtgacttactggattaatcagttgggatggagtatatgttggatgaactcgtataaattggtagtatgcaaattttggagactcataattgtgagagttatctagctttatttgttgccgttcacttgtttctctagtcaaagatgcttgtcttgaagttgatgatgttagcctttttaagattcaatcaatgatgctaaagtatttattcaatatactaattgcaattagggttgttcgcccatttacaactggtgtaaacgagcttagcttagctgtcgcgtgcttgctgaaaatgaatacagccagttgttcggtcaaaacctccgatgaacagcccttattgcaacatagttgtatctgtcataagattatcttctctatttttgttatgccgtgggcttattgactgaggttgtaatcgtgcaaaacaggaggacagggtactgggtgtgggcaggcaggcactgaaactggactacactctagcttcttagtgattacctctagatcagctcagcaaatagatgctattaaccactttgtttacaactttacatgcatgataatcgtttttgtatcctgaacatgagaatttgaaatttgtagtaggtgtcaattacttcaccaagtaaagtagctggaaacatatactagtagccatgcgggagtctggtcttccaaatcaatcaaacaatctgtgactgggtatcatattgcacattaatatgtatgctaaaggtcctatgtttaaactgttactagaagtgcttatatttgtttgccttcctgctgctcttgtactatattctagattcaaatgtacaacatcttattgctcatgtaaacattaaatactaattgtaactgtctaaatttcttcagagtttttagtgcttactaaatttcttcagattttccgtttgctgtctaaaactcttaaaagcatcatgttttcatgagaaagctaacgtttacagtctcctggtgtgaagggcatttgcaatcagtgacaaaagttcctcagctgtggagcca

SEQ ID NO: 18924 - DNA, 1501 bp, Oryza sativa
ccggctgtgtacgacgcgtgggctcgcgtggcagcgccgaaccgaggcttcacctccacccagctgcgtcgccactcttcacccaccatcccagtgccgatccaaccgagggaggaagctccagctctccctctccacctctcttttgtcgccggccgccaagaagagggacatcgccaaccatcgtcgagctctctccatctctaactcatactcgttccattctcatctcaccatgccgaacaactttagttttgatcccattccatttcatcttctacagcaacgggaacgccgccatgtcatggtcgctctagagcgtgctctgtgcaccgccgcagcgacatcatcgccgttcccgcttatctggaccaagccgggccaagctgtcgcgccagcgttttcgccttgacctcctctccatttcccgtcaagaatctcgaaggatggtgctacgagtgcggagatcggctaccgtcttcttcacctccggttgccgtcgccattgtcgattccgcctcctccggtgagccattgtccgattcttcgcgtatacaccatccctgggacctcactaacccaatgaaaacacatgcatgtcaattcgatgattggatcgagccgttgccgtcttcccggagctctacaccgtcgccggaccatcttcttcaccgctgccgctgtccagactttcccgcgcctcattcaaggttcggtgagcacccttgagccataggattgcattcatgcatttcattcacttagaatcgagcacgaactcaacatgcagtagcagcctaagcacagccgccgctcggactcgccgccggcgttactccgatgtccactgaccgagaaaagtagaggaatggaatcgaaatagcaagatcttcattttgtcttttggtcgcaccctcaaacgagccaccgtttgccgctggcaagcttgagatcgagctcagccatggcttgatctgcttcagctcgaaccagggacctcctcacaagaatttaggttaatatagggtcctttctgcaaaagatcaagacacacagaacagtcataggactgcgggttgatttcctgaaactctaggggccttcttgcatattggcctgggactgacaatccacccctaggaacaaaatctgaaattataaaagaacagtaactaaaacttgtaaaatcatataaaattaaatctagctcattttaagatgattcaaatttctgtgaactcatcaaattgggaaatttgatgctatggaataaaaacttgaattcacagtacaaatttagcctctaaaatttatccaaattaaatcacacattaagcatgcacaaacttataaaatgcatacaaaattcatttcaaataatttcagagcaaacttagtttctacagatccaccaacatgttctctaaaaaaaagtaaaataaaacatctacacattttgcatcaaatgcctctaaaactattatctttaaaaataactagt

SEQ ID NO: 18925 - DNA, 1501 bp, Oryza sativa
taactgcacagttggcccacacttatgttccctactccatttttccccacaagtgtgacacaatcccttagccttgcgataagcacgtagtgctgccactcgatcctccagaggctgagttctgtcatcaactcgcccaccagctcgcccaggagtaaaagcaacattccccacagggcgttgtccggtccgatgagaaaaacctccatcaatccgatgcgaatcccgtcgtcccgcttccaacacctcttcctgtaaacaagcaaggtccacagcagtatccaaatcgtttggacgatgtaaaattactgctgagctaacttcaggtttcagtccatcaaggaattcagtaatgaagaatactgaattccaggacgggtgatgagcatagagttgatgcataagctcattgaatttttctacataactaagaatggttccctcctgcctaagcctcttgaactgtctaatgagactctgaaattcctccctcccgaacttagcacaaacagcctcagagaaatcattccaccccatcaattccacatgagtattggtggattgcaaccacacaagagcacttcccgaaaattgcaaagcagcaaccccaacccacacatccgggctaatcccactcactcggaaataggtttcgcatttcattttccaggctctagggttctctccttcaaactgtgggcaatctactctagcattacccccatggaaccccgaagcaaaaactcaattcgaactctccccgaattcgaaaggaacacgagatggagactgaaattgacacgtacccttggccgggagagacgttggagagaaatcatctccagacgccttcccccgattcatcgttgcaacgccatggcctaacggccctggactcgcgtccgcccctttggaagccgtctcctcctccttcggcaccgagatttgaggcaccgtcggcgtgggtagaagagggggcagatccgctggcttgacggcgagaatcggattgcgggatatccgctccacttgctgacgcaggtcgccgaggtcgtcccgcatctccgtcatggccttgtccaccgctggcttccagctcgcgagttccaccaccataggcttgatttcctccaaggatcccatcgaagcttggatggcggtattctgcttctggattgtcgccatggccgccgcgagttccgccaattgctgctccatctcttgggacttgagttgcgcacgggaatggtatctaggtttgtcgaggtactccaggatggatggctctgatacctattgttacgaatctgcttgcgaatttgggagttttgggattagaggagcagattcgaacagagagaaggggtaggaagaaggggaggaacagagagaacttggagcaggggaagatgcagtagttagggaggaatagtttttctgttcacttgttcgatgccttttcccctctgctcactcgtgcttatatactcgcacgtttaca

SEQ ID NO: 18926 - DNA, 503 bp, Oryza sativa
ccctctttgtagcttatagacatatgatcatatcagataaagatttgcagatcgatctatttttatgcatgcatggtgagagaaagtggacacgtagtaaaccaataaaatatattctcgataacaatatatatagcaggttttacatattacaatctcacaaaaaaaccagcttaattacaacaatcatgtgattcaaggttgatacaaatgcagatcgattagcaaacagacatgatcatatcaaatacgaatctataaatcgatctttttttatgcgtgcagggctgagagaaaacgaacatgtaagccattaaaattatctcgagataacaatatatataatggattttagaaagaaaaaacgacttacaacaatcaaattaaagtgattcaaggatgataaaaccgcacatcaatctgcaaacccgacaagagacttactcacggggaacaatagccaacaaccacaatagcgaacaaccacaccaaattaaactctg

SEQ ID NO: 18927 - DNA, 1501 bp, Oryza sativa
cgtccctggtcaattaaggaccgagtcatgaagttaagcatgaaacgacccccgtacaaccgcacttctcgtatgggtatagacctagcggagtagatagctgagcggaggcagtatccatgcatagtggtttcttgacgtgtgaggcaggggctctacggtagggcagccattggtaggaccgcaaggcgggtgtctaccattgtgtcgccatcggtaggactgccatgtgagaatctaaacataattataacttaatgcatgtgtgagtcttcccttcccgggtgcgccagaactcttctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgtggagcgcgggtaaagtgtacacccactgcagtgtgagtaaaacaaatctattcgaatagccgtgctcgcggttattgagcaccgggacatgtattacacttggctagactctaaattcttaacttgtgtgggatgggatattgcatgatgatttttatgctgttggagccacttcctgagaggagggaaggtggacgtcctcagaaaaccatgacgactcaatggtgggaagctatccttgagatcacaatggatggtgacataaccgtcgttgtttaaatgtgaacactggtactaaaatttgatcagtcaatgctaggtcttaggcttgtgaaaagaattacaaaactggctttgcgcaaggaaccatagccatcctttgaatacccctatcatgtgcattgttgctataatggcttgctgagtacggttggtactcacccttgcaatatataaacttaatcagaggccggagacgaagcttcggaggatccctacgcgtactacgaggagggtgatgaagacgatggcgctcagtaggtcttagttacggtcgttgcctgtggcaatggcgtgccgctgccttaactccgctgccttatctacttctacttttggaatgtattccggaccgctcggtccgatgatctaagactatgcctgtgggcttatgatgtaataattcacactagactttcgtgtatgtgcatttggtatttcagctacaaattcgtgtgtaccagactacttgatccaaggaaatggtactgtttacacgattgattcctgttataaaaacgggggtccacagagctggtatcagagccatacgactgtaggaaaagaccaaaaggcgcccacccccttttctagttggtcaaaggagaaattcccatttagtaatactttcaaaaataaaaacgctatgtttacaaaactctatacgattttcatcttactcttaactattttcttcacaaaacaagttttactcttagctgactttgggtttttcttaaaattagatggcagatcaggattcacccactacctgggaga

SEQ ID NO: 18928 - DNA, 1501 bp, Oryza sativa
aaaataatttagaactgatggtgtggctgacaaattaaatcggtcactgatgacctcttaggctcttataatttagtcccaaacttggctaactgattttcaatcttgcaaatccactaaacatgcaaatcgtgcaaattctgaaggagatgcaggtcaatagtgctagcttggatgcgaagtaccctgagaagcttgtacacttgtttgaaaattaccgcgaaatcgagatgagaatcatgagatgcaacacaatcctagcaaacaaagcaaccgggaaatgtcagcgctaactttttatctaatcacatgcatgcattattactatctaaatttgaaattctagaggttgttgaaactagtcgaattaaatgaaaacagcataagtataaaactgcagggttgttgaaactgaaactaactgaatgcacctgcaagtcctttcctagagacaatgtaaagaaatttggaaggccaacgttcttccagatcattgtggcttgaattgctgcaaaaaaaaaatgcagcgagagagcgtgagttcaggtttcatgacattaaacccatcaggtgttcatgacggcccattaggggtgaagtaatgcgcttggcgccggcccattgttgcagcgctcaatgtgtagtgctcttttttttaaaaaaaaagaaaaagaaagaaaaacagatggagaaggatgcatatggcaaacaaaaatgttttccctgttgtaactcaaacatttccacgggacttttgtcagcgacactccactgttaacctccaaaatagtaagaaagtgtactgattaatattgtgttaggttcaaatgacgatttccattggcaaatactccctccgttttaggttataagacattttgattttggtcaaagtcaaattgttttaagtttgactacgtttatagacaaatatagtaatatttataatattaaattagtttcaccaaatatataattgaatatatattttcataataaatttgtcttgggttaaaaatattactatttttttctacatatatagttaaacttaaagcaatttaactttgactaaagtcaaaacgtcttataacctgaaacagagggagtagtattggaagatgggattgttttgaagtatagtatttttttttcacagaaagcattctatatagtctacaagaaaactacggtacaaaacattaggacaatcatcttgaacaaatcctgaaaatttgtcctagttacagttgcaacatgtgccaacgaacagctatacccatgaagatggatgcatggaacaaatcacaaaagaatgaaattctgtacaataaatgaagagatcgatctggacaaagagacgaaacaagccaagaccatccggaggagcagttcaagggtgtcgccgccgccgcagctaagcgagttgcctagacgcgtcctccggtgagagcttgcccggcggcaaagcacatccgcgtcctggccattgagggcagcc

SEQ ID NO: 18929 - DNA, 1501 bp, Oryza sativa
aataatactagtagtacattcctaagagcaagtttaatagtatagccaactgctagctccaatttatctatagccaatataatagttcattcatacaatagttatataatacactattagtatctagtcccacctatcatacacacactgtgtcttggagtatgtgctacacatggctataaatctgtagcccaccgctcctctctctctcctcatttatattcttaaaatatgtttgcagttatagcctgctaatgtacctgctctaagtccaagtcattattactccgcgagatagatagctgtggtagactggtagctcgtacggctacacgacacgcaacaaactgtactgcctcacacaggagtatggccctctccagcgctattaactgcggtgggttccattaatgtgaacaagtgtgtttgaaactttgaaccgaacgatcaccaccatgcataacacgataactatgcaggagtagttttttttaaaaaaaaatcaaaagaaataaaaacataacaagatattgacgtattgtgtccaagtttgctgaaggagtgaaataattgagggggctagcaaaaaagactgtcaagctactgctttgatcatctcacattcccaccacatttcggtaggagtcgagggtacgtctaatacacgaatgttcgcgtaaaagtcatactaatgctagacacgtgcttctgcataatgaggataatctccggtaatatcgatagaaacgtcatactatattgtacttgttgtttaagaaaaaaagaggataatttgcggtaatagctaatgtaaagctcaatacaacaggttgatatatactccctccatcttttaatatttgaagttggttagttttttctgaagtactaataaacgtagaaaagaaagaacatgggggcagaattaggatcaattttagccattttgttcagttgtgtggactctccggatcaaataatactagtacgtcgaatcgcaacagtaaagaaaaaaactgtctatatatggtgcaccagctgggtatagctgccgcggcagcaagccagcaacagcaacaaatttaggagtacttacttatgttgccgtcgtaactagcactaatgacgatacaacaatttacggcaattcactatggcattgagatttaggccgagtttagtttcaaacttttccttcagattttcaacttttccatcacattaaaatttttgtatacacaaactttaaatttttctatcacatcattccaatttaacgtgaattaaacacactcttattttacttatgacatgttatcctctacaataaatacagagaatttatgtaggctcgatccgtgtgactctggattgtgggtccacgtgtgcgttgcagttagagcaaattcaggagaatagcccactactagctctaattcacatatagccaatacaatagccaatttatacagtagttacttactatactattaatatattg

SEQ ID NO: 18930 - DNA, 1501 bp, Oryza sativa
atcggggtttgaaggaaagagaccgatccgattcgacctcgaatccacgagtttccaaaccgaattaggcgatgattccataagagaaaaggaagaggagatcgagaagatcatttcccctctattgatttcaccggatcgggaaaggatcgaccggatttggaaggagacgacggcggcgcggcgctagggttcgagcggcggccggcgcgaggaggaagacaggcctgacaggtgggccccacctgtcagcggcaccgagagagagaagagagcagcggctcgagctgggccgactgggccggggagagagagagagaggaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacagattaaaattagatcttctcttctaggcttttaaaatcatttctaataattccttttaaacaacaatttataatttaaggattttaaacaagaaaagctcttaacaaatataattagatcattaaaatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaacttcacttgtaaattaaagatcatttaacataaattctattattaatttattaaataatttataaatcctgaaacaaaaatcaggatgtgataaatctaccccccttacaaagaatctcgtcccgagattcggaacggctagaaagaaaagggcataggtaaactgtagtctatcttattattccataactcagataattattctaaggctttaaagaaaactactgctgctttgaaactagtggctgagctgtaacacttgaagacgcaactcttgaagacgcaactggcactgcattggctcctgtgacgacaatgttgttgacctgaccttgcggctgctgacgcttcggcttcggacactctcttgcaaagtggcctggcttgtaacagttgaaacatacctgctgctcccttccactagtgttattctcctgagactggtcctgctgaactggcaccggctgattagcttgctcgatgttaacatcattgctttcattagtctctgatttgatctcaccagcgatgttcaattgttgcgactgtccttgaccagcggaagaagattcaccaatttggagtggcctgatatgctgcctctggctactaccttgtgcctcctggaatacagtcattctccgtttacggttatccatcctgttcttcttgtcttcaagtcgaattgctttgtca

SEQ ID NO: 18931 - DNA, 1501 bp, Oryza sativa; identical to SEQ ID NO: 18837

SEQ ID NO: 18932 - DNA, 1501 bp, Oryza sativa
gaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactgaaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgatccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatattaagtcataagttatcccaatagtgtgctaatgtttctaagcatggctaagcaatcatatctaatatctagctgaaccaatatataaagctcaactagtcaagttataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttacaatgaaatgaattagttatgaattttcaaagattaaatcggattaaaacacttatatggattttaattgaattatgacgcaataatgaattatttttgaaaaggaaaagaggattattgcgtcagcggctaaggtttgcggtgaaccgggtgcacggcagcggttcacgggaacggacggtcgagatagaacctatccaaaacggacggccgagatcgaacggtccacgaccggctcacggggaagggcgacga

SEQ ID NO: 18933 - DNA, 1501 bp, Oryza sativa
ttatatcctaaatggcaattgcggagttcattacatatatatcaatagctaaacttgttatatgtattacaggattgatcagttgcttaagcatcatctcttatcgcccttataggaaactatggctcaaaaataaaaacatttaaaggatattatttttttctaaataatatggttcattgcatgttgagttttttgttacaactatataagatatatagttcttattgatgcggcttaatacatgttgatttttatagtaatgactatattaagtgcgctataaatgcaaatgacatataaatgattatgattaaaacataagaaagattgaactattattattttctatattatggctcactgcatattgagcttttgattatatctactattataaaaattgaatatatttttgccgtcattcgtattttggtatgtcatccgtatttgagtcattttttaagttcgttcgcttttgaaaatgtagatccgtgtttgagtcagattttaagttcgtttgcttttaaaaatacaaaagaagtcatacaagaaatttctttaaaagaacttgcatgctaacttgggattaaagtcggactcctaactgcagctcatgtttttttaaaaaaaatatccaagcgaattcctgaatttcattctatctaaaccgtataacaataataagattaaaataacattcacccattgcaacgcacgggcatttttctagtaactatataaatatgatatatcaataatactctagcacatcatatcttcaaagcaggttgcggaggacggtcctatttatatttctataaaagtgtacggatgtttgacaagtggaaaatatccaaatcccccttaaaaatctctttagagtttttaatgctcatgagttatattcctatttaaatactttttatcctggtaaagggatttcttcttggacctctttaaggaatacctacctttttcccttttccatgtctagaatcatcgaagagaaattatattgacaattcaacgtatctttaaacctttccacaagcatgcatttcttgcttgccttactttgagtagtccgcgtgctctggactgtgttaacgaccaagtttggtaataccagcatcggagatggagatgggatcgaagcggaatcgaagatgatggttgttgcggaaacagagtaaaatcggctggagtccgggtcggctacgactgggatcggctaagtctgagttagactgggttaagtgatacagccgattccgacaatacgatctgtgtacgatgtcgggttcgagttgatgtgcttcaagatgattgccatgcatggatagagtcctgggaaggcaattgtatctattaattaggatattttatgtaaattccttagagatatgtttgggcaaaagtctgccgcaaagacttatggtatcttagagtttgttagaaatagtagtcgtgtccggtatgggcatatcttgtaattttc

SEQ ID NO: 18934 - DNA, 1501 bp, Oryza sativa
tcataaataatttaaattgaaaaaggttttaaaaagtcttcttttggctttgggccgaaagtcggcccaaaacccttctctctctcctcggcccagtccggcccagtccgccgccgcgcgcgcgcgtccgcccgctgacaggtggggcccacctgtcagggtcgtcgtcaacctccggccgccgccgcccgaaaccctagtttcgcgccgccgccgtttccttccaaaatccggccgctcctttccgtttccggtgaaattgattgaggggaaacaatctttgggatctcctctaccttttcccctttggaaacgtcggctaattcgttttggaagttcgtggaatcaagttcgattcggatcggtctctttccttcaaaccccgatctttccttcccgtcgccagccgccgtgggccttcgccgtcgcctcctagcccctttaaaaggttccccgagctctcctctacccgtcgccaccttcgccttcgcctctcgtcgtccgtagtgccctagcgccgtgtagcttcgagccgccgtcgtcgccgccgctccagccgtgcgccgccgtcgtttcagccgtcgccgttgctcgggaaggtcgccgtcgtgatcgtcaagtcgccgccgtcctcgtccgccgcttcgccgccgccgaagaccgccggagcaccgccgtcaccgtcgacccgatctccgccgccgtttcaacctcgtcgccgtcgccgtccgttgctcttccgccgcctttttggtcgccggtgagttcgccgcgtcgccctctacccgttggtgccctccgttcgtgccgtagtgcagccgttcgccggcgagcatgcgcgcccgagccgccgagccgccgtcgccggtggtgacatcatcgccgacgtcatcgtcgcccttccccgtgagccggtcgtggaccgttcaatctcggccatccgttttggatcaagtcgatctcggccgtccgttcgtgtgaaccgccgccgtgcgcccggtccaccgaaaccctagcccgctgacgcaataaatctctttttccttttcaaaaataattcattattgcgtcataattcaattaaaatcaatacaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttg

SEQ ID NO: 18935 - DNA, 1501 bp, Oryza sativa
tcgagacgacacccgaccgacatcaagggagacgtccctgcccgccgccagcattctctaccccgccaccaacttccctatgtgttgtcttaggtctcctccactctgctacccaccagcctccttgtcgaatccggccaaggagagcccggagttgggccacgccgcttcggtgacctaagccatcccatgtcgtcaagccactacctccatccacctatggagctccccactgaggagggaaggatgtccacagagagggggttgcctggccagcatcaaaggagatggccaaccgtcctcctcaaacctgctgccatgagccatacaccacgagcagacgacgacgagggtccacctctgctcatggccgccactggctgtcctcagctgctgcgctggtgcagaggctgccacgcgatggcagctccgcgtgggacgccagatccacctcgccgccacctccccacctcaccgccgccgcaggaccccgtatccacaccgccgccgcttccccgtctcgccactttccacattgatctattcaatagtccagagcatgcagactactcaaagtctcaaagtaaggcaagcaagaggaaaggttcagagatatgttgaattgtcaatattatttctctaggatgattctagacatggtgaaggaaaaaaggtaggtattccttaaagaggtcctagaagaaatccctttaccaggataaaaaagtatctaaatagggatataactcatgagcattaaaaactctaaagtagattttttaaggaggggggaggggggatttggatattttccacttggcacacatccgtacacttttatagaaatataaataggattgttctccacaacctgctttgaagatatgatgtgctattgtgagtattatcgatatatcctatttatatagttataatcgaaagctcaatatgcagtgagtcataatatagaaaataataatatttagatctttcttatgttttgatcataatcattgatatgtcatttgcatttataacgcacttaatatagtcattactataaaactcaacatatattaagccgcatcaactagaactatatatcctatatagttgtaacaaaaaaacgcaacatgcaatgaactatattatctagaaaaaataatatcctttagatgccttttctatatgtttgagttataattttctataagatatatatttagaggcgataagagaaatgaaagcaactgatcaatcctgcaatacatataaaacgtttagctattgatatatgtatatgtaaacttttaccacttcaaaagaaagacattcactgccaccacccctttcaatgacggatagggtctcattctcaaatattaaaaagttatttattaaatatatataacatttgaacttatgttatatcttgcgcattagagtgataaactccgcaaggttaggatcttgccatttaggatacatctcattgaaaagc

SEQ ID NO: 18936 - DNA, 1501 bp, Oryza sativa
caaggcccacctcggggtcctccgctgtagagggccactccacggagccgtcagccattaacttgccttggagtcctctgctatcaaggcccaccgccacatccgtgttgtctcactccacgccgttgagggtcgccagattcatgccgtcacctctgccgccacctaccggagaagaaagagaggacggaaggcggagctcgacgagacggcattggcggccgccttgacccattcgtggcttccttgacgcgccgtcggagttgccttcggcctttttgctgtttcaatatactcgacggccgtccggatagaggtggcaccgggaagagagaggggagaaatggcgccactgaggagctcatcaccgacgatgtgagtggtaaagccggtgaagcgaggggaacatgaaagtgacgggtgggtggcggggaagaggttagggagtagatttttttttctctgatttttagggtgttctatgcaaattgctagactactctctaaattttaaaaagtatatgagtattaaagtaaaaaattacaagggagcacatgataaattaagtcatcctagagccacttttcactgtgagatagagatttctaacttgtgacctagtccaggctcctcatacctgtggcttgcactgtgagtacccttagggctttcacagtgtgcctagttgttgtttagccccagctttacacatcagagatttcatgccacatccgcctttcccatatttagtgaatactgctgagcccaattaaaacatgtgttcatcgttaggatttatcagggcggaccgaggcacagctcgagcagcacgttaggagatggcatggccccatacaaggcggatggggatggaagctagcatcatcagtgttttggggggagtgtcatcggcagaaggggtggggggagagcggcgctggcagagaggggcttcagtagaggaagttgccggtggagaggagggaatgtgattttataaatgttcatgatttttgaggtgttcattgtaaaatattgaagttttcccctaaatcaacaaaatataaagagtaaaatagaaaataaaagggacttacatgcgaaattatttgagctactttgcactgtatataaaagggatgtgatcaaagtctacgagacacggcttagccgacctcttctcgcaacaatcagctgacagagtacaagcgctgcagaaacatactccacacaactagaaaagtcaatgtgacaccgtgacagcggtgacgtacgggggcgcgggtacgcgacgcgagacggcgagagggaagagcgcggcaaactcgcacaagctggcccgcttcctctgctagttcactcccgcgcgaccactcatggcgcgcatgcacgcaccatccagagaaaacccctcccagcctcagcgactacggcgacgagctgagagcacaaagaagaaccactcactgatcaaaccaacagatctgtctcttcagctta

SEQ ID NO: 18937 - DNA, 1501 bp, Oryza sativa
ggccgcctgcaaatttcgttgacggccgtcgcccgagagcgaacggccgtctgccacgtcattttcgccgccctctgggatggcgatttttaaaaatcgccctcccagagggcggtaggcgaccacttccgtcaattttcaaaatggaaaattatttttgtaaaacttttaataaaaaaaattaaaaataaaaaaaattctaggaactctatcaaaatcctgtctaaactctaaaccaaatcctggggttcttttcaaatcaaactactacatcaatctgtgtattatattatgttctaaataattacaatactgacattgttaggttataatcgagactacagagaacatgtacatatcagtattttttttatttgttactccctctgtgaaaaagaaaaaaaactcaattctatatttgaatctggacattgagattagttttttttataaagggagtatattttaatttttggatttaataaatcaagaaaatacgattgttgagactctgaaatgaggacaacagggcgtttagcaatttcgaatctgttaacaaatccatgtattatgtggtataggagatttagtcatgtttttataatagatatagttgcgtatgatttgtattagcaccattcatcatcccctgaaataaaaatagaggatttgcagatcaagagtttgcatgaatctttacctactttgaaccacccaagaaatctaataatgccgtcctgtctgttaacgttacgattgattgaactctggcaaagtcacaaccaaaattctgagaaagctcgttcctttcttacgtttggtctctcttatctctactactactgctcatcccgtttcatattataattcgttagatttttttcctggtcaaactttattaaatttgaccaagtttatagaaaattttgctacatctaaaatattatattagttttattaaatctaatattgaatatattttaatagtatatttgttttgtgttgaaaatactattatatttttctataatcttagttaatctttaaatttgactaggaaaaaaaatcaacgttaacgacttataatatgatgaaacagagcgagtacaataaaagaagagtcgtcctcctcctcttcgtcccgtgcttcccacatgttagaaagaaaaactgttgcctgctaagaacacgacaaagcggttccattttgtatgttttttttaaagagggcaatagctttgcctcatatatatatatatataaagcatggaattttgtatgggtaatttgctagtttagaatgaattaacgatgaaggttatattctagacgttctctgttgtatatatgtccatgaaaaaccttgtgtgttcgacaattctgttgcaataaggagccatgaacaaatgctctgttcgacatctgcacaattcgccttgaaattgcacaaaaatttcgtttttttttctggtcagagtgcatccatatgttcactgttctg

SEQ ID NO: 18938 - DNA, 1501 bp, Oryza sativa
tgggtggcacctcaacatggagcgccgcgccgccgccgccgccgcgcccgccgtgcaacacatgggacgctagctagcttcgaatcgtcgatcgatcacctctcgtattcggccggccttgtgaagaactatgtactgagcagtttttatgtgattagaacaattctacggtccttgagaaggtatcataaggtaccaaattttacattaaatttttggtacctcctagtatttagataccaagagatatcaaatctacgatagaaaaaaatgatacctcatgataccttctcaagaactataaaattactcatgtgattatatgcatgcatggtgcatattatgtgtgtacacgcatgcttatatgtggtagtagaaccgtaaaggagatcgcgcgagggtgtgtacagttgattgttttgatgtttttcttacaaaatatatattgccggccggcccatatatttccaataagaaggaatactccagaaattcgacagtgtgtgctgaaatgcgctgacacgccaaccctttaatcatgcgccgttgaacggtcattccatgccacagaccggaatttctactcttttgttaagttgcaggaaaaaaaattaaagctaggttactatacatgataatcaaaataaccgtacggtttttttaaactctgactgtctcacgacggaccggaccaccttttcgtattttctgtgcatctgtgaaactccgcctgttggcctgtggatcacagacacaagtggttaatttggcaggatgctagtctaatctagcaacacgattgtagtaaagtgtagtttttagcgttgtaacttgtaagcgccgagaatacgactttcatcagcaaaactggtttaacgagcttttatgtagtaaactcctttaaactctagtgaaattcggaccgccttctttcatgtattgtcccgacgaaaaaaagatgatgctagaaattctcatattgaaaacaagaattttacaagaaacgttaatttcctctcaaaattctcctgaaatattcattcattcaaaaggaggcatggaactgaagcaatataccttcaaatttttaataactttttaataaccttagaaaccgattttaagagcatagtagtatcaccgcgcataatatcttactacttctcagatgtatggtaacattgcataccaagagctagttggaagacataaaaataaactggatgacggttattagacaattctaactttccctctcaattcattcataaatctttgcattgcatcaaatagatgcagtatatatgtttgaatgtgtctattgtacgcacatgccgtcggtgatttgtaagtaatgtcttatctttcttgctgcctgacaacacacacagccgggtttcaagtcgggtttcagcggcacaactggtataatagttgtcagagaccttttacggtgtttgcgaggtacttgaaggtattgagaggtagaacaatgtgaacc

SEQ ID NO: 18939 - DNA, 1501 bp, Oryza sativa
tgaggccggcctcgaggagcttcacctggcggaactgccactggtggtactcctcgccgtcggcgaactccgccggcttcagttgccggaggagctcgagggggaggacgatggtgtcgggcctcctgccgacctgcccgacgacggcgcgcatcagcgtccgccgcagccgcgcgtcgctctgctcggtcacgcgcatctgctgccgcatgatctccgccgacgtcatcggccgccgcccacgccccggggacgccggccccgacgtctggctcagcgtgcgcaccatcatcggctgcgccaccatcgccgccgacgacgacgacagccgcctcgccttgagccccagcgccttcttgacgcggctgccgccgccgcccctcggcccggccaccggcgacgacacctctgctgcgccggcggtgttcccgccggaggaggagcggcaggacatgaagaagatctcgtaggcggtctcgcggagctcgacggggccgagcgcgtcgacgcgtccgaacgggcagccgacgtcggcggcggcggcgaagtcgagctcggtggcgtcggacgagggcgtcgcggaggaggtcaccgagagggagcccgaacgctggtggcgccccatctcgccgccgttccgggcggccgtggcgacgacggagcgagcgcgcgcgcagcgggcgacgtcgaggaggcaggagacgcgcggcgaccacgacagaagcggcccaaaaaggggagcccaaatggagctcaactatttcggtgccgggcttgcagctcaaccattgaattccagctcgtgttttatcaggctagcttatgctcccttggtcgttttatctttgatcaaagtaaaactgatccaagtttgatcaagtttgtaaaaaaaaaaagtaaaattttcaacccaaaacaaatatattataaaaatataaataatttaatgagtactatgtttgtttacaaacttagttaaacttaaaatagtttaactttgaccaaagtcaaaacgacttataatctgaaacaattataatctaaaacaaatgaagtactgtactaactaaccgattaatttgtaatttatttatgagttaacgatggcttgatcctcatatgtaatcaaaacatggttaataaccagagaaaaacatgaagtagatgaagggcaaatgtggatacattcacagatgggcagactttatagcttatggtcaatgccatcagtcaaatattgcactaactgggttagtttataaagtttcaacattgccagcgtatgtatgaagaaatatgtattactaagcatagatgtaattgcagagattacatgatttaacatgataaactggagatactggattgttcaattaacacaacggtgagcttcctattcaatcgctgtacatgaacaatggtaacctaggcaaatttgtcaattacggttctgtaaaaaaagaaaatgctatgtaaaaggctcacaggaaacgtcacctct

SEQ ID NO: 18940 - DNA, 1501 bp, Oryza sativa
tatgtcttgttctataatctatagagatcaccctgagtttgcaactttcaacctttagctttataattatatgcaaaatttgtagttgaaattcaccattgagagactattattgtggttgattttttttttacaacttagtttttccttcagttcattgggggtagtatgacgcgccatccttcagttcattgtaggatggtgaaaaaaaggcctagattctgatgttagacaatccataatcagataagggaatttggtaggagtacaatttactctgcaagaaacagagatttatgcttgctaatccctgtagatcattgagccatcactttcttttacagcagtaacttcactcaagaaaatgtttgccttttactgagtttttttgtcctcgcagtgcgaccatcgtcactgtcgacatgccccgcaagcgcatggctgaggccatctgcatgctccatgagctcaagctgttgtccgtctctggtacgggatggatattgctggtcaaggtagggctgatggttagggaggttggagccgagaccgagttaagtgtctgttcacgcatacctctaacttggttttgaaattaaaagtttgatctgaatgctgatattttggtagttgttttagtaatctaccttgctccttgttgtcttctaaagctccataagatgtagattgtaaagggcattttccaccccaaaagctagccattgaggtaaggggctcccccactaatatcttaggtcctttacccttccacaaccaatgtaggactattcaacaatctcccccttccacaaccaatgtgagactattcaacaatctcccccttcacacattggtgtccctcaacccttaactgtatacgggccctgcccacggtccatcaggtatacgagccccgcaagcacccacggtccatcaggtcttcacacactgtgtccatcgggccagagatgttaaactagccaggctcttataccaattataggatcgtaaagggtctttcccacctcaaaagctagccattgaggtaaggggctcccccaattatatcttaggacatttgcccttccacaaccaatgtgaaactattcaacataagatagtattataaagtttataagagtgttgaaccaaaggtctttccagtttccctcatgacaaagtacatatttctccgtggtttattccaccgagtattaactaacattgtaaagccaaagttataaattaaaatgtactcttagttctgaaacataatgatatgtttggctgtatgacgtaattgagtttgaaccgtaattgagttaacatattaatattaactagttatgttctcaaccgtaattgagtttgaaccgtaattggttctcataatgacgttctgaaaatgtatctactctattcaaactcaattacggttgagaatgtcatatgttctggatccaaccttacctacgctttcttgttttgttcatgcagattt

SEQ ID NO: 18941 - DNA, 1501 bp, Oryza sativa
caccagtcgtctaatagtcagatgcgtgtgcagaagaccatgccaatagtgaatacgctagtggaagaggatgactgaaaattttatgtacagaacttaccgagtataggatggcaagcaagctgatgtcgaatcttagcttccatttggagaagtcgcgctctgcgaccacggcgacgacaaacgactgcaccgtgctgaacaagcattgagtcaaagtcacaatcattttatctggatattccttttgcaccgctgcctgcacagtcaatagacaaggagtggagacctcgattcatcagcaattgcagatgtggatcgatgcagacaagcatgcaagaacagctcagattttttttaaataactaaatatgcatgcgaacctgaaaaatgatccacaaagaccagcacatgttggcgatcaccataaggaatgtccatttgatccacacacccctcggaactacatttttagagcctgcgtcagaggcgaaggcacggtgatggttgatagggcttatggatgggccggtgaagaaggcgatggtgaagactccagccaggcagagtgctacgctagtgaccttggctatgcctgaagagctcctcagcttcacatactccgtcctggcaagcaacatttcaatcctggtattatatactactccatccattcaaattatgtgtgtcgatatagtgtatatctaaatatgtatatcaaaatttatgattaatgtcaaaacatcttataattaatgttttcacaactaacttgaatctatttatggtacattctcaagttaggctttaatgatgtctcgtttagagcaaaaataatagtgagctataagcaagctatatgcttatgtggaagagaaggataaacaaaagtggggagtgttggctctcatgtaagagctaactgcacacaagctccaagaaacatgcattaaattcataggagagaaaaagaccggatgaaaaaaataaagataaccttatagttaacctattatacatgttagctttcacaatgactaatagtaagtagtgagctctactattaaacttgctcttaagaggtggtggactatgatatcgatgatgataaacctcaaaagcactgccaagaagaaggtgatggctgggagtgagctgtctactgcagatgccaccgttgcagaggtgaacttgaggcttacatggtacagatttaccccaagcgtaatcctgaaaagcaatttccgcaggtaaaccagcagagactaattaaactcttgacatatcatgagtatacaatcgatcgttttttttgttttgtttttgtatcaataaattagagattgcaaagatgagtgcatacccgattaaggcacaaaagaagagctttatgagcaccccaagtgtcatgacctgtcgtgcacttttcctacaaatataatcaaacggacttctatttctcagcaaatcaaacaatatagcaaactaaacgaagtggcga

SEQ ID NO: 18942 - DNA, 448 bp, Oryza sativa
ctttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattgttatcgagaatatattttattggtttactacgtgtccactttctctcaccatgcatgcataaaaatagatcgatctgcaaatctttatctgatatgatcatatgtctataagctacaaagagggtcaatcccggttaggaagggcccaatggagggtccccaaccagctctggattttcagca

SEQ ID NO: 18943 - DNA, 1501 bp, Oryza sativa
atcatcatgtatgtgtagtgcgggacggccatgaacttggctaacgccgggcgtccgagtatggcatggtatgctgtctcgaaatcggcaacttcaaagctgatattctctgtgcggaagttttcccgagtaccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccagggggccgccaaagatatggttgagctccttgcggtggtcttgaaatccagccggggtgtcgccgtcgtccttcttccttgacgtgctttgttccttgtcggagttcttccgggtagacttggtgtactgctccgcgaactgcttgtagatgaagcattctttggccacgtggttggaatttggatgatgcgggcattgggagttcatgatcttgtcgaaggtgttgacgcgcgaacgctgtcgagaagagtgagtagcggttgcaacaagttcctcaggcttacgcttgcggtccttatgattgttacttccacctcctcccgtagccggcgtatttttcggcttccaactgggcccgactgctttgatgcggtgacggcgtcttcagctttggcgtactcgttggctttttcaaacatgagcttgactgttctgggaggtttgcgcccaaatttgccgaccaattcttcgtggcgaatccctttggtgaatgcggcgatgatgacgtcgtcagtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgctaaagccaccggtagatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtatgattgtgtcgcgaagatcgatggggcggcg

SEQ ID NO: 18944 - DNA, 1501 bp, Oryza sativa
acagcctttcaacacgctgctgaaactcatgaaacttggaaaacacctcagacttgttctttaagagataaatccaagtaaatttactgaaatcatctatgaaactgacataatacttcctactctcaacagacacaggagcaggtccccacacatctgaaaacacaagctctaaaggatgacttgacacactagaggacttgggatagggaagctgatgacccttggcctgttgacaggcatcacacactcctaattcattaatctctcctaaacatgggagtttattattgctaataatcttttgaacaatagctagagatgggtgacccagacgactgtgctacctcgaataggtaggcttgacgactccgaggacttgcttggatgaggaaaacgaagatgttggcaaagggtacaatccattgcggcatggccatctaagaagaagattcctcgtgacctgatccttgatagcaaagaaacgtgagtgaacttcaacaaaagcgttattatcaacagctaggcgatgagcagatatgagattctttttaacttttcgaacatggaggatatttttgagatgaatattgcggacaggggtatgaataatagaatgaccaacatgcttaatatccatacctgcaccgctcgccgtatgaatttgttccttgccattgtacttttcatgagtcgtcaatttttccagcttgcctgtgatatgatctgtagctcccgtgtccatgtaccaatttgtatctacaccataggatgccacagcagctattctggagtctggaacaaaattttcaacgtacctgtgccaacaatcggccaccacatgaccggtttttccacagagttggcagatggggcgtggtctgttgctgaagccacgtgcgcctccgtttcctcggccccgaccgccgcgatcgccacggccgccgccaccgcgcccgcgagatacgttagcgatattgttgttgaagccggtgttgttgttgaagtttgtggagattatgggtatcccatatctacacggcgacggtattcgaactgggtacaagatacctaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccgtatataaggggggtccggagcgcctctaggggcagatgttgatttttcccgaatcatacaattaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 18945 - DNA, 1074 bp, Oryza sativa
aacgaaacacgaacgaacgtgaatgcacttgtactaaaaatgtgagaacgaacgggagcgaaacgtgtacgaacgagataattaaacgattattaaacctagcatatatatatatatatatacgattatatatatagttgaaaacgtgaaatacgatatatgttcctttgcgtttagactaatacattttcctagtaatgttatagaaaagacgtcgtcgtcgtccctcaagccgaagtggtagctagccatcgaaggaattcgcgcaggcaagtgatgtaaataagtgattgttagagatttaatataagattattagagttttaatataagattattagattattagcatatgtgagtgttagattattagacttagcatatgtgaatgttagagattcgtgatagacttagcatattgtattagacttagcaaatgtgagtgtcagagattattagattattagacttagcaaatgtgagtattagagattattagattattagacttatcatattgtattagagatttaatataagattgttagacttagcatatatgattattacaattttaatataagattagtagagatttaatataagattgttagacttagcatatatgattattacaattttaatataagattagtagagatttaatataagattgttagacttagcacatatgattattacaattttaatataagattaatagagatttaatataagattgttagacttagcatatatgattattacaattttaatataagattagtaaagatttagtataagattgttagacttagcatatagattattacaattttaatataagattagtagagatttaatataagattgttagacttagcatatatgattattacaattttaatataagtttagtagagatttaatataagattgttagacttagcatatatgattattacaattttaatataagattattagagatttaatataagattagtagagttttaatattacgcttagcaaatatgacctatagacttagcaaatatttcttgtacgaacaga

SEQ ID NO: 18946 - DNA, 1159 bp, Oryza sativa
ttgtaaccgactaagtctagggtgtttccttgatacacaagttaagaaacaaacccgagatacagataagatattctatctacattaggtatcttgtacccagttcgaataccgtcgccgtgtagatatgggatacccataatctccacagtagcccccgagtcctttgcagtcgaccatcgtagccttcccaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccgcaataaaagaaatccgagtggtttacactctaaaaggttcacgaatgaacacactcgacaggcatccgaatataaaaactctaaagattacccatcaagtattataaagatcatggtaataataagtcgaatagcctaggccatgactatttaccatgaaaacaggcatataacacgccaaggagatgactataataaaaacaagtcattcctagttaacccaaacagcttttgtagcctaaaaaagctcgcaaaaacagcataacgcctttctgtcgggcacctttttaatttgcattgcaataattccaaagaattatatgaccgcataaaaaggatttcatcagcattgggcaacactgttgtgtgcataatatcgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcgaatcaaatcagcacatttgagtgaaaccga

SEQ ID NO: 18947 - DNA, 177 bp, Oryza sativa
gagaagtcatgcttcgaaattcccttctttctctatcttgtaatcggctttcatgagctgatactgatgtgctccaccatgctgaaactgatacgcttgccccccgagccgatattattgttcctccgttaaattctccaccgtgaccacaatcttggcattgacttcttcttcaga

SEQ ID NO: 18948 - DNA, 1501 bp, Oryza sativa
ctaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttgttgccgctggagttaatgctgaagtgaggcgccgccgccgttgacctcccatcgacgctgccgtcgagccgtggtgggaggatgatgggtcattggttgcctactatcggattaatctccgccgagacgatatggccggatgcaatttgtttgctgttgttggggtctcagttgctgtaacgccccgacattcgttagccataaacacagctaattcacaccgaggtgttatgcattacctgtgatatagtaccagtcccaggatacactagcttttacacgcagaataactgtggaatcaaagaaaactgttttattacatcactgggtagtagtccttacataagttgccaccatggacaggtccatagatgagcaacacaacattacagaaaaccataaaagcgacgacgcagaagcgaacagcgcggagaactaagcgactagcgaatagcgcggagaactaagcgactaagcgactatgcactaggcaaagaacctaggcaactaacttattccacaggcgagctttggggctaggcacgaaacatctagaagtctgttgacggttcttaaatcataatatctgaccgtcattacctacatataatgaaataaaacatggtatccaacttagtggtaggtattattactaatcatttccactagtgttggtgaaatatgtgtatgcaggtattttgagaagaaaacacatccgtcaagcaacaaactgcacctccgcgcattcaggatacatttacacggattggaggccccataagtcaagtaaacaactccaaatgggcccaactatcatgccaataggctgagggtctcaaaattagtgtccacgataaaaaatgggccgaacggagccgtctcgagttcggcccgaacactttttgtggccgttgatcgtgagattcgatgtggatggccctgatctcttcctaatgatggttggagggtagtttggtcgtttcccatacctgtaaccgtcatatgg

SEQ ID NO: 18949 - DNA, 1501 bp, Oryza sativa
accattgcacatcaccacctcattatctcaataatgaccctaaaaatccgaacaacattcgcgacttttacttagtgattcggttcagcctcaattgcatttccatttgacccgatttgagcatcgcatgctcatgccatggactttttccagatccgggttctctcacagagaatcattagcaagaggcgacacatttattcccacttacacatttaaccagatcttcgtcatttcccaaaacgatcgatccatggttgttccatattcctagcaccataatatgtgcgaattgctaggaatgtcgtctccacgacgaacatcattatgaggtatatcaccttccgaaggtgaattctccactaggagaatcagaggagtatgctcacatccggtgagaactcttatgctctgactaaggcccacggatcgtgttagcaggcgtcctcacataacatgatcaaattccataagtcttatatggatacgatattattcccgggtctatccacatttaccataattgggagcattactctttttaacaactatccagttgttcctcatatgattttgttggcaaaaactccgtgcaccaagcaaccaggagtatgaactaaacatacaaattcagctcatttagtgcgttcactcaaagaaatgtacatgcattccaaaatgggcaattctctccccctaatgccgagatatcttacaatagcatactaccaatccccatatcgtggcataggatttaggaatttcacctcgatcacaaatgttctcccatgaatgtatgctacggtggcgatatatttgggaaatattatgcactttaatcggagagatttttgcattaaagtgagcctggatatataccaatacagtggcatgactacagtgttcttccttcctccgaagggttatcctcaacctcctagttaggatatacaagtctgcaaaaaccactattgctaccaaatgtatatgcaaccaacatgcaaatactttagccatatgcaatctccatggattaatgctcaccttgtgccattcaaactcacaatcgattccggatcgacgtgcattagacatcccatgtcatatgcttaagaaggcaacctatggtggcaaaacgcattccgatgcgctcgacaaggagtatgatagcaaaaatgcacggccactagcctacgctgccaagcagatttttgtggtgcagagttgggttaatgtccagtttgtttaatgcccaagtttgaccccaattactcataccaaactctagaattgggttatagttaagcagcatgtattaggtatgatgcacgagcgaattatcaaaccacatttgctaatatcccctagacatagccattgggagataatcaatacctccaacaatggtaatattcacaataaaaccattatattcagacatatccacaaaaatagtagaatgtgtcggtgcaaccgtcgttggcataacaagctcaacgca

SEQ ID NO: 18950 - DNA, 485 bp, Oryza sativa
caaatgtgagttattagctgacttgggtgaactttatgcaaacccccagtcgcattttgacatattctttgtacaaagaaagccacaaagctcccaattctgcagtgtacatccataaacgctgtattgtctgaacaaattacagcgtcatgaaacagtgactctttgttcctaaacactgaactgtggataaagtgtaacaaaggcgtcaagtaaaagcatttgttagaattcctccgtttcaaataaatcatcgtttgttggtttgtcctaaattaaacatgttgaccgttagtttgtaaaaatatgtatatagtttaacatatggatcatatactatgaaaccatttttagtaagaacttgaaaagtttataatgttgacacctataagtgcacacaacgcataggctgcttaaagttcattttcagaaaaaggatgatactaatgtaccgtgaatgcacagaaattgccatcagtaaatgc

SEQ ID NO: 18951 - DNA, 1501 bp, Oryza sativa
aaggtaataaccaccaaaataggcttaagaatcacaaactgcaaacagccttgtttgcatctccgaataaaacgcctgtccaataacataattttaatcagcacttgcatagatatgacatactctctgaatgttactgtgcaactgcatgttgaagcattagattgttacaataagcacttaatatgtgcaaaagatatgtacgcacccatctagaggaatagctggaaaacagcaagtcatcagaaaccacgatggcttcagggttcgcccattcaaacttaccaccacagcaccaggacctccaacccatgccaagcaaagtgaaaagaaattgtagatgacccaagcatcataactgaaaaacaatcagagagattttaacattagtcggatatgcatttattggttcagatcctaaaacacaagtgcagtaaaaaaaattcaaaacgtggaaaaaaaaagtatcgacgatcgcataaaacattgataggaggctatgtgccttacgcccttaacaagcacagacaagaaaacagcaatagaatcatatccttggtcatggcatcaaattattcatagaatttataaaccagcagttctgtaagaatgaaggccatgtccattacaataacttattagcatttccattacaataacttattagcatactgtgtcagattatgatgattttgtagttatatagaagtggtgatcattcaatgcgctttctcccccttgttttcttcatgtgtgttgttggtcttagtaagacactcaagattaacagtgacaatagtcttcatatatcaagtgtatttaacatctgaaatcatggttcatgggctgatggattaaaacgacatctagaaatatgaatgcatgtgatgtggcgcaaatggcataatagatcttctctacactagtgattgctgaggcttatcaacacagtagctaaacgtaaacacaacacatatgaagacatgggcagtgtaccaatgttgtcatgatgatattgctagtatatacttcctccgtttcgcaatgtaagtcattctaacattttccacattcatattgatgttaatgaatctagatagatatatatgtctcattaacatcaatatgaatgtgggaaatgctagaatgacttacattgtgaaacggagggagtataaatcaggtgatagcaaaagaagtgcatcagagctagaatgtgacatggtgcaccagcaatatcaacaatgctggcacagatgtcaaatcatactaacgtgtggcaacaaaagaaaagttgtgcccattggcaattagagaatgccaaaagaaagtttttatggcagttcttatatttgctgcttgtctagtgtctacaacataactttaagatcattggagatacaagattacatgttcagctcccaacaagtgagcagaaaacaggaaccacaatccaaaagaacagttagttcacattaaggggcaagattataagattgac

SEQ ID NO: 18952 - DNA, 1501 bp, Oryza sativa
ttttctcaagtactataaaattgctatgtttctatatcaatttttttatacggtaagtttctaggtagatagttcacgtagaaagtttctatgcctaggtgggtttgtctttcttttcttttattgaacttgccttttgaacttattttaaattaacgttcataaaattctctactgcggatatttctatgtagaaacttttgagtcaataagaaggaacacatcccgaagtggaaaaaaggaccttaaggccctggtcgattaatcccaaaggaaaagggatgagagaggatttattccacatatattatgatgtggaattattctcatttaatctcctccaaacaagatctagggactaaactttaattcatgtcacatcagatgtttgaacattaatttagactattaaacatagactatttacaaaactaattgcataaataagagcttatctacgaaacaaattttttaagcctaattaatccataataagggaatgcctactggcatcacatagactaatcatggattaattagattcaatatattcgtctcgtgaattagtccaaggttatggaataggttttgtcattattctacgtttaatatttctaattagtgtccaaacatccgatgtgacaggaaaaaaaaaatttttagccccatcaaaactcgcccaagagaaaacgaacgtggactcgatgcacgtgtggagtgaacctgtcggaatgcgtttttgcgtggactgaaaacgcacccacgctcacccgcaccattagacgcgcacccccaacaattcacatcatggctcgcttgtccatgcccatacacgttgaaagccaccagctcgtccaccgtggcaatatcctctaaaattgctcaacgtgaacttgccacaggtgaggtgagcatgcgcgcgccacggccgcggcggtggccggccgacggcgacacgttgtgctagatgaggtggtgcatgacatccacggcttcaacagttcaacttccggagttgaactgtgcaaaaaatccgactcaggaatgcaggattgtccaagcacacacaaacaatctccaaaaatccaaatgaatcggtcgcatttcaactaattaaggctgcgtctagttggatccaaagtttggattttgattaaaattggagatgacgtgactgaaaagttatgtgtgtatggcaggttgatgtgatggaaaatgactgaagtttagatccaaacacagcctaaactgttttgacttgaattttcgacgagtgtcctgcatgcacatgcgtgaacacctcagttggagttgggtcactccgattgaaccagcaattggggccaagtggccaacgttgattgcatcagtgggcacacgatgacttcgttgcttctactgtgcagcgagtgatatatatgcgcgtgatatatatgcgcgcgtgcggctgacttccttgcttctactgtgcagcgagtgaattagagcagctagaatagta

SEQ ID NO: 18953 - DNA, 1501 bp, Oryza sativa
tgagctggacagtcgccaatgagctgaaaatctgattagctcattgaggatcaattaaatatcgtaggatataaagttaacaaatagtttagacaaagttgaataaaataacggtgaggtgcaaagtttgttgagaaatcgtaaaaagataaattttcacgggtggagcagaagtattgggccattggaggaatcaggcccgctacgtatattggcctttttctgaagcccaatttccttttctgcttgtggagttctaggattccggagttctataccgaatacggtccatttcggtccgtccttatgtgtaggcgggcagcctagtacaaattttaggcccgtacacgtagaatggtctatatttagacctatctgaacaaaaccttagggatgttagcaaactatgacctcccaaccaaaccgattctcttgttttcaaataaccttaatttaatttacagtgaggaaatcagtaaaaatatgttcgcaatcatttaaaatttacaatattctaatgtgtttggtgctagaatatatttaagaattaaaggtagcgatgatggtagagttcttacaagggctcctttggattgaataaatttcataagaattttaaaggattttattacttagaaattttattatcaagtcatttgaaacaaaagaataagatagtacaaaatctaatggattggatacctaaacatcatttcataagaaaatgcttgttcggctatgctacatcatagccaagccaggttgcaatgcagcgacgataaattgcagccaaacaatactaaaattccaatgtacttgaaatcctttgtttggatttcatgcttctccttgaagtccattgcacactgtttttcctctctcaactatttatttcttccacaaataaatttttgtgtgttatttcctgtgagctatccaaaattaccatctctaattcttacatttcaaacctcccgtaaactttttgtagcgtatgacaatgttattcatgtgtgcggttttttatagcatgttcaagaaaaaaaaccttaaatgatcgaactaacacaccaacaattatagatatagctcattttttttatcactaataagatattaaaccactcaaaagcagactgtagacataccatatacttgcagaccatgaataatttgcagacttaatattatccaagaagataggagtatgacactaagcctgagatatttcaaaagagagccctggaccctggtatgatagcagcagaagagtacaaggcagagacagataggctctctgtgctagtggttcttgtgaacgagaggcctcctcgtcgacccgcaaaaacccttctcccccaaacccttccccgtccccctatccaatgctacccccaccccgccatataaaccctcgccttcctaccacctcaagaccagccgctcgtttcatttcttatcacttcccccctctctctctctctcccccctcctcctttct

SEQ ID NO: 18954 - DNA, 1501 bp, Oryza sativa
ggtcgaaaacacgaatcactcggtttttttaggctaagttcaaaaaaaatcaaactagattttaaatctccaacggaatttttctgtattttatcggttttttcgacgggtttcgtaaaatccgatgatatcgctcgtgaacggatttcgatccggtatcaagaatgtgaacttcggcgtcatgatcggtccggcgttcagctcactggccaccgccgtcgacgcgactccatggccgcgccatgggcgatgatgctttcctcttctccctctctatttttaggctttggaaggcaaagtgtgtgcaaagttgaggttgatccgggcgtgacgtgcgtgccatggcatgaccaaaaaccacatccagtcacgtggctcaaaatgcacggttttttgcaggcagcatgtgagcgtgtctgccggcgctcttttgctgtgtccaaatcctaacgacacagccacccgcgctcgtgtgcaaacttagtttttgattcctccccaaagtttgttgccttagctacaataataaatatccagaaagcacgaattatgttctaccaataccattaccaatatctactacggatattggtaataacacccttgaatattaataagctacttttttcgtttcagattataagttgtttcgactttcatcaaagttaaattatttcaagtttgattaagtttatatttttaacccaaaacaaatatattataaaaatacattcaattattaatttaataaaattaattgttatgataaatattattatatttatctaccaactcagttaaactcgaaatagtttgattttgaccaaagtgaaaaacgacttacaatctaaaatagatggaatattagtcctttatgatttttctactaagtagctcggtggtctctactggtagagctgatcactgtactattttccaaaagtataatagtactccctccgtttcaaaatgtttgacaccattgactttttagtatgtgtttgaccattcgtcttattcaaaaaatttaagtaattatttattctttttatattatttgatttattgttaaatatactttcatgtacacatataattttacatatttaacaaatttttttaataagacgaacggtcaaatatgtgctaaaaagtcaacggtgtcaaatattttaaaacggagggagtattttttttagaagctagagtccaagcgtttaaggctctcgccgagcagtccatctcccacttgtgcggtgtgttgacgaaattcactgacaggggagcatggggtgtgtgcttatataaacacggacactcgatttagctaatagctagctggagctcgatcctgaagagcagtatcagtgctcagctcactgttcatcatcaccctcacctcttctctctccctcccttaccttcctccatagacgactgcagctagctcgatcggagatcgaggccatgtccatggcggcggagagggtggaggctgccg

SEQ ID NO: 18955 - DNA, 1501 bp, Oryza sativa
acttggctgcgttcttaatgagcttagagactaggttactcaatcgtttacagagagcacgtttttcgaactaatacacgatatattttgtgtaaaaaatatataaaaaattattaaaatgaaacaaaaatattttttaatatataatagttaatacttacatgattaatggttatactccttccggactgataatacttgtcgttttaaataagtgtgaggtcaatctttaaaatctttaattatggatcatttttaaaatatttatctttcaaatatggtgactacatgtatagattagtcttaaaaagtactttaataaaatcatatatttgttaacacttttatacatattataatgaaaataatggtcaaagttgtttttttgagatcgtgctcttgtccaaaataacaaatattatcaacccagagaaagaactcgttacccatgccagaataagttgagtcagaaacgaacgaagcatttgacagaaccatagtgaagttccgctaacctgaacattagacagtcttggaaaacaaagacatactgaggccctcacataccaatggtgtttcatttgatccatcaaaagttcatgtaagaagcattccatttccatcacaaaccacacaaactattgaattaaatttatgtggacttttcatttgcctttgaggcatgctatggctgtgtttagatccaaagtttagatccaaactttagtccttttccatcatatcaacctgtcatacacacgtaacttttcagtcacatcatctctaatttcaagtaaaatctaaactttgtactgaactaaacacagccctatatccatgatgctgcagtgcgaagaatccaaaaggacattttgggtggagaggagcagaagagtacagaagggacattcatgtcattcaggtcaacgactctctgctcccatccatccaacggaagcccacctccgtacggtttacataaacaaacgcatcaaagacctaattacacactgggttggtcatgtaattctcccccacaatatactaacctagtactccttttgtaacttgcaaaattttgattgtattagagttgcgacaaaaaatgtcaatatttttcctatctaataaaattacccttgattaactaaaaaaagaaaaatacccttaagcgtgcatccttttcattgacagcaccggcatgtatggtttatgatatgcagttacttgtacatcacaaaccggcactattccctccatacgcaacaaggatttccccccccccctagcagtagaaaactcaagctacaaactaccaggtatttcataaagtgcataattgtccatgtaaaccttgcttagctgaacaaatccaatccaaagcaagcaaaaccattaatcaaatcaatcaattaaaaaaatcaattaatcaattaattataattaatccgcccataaatcagaatgcaagcagagagagagagagaggaagtccaatgaa

SEQ ID NO: 18956 - DNA, 1501 bp, Oryza sativa
aaattttctataaacttggtcaaatttaataaagtttgaccaggaaaaaaatctaacgaattataatatgaaacgggatgagcagtagtagtagagataagagagaccaaacgtaagaaaggaacgagctttctcagaattttggttgtgactttgccagagttcaatcaatcgtaacgttaacagacaggacggcattattagatttcttgggtggttcaaagtaggtaaagattcatgcaaactcttgatctgcaaatcctctatttttatttcaggggatgatgaatggtgctaatacaaatcatacgcaactatatctattataaaaacatgactaaatctcctataccacataatacatggatttgttaacagattcgaaattgctaaacgccctgttgtcctcatttcagagtctcaacaatcgtattttcttgatttattaaatccaaaaattaaaatatactccctttataaaaaaaactaatctcaatgtccagattcaaatatagaattgagttttttttctttttcacagagggagtaacaaataaaaaaaatactgatatgtacatgttctctgtagtctcgattataacctaacaatgtcagtattgtaattatttagaacataatataatacacagattgatgtagtagtttgatttgaaaagaaccccaggatttggtttagagtttagacaggattttgatagagttcctagaattttttttatttttaattttttttattaaaagttttacaaaaataattttccattttgaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaacgaaagagagagagaggggagggcagcagaaggggagtggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgatttcatcaggcacaa

SEQ ID NO: 18957 - DNA, 1501 bp, Oryza sativa
gaacctaacagagacaaaatttgaatccaaaagctgggaaataaacagcccagtttgaattcatgatgaggacaatagctcactttgtgagtgcagattgacaaagtccactactgtgtacttttaaggttagctgctatctgctttagaagttgtaaagatgtcagtgctgctaatcttctcagggagctgccatggtaggatgtacacctgaaatatgaaaaaaaggaagagctaacagtggtagtcagggtttataatactacgctattacctcacgattaccgtggtaaccatctcagtttttcgtggtaaccatctcagtttttaaaaccttagggtttttctcggtaaccctacgcttttgctcgactacaaccggggttcccctaccatttttgtagtagacagaaaaaatgtacgagctgtccgttcatctcttcctccctaactttgtttctcatcttttgggtttccaattagtggcggatttaggccatttctgtgggatcggctgaccccacggctttttgaaaaacaccatataaatctcgatttcatgtataaattcaaaaaaattagagaaataacccacttaaatataaatcattagtaattgaccccccaggtataaaattctggctctgccactgcttgcaatggagcaaattttgccaaatcatttctccattctcgtttcatttactaatcctacctaatgaataatgatacatgaatgtaatgcacccgttcgtgcagacacagtaccaccatgacctgtcttaagtactcctatatgtaagttaaattgaagataaacatgtatagtttgggcgcttcacatggctctcatttatgatgcagcagcgacagcagcaataacagagatagagatgaatgcccttcaacatgatatactgctagcgctccttcatccacgggtttcatggaccaggagattgattactattcgcaatttttgcctctttttttttttctaatccaaattctaaatccgctaggcttcgtctggaacgtgcgaaatttttaacgatttttgtgagagataagctgatatgtgccgcaaatcctacgaagttatttcctgccagattttggcattccagaacattccagcatggcagtatgaactagcactagcaggatgcagtcttaaaaaaaatactactatataaaatacagtattagttaataataattgttccatggtaaacaaactgcgctaaaatattagtagacaaatattgcaattgataatgaaggaaattgattgctgcaaggaaaacaaagaggtgcatctgtactatttagcaatttagaatatatatattaaaaaaaagaagggatttcactgtcatatagaagtactctgcgatttgatgatgctcaatggaagtccaaaacagaataatgttaactttaagaaatagaaaactggtatatttttccttgttatctttggtattttctgatacaactg

SEQ ID NO: 18958 - DNA, 1501 bp, Oryza sativa
tccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcggcggcggcgaagtcggccgattcgccatgctccggctcgaagaggaaggcggacgacggcgcggatcacccggaggcgccgcccagcgcgcggccgcggcaagaggaggccgggagcgagcagccggcgatcctgccggagttggacctggatgcgttgctgtcggcgccgatggacgacagtttgggagtggaattcgacacggccacgacggagcagtacatgaggtatctgatgaacgacgagccattgccgtgggctccgacgatggaggttgccggcggcggagacgaattcatcgagacgacgaacggaccttgcatgggcgaagaggagatcatccagcggctggcttccggagaaaccctcgacgacattcttggctcgaaccctaattaaatgaaacaagtttttgattgaggtgtagtgagcggctgtagcactaagtagtgcagtgtttttcgtcagagaacaggtttagttagacatgtactatgtactacgtatcaatcaattagttaggtgtttgtttgatcaactgagatgcatgaagatatgcattgctcgattgatcatctcgatcgatcgatctgtaataactaatgagaagagttgaatcgattctttctgtaaagtctgatgtaataatgcccttctgtgaagtgaactaacgaaattcatcttcatcagagagattcagagtgattctctttttgtatcttttgcgagtattcatcagagtgatttgttctggcgtttgggcaaaatctggtttgatatcgctgtgtcgatggctgtatcattgtgcgctaaatctaaatgggccaaattgggaagttggctcgtggtggtaggcccaaccacgcggcatcccctccattatgggccctacccgcggcatctcctcgtggacataggcctggcccatcacgtactcgggggctgtgtataaattattttttaacgcggggtcttgttgtaagtttgccaaatcagcttaaaatgcaaagggtggataggataaggcaaagccattgggctcgtcggagagacaagtagagagcagcgtagtcgccgcacttagccatgc

SEQ ID NO: 18959 - DNA, 1501 bp, Oryza sativa
ttttgaaattaattgagaggagggaggaaaaacagacgctgggccggcggcccgaaggagcagcgggcgccaaactttcagtgtggcgggatgttgatcaaaatttcaacgtgaaatgaccattttgtccagatattttagtggtaacttcggatgcaccatgggtattttagtaaaatcgcattggttcctcaaccctagccgatccaaatcagataagccgccaccacacgcgaggcgctactgcagatgagaccgccggcctctgtctccgccgctgctgggcgccggcctccgtctccgccgccgccgggcgccgctcaccgcgccggcttcctcccccttcgccgcttgccgtgccggcatccgtctccaccgctgccaggcgcgggagcggtggatccgctgccgccggcgcctctcgggcccggagggggcgtgcagcgcagcatccggggcagccaccggtgacgtgaatcgaggtggaagaagcaccggcgagggagagctccgacgagtcctcctcctcctccttctccggcagcaggtcagggcgcagatcccctcccagtagcgcgcctgcttcctacatctcgcgagctccgtccatcgagaggctgctcgaggaggacgacgcactgctgcacgcgtgagcatagggagcacggcaggcgatcatggtgggcgaggacggtttgacacggatgaaaaagaagaggagaggcgccagtctttctatctttgtttcttgcattagttttcttggcgagttttgacgcatgtgcctcacccatgtgcaggagggcggaggcgggatctgctactgtgagagggactggtgattggtgaagcgccccaacttcgactgcgagcgaccgcatcccaactgtaaccaatctctctctatccgctgatgctagttgcttatcaaagttcctgaatctgatgaatgcagaaacctctaatttagttaagcaagtcaattcatgctgtaacaatatgatctctgacaaaaaactgaattccttgtttctgcaaatgcaagtgcagtcataaataagaaagaatattcgtgaaagtttcatagaaactagataaaaaaaagaaagtgttttagataaaaaaagaatgtgtttattttcagaaatccacagttgctatattttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatcctttttttttaagttcaacactgtacacatttgctggacataatgcatatatgttgttttcagcgtgacaaatacaatgaagaagaacctaatgcatttgatttgttcaaggagttccactacagcaagaaaaaaaaatgctacaccactgctgtacaataggctattgtaagataagtttcaaactttg

SEQ ID NO: 18960 - DNA, 1501 bp, Oryza sativa
cgctagtctttggagatgaatggatgagaagaaatttagggatatgatgttgtgtacttaggggtattttgtcaatttggcgtataaatagtttttttaaatgaaatcttaacagtgtttgcaaataaggtcaaacgacaacttcaattttaaaaaatatggtcaagtgagtaaacttaaaaaaatagagacaacgaggtttaaataagcaattgtctgttaaagtttccctgtctttcccattgatgaagatgacagcggcaaccaagctgcagtttgccggcttgcagcctctcggatggctgatggacggttgagatgaaggcattgtaggcaagggccaatcctgtccaacccggctccgacacgtgccgttgccagtttgccacacctcgtcgaggcgaatcccccgcctttgtgattcgaaccgctttttgggatcattcgaatccaatccaatcaatcgaatgctgcaagaaaatccaacgcgcgccaccgacacacgcgacgaccacctctctacctcgccgcatccttcgatcccctcctctttcactggtgcccagcgctcgcccgtctccacccaactgaacttgacttgcgccgccgccgccgcggggaagcctccgaataaactcgcagccgcggggcctctccggcgatgctcggggctgcccagggaggatactaggggcggatttcgagggcgacacggggggtgtcgcttgctccggtccgagtccgacgctgctgagccatccacggacctcaaccctaggtatcgctttatcgaatgagcgttcattcgcctctcctttctctgtccctttttttttgggatctagatggggccatggtttgctctgtttctgtttttttttttttggttctaaaaaattcgtcacgggctcatggctagacgtacggggtgttgtggtgtattttggatagccgaacagcacgaattctcaattggctagattacggttggattcctgaatagccgacctgcaatttgggtggattaggtttggttcctggatagcctacctgggatgggttaagcttagattctgtggaagtagaattttggttgattatcaggggcttagagttgaattcagtgaggaattttcgttttcttagatttaggcgtattatgatttagggaggtttcgtgaggaatgggatttttattttgctggttactgtttgatttcggtaggaatttgaagttgaggtgattgtggttgcaaaagagagagaatctggatgtgtgccatctttctattatttaggtcgttgattgcttaagtttcaatctaatgctaaatttattgtattaccattctataacttttgtctaacacccctggtttaaaattttcatgtggaacctgctatggattggttgggatattttcatgagatctcttcatcaaagcatgatctgtgctgttattacaatataaatggtgcacgttgctcttgtttacactta

SEQ ID NO: 18961 - DNA, 1501 bp, Oryza sativa
gaacgctgcctaagtgaagaaaaagtacataagcaaagaggaattacactgtgtcgaaacaagatttcggcaataataaaagggggtggctatcaagctaggaaagtggatgggtttgaagacaaggaattttatacaggttcaggccttcttattcaagaagtaataccctactcctgtccggggatgattccgccgagtgtgttattgattgtataattgggaaaaaagaatcgtgccccaagaggcacacggaccctccttatacaggggaagggatccgtaatacaaagtacaacccatatcctaacggaatatgggattacagataaaacacaatcgtaaccgactaggatcccgggtattttcttgacatacaagtttagaatctaacccgagtcctcgtaaaaatattttatctatatttggtaccgtatatccagctggaatataaccgccatgtagatatggggtaaccataatctccacagtagcccccgagaccttcacagttgaccaaaatagtcttctcgaaacaaaaacaataatccgagtgctttaattcaacttgctccggcttgccgagtgctaaaagactgtaaagggcgaaaataaaacatggtgcatcgagtagatgcacctaattaggtgtagcccctgactatgtgattagttgaaaaactaaacatatagtcaagaaccgagtggttttatagtgaagcacgcatggtacttagtaagatacccaaccgactgcttctcaatcttgaatatatcaaggacaaaaaatacaagaagggccgagtgataaacactcaaaaggtctaaaaatatatatatttggtaggaatccgagcaagaaactcttaaaatgatccaccaaatatgataaagatcatggtaattaagaagttcattagcctaggctataacctttaccataatcaaaataagcatataacatgctaagagaataactatgaataaaccagtcatctcaaatcaacccaaacagcttttgtagcctaataaagcttacaaaaacggcataacacctttctgtcaggcaccttttgtttgcatcgtgttaattctaaagaattagcaaaccgcattaaaaaggatttaatcagcattgggccacaacattgtgagtacaaattgccaaagcaaaaagtgcctaagtccctaagaatcacaacgggccacgctggaaataaaattgggctgaagtactgtacaggcccaggcccattagtactcacgataccctaaaaaacaccgaagtccaagcgacgcttcgtcttccccgccaagactctcgccatttccccattcctcgctacagtacaagactacgccgacggagctagggttcatcaatccgccccaatccattctcaaaaatcccacgaatcttctccacgcgtccaccgcaccgattcccccatccctttccatccgtatctcgaaccaaatcaaaccatccagttcacattca

SEQ ID NO: 18962 - DNA, 1501 bp, Oryza sativa
gaacacctgatgggtttaatgtcatgaaacctgaactcacgctctctcgctgcattttttttttgcagcaattcaagccacaatgatctggaagaacgttggccttccaaatttctttacattgtctctaggaaaggacttgcaggtgcattcagttagtttcagtttcaacaaccctgcagttttatacttatgctgttttcatttaattcgactagtttcaacaacctctagaatttcaaatttagatagtaataatgcatgcatgtgattagataaaaagttagcgctgacatttcccggttgctttgtttgctaggattgtgttgcatctcatgattctcatctcgatttcgcggtaattttcaaacaagtgtacaagcttctcagggtacttcgcatccaagctagcactattgacctgcatctccttcagaatttgcacgatttgcatgtttagtggatttgcaagattgaaaatcagttagccaagtttgggactaaattataagagcctaagaggtcatcagtgaccgatttaatttgtcagccacaccatcagttctaaattatttttgtggcgtccacaaatttggcctgcatacttttttaaaaaaatctgaattaatcaaccctgttatgccaaaaacggttgctgatgataacatttgatttgtgcgtacgtatctgctgacgataaattacgacagaagcaactgaaactacgatatgatggtctgagaaacatcatatgccttaacggacgatcacattacagttgaattttctagttactactaactaattgcttctctaatcgagtctccgccgtgcaactcgatcacatgacacatgcatggtccatacgcagtcaaaaaaaacaaaaacaaaaaacaaaaagaactttgctttcgtctaatatatttgaggcgcgcaagctttgcgtgatcacgaaaagaagtcacagaaaaacgcaggcggtgaatactcgatcgaattgagttccccaaatcgatctcatctcatcaacaaatgctctcaaaattcgtccaatgcataagcatggaagtgaatgagtgatccaatatttcacaaaaacccagctctcaaaagcccactgcaaccgcttaattacttggctataaataaggtggtgaagtggccatgaatggatcacaaagcttcacccactccaaacctctaacacctgcagtggcctgctgcctatatttgtccaattcgacaccgatcgatcagcttaagaggctgagcttaattaataatcactagtggtcacacgtgtaagcactactagttagcatcagtttgcataatcccctcgcatatttgcagctagctagttatacatatatatggcaggaatctagcttggctgtgcttgttcttgatccatccatcgccaattcgccatgcatgcgttcttgccctgagtcgatcttgtgaattggtggtggtcggagagatagattggttggttgcg

SEQ ID NO: 18963 - DNA, 1501 bp, Oryza sativa
tcgttgtttccttctccaggaaattctgcatgaatttcaccaggctatccgttttcggtggctccacttcgacctcttgaatattctgcgggttcggcctgtactttattctgaccatggagcattgttccgtcctcggttgaaactcaaacttctcttccttcctgttgatatggaaacggatactccccattcccacgtcaatattggctcctgcggtgctgaggaacggacgccccaggatgagcagcgtctcctttcccgtctctatgtccagcaccacgaaatcaaccgggatgaataaatcccgtatcttgactagcacatcttccgctatccctgcggggtaacggactgatgaatcagccaattgtaggcgaatcggtgttagtgccaacaccgtgaagttgagcttgtcgaagacgtcttttggcatgacgctgacactagctccaaggtcgcacaagtcctggtcgaactgctgtgccccgatcgagcaggtgatcgtgggacaccccggatatttcttcttttccgggagcttgtggagtataatgttgctgcattgctctgtcaggtcgaccacctccgttgttgggagcggtctcttgttgttgaggatatccttgagaaacgggcatatgttggaacttgcatggcgtccaacaacggcacgttaatgtggattttctggattacttcaacaaaacgagcgaattgctcgtccactgacggtctcctacttcattgagggaaaggcagcaaccgtgtgtcgcagtactcctacggcactgtcttttctggctgaacatccatatcagccgagtcactagatggtgcttcttttgacatcccagtagttcctgaagggttaggatatggcggatcacgagtggacttaccttccctcgtcgtgatcgccttgacattttcattggaggagtcgggttgccctggaatcctcccagtttcatttgcagggacgaaagatgccaactgagctaactgggtttctatcattttattaaagctcagctgattttgaaaagcggaagcaaagccatataatttgacatttatgttctccaggaccttgtcattggccgcaagatttttgcttagcgcatcagtggttttagcttgcgcaaagactagatgcttcaagcagggctggttagagaaattaccgttattgttacctccttgataatatgcgtgtggttggttccatccctgacctccttgtggacgatacccgttgttcttgttgcccatgtacatcgcctcctcacgggtttccgagcagtcattcccagaatgacacgtattgccgcagacctcacacgtgacgtgcgagtccaaggccttgacggtgccttgtggccgtttctcgtggtcgtccaaccgcttcatgaggaggtccagcttggcagcaagcaattccgtctccttgacggtgtgcatgccttgctagcgggtctggagtcgttcctcactctaa

SEQ ID NO: 18964 - DNA, 1501 bp, Oryza sativa
ctggaactactccatcggcttgtcagccgattggctgttttgtctattatttgcatattttgtcagttgtaggatcaaactgactggcacacccgcatctcatcaacctttggacctgcactggagctaagcagatctgccaggctggcgtgttcgattttttcatcaacactcaagcaatagctctctcatttctctcaagtttagtttagtagtatctagttggtggaataggaatagagtagaaattaggagtccggaagccttcggaatagttcgggtatggctctatcagcttttctcttctcttttgtaagctttgtacttttattagaatactctactaaatacatttatggtattgaaatactttccgagtatatcagtacctaatttacattatgttcttgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgtggatgagaggtggaccgctgatggtgacaactcagtacgggtattcctccatgcctatatataatcctaagttaattccctggggagggtattcctccgtatttagccccgattgtatggtcatggcggactgtcgtaaggaactcgacagtcaggggtggcttctcgaagtaccaggagggcatcggaaagagggtattagctagtatatcagtaaactaggatgtatgtatactatgtatattagaagtttaggaatagattatcttcctcttttctttccacttagcttagataatatattatgagaataagtagtttatgcttgtgtgtcactctacccttggattatcttaacccctgtttagaatatgattatcacaagcaatatataaattactagtcatgttctctctacatgattttcccacaggataaaataaatatgatacccttggaatactctcgggtaaaatgctataatggtatatccgtgcgcttgcggatgaactctgtaaccataatatacaagaagtatttctgcgccattgctgggaattatatttctagtaatgtcattaagaaataccaacaagcatttctggcgccattgccggggaagattcataatagagattacttattttatatttccctctgtataatcattttcctttgcaggctaaccttggttgttttcacttttgttgtgaaaacagggtagtgcatgacttgtttcaacctgctggaaaacttcaaggaaaatccagaagttgttgctccgcagaaaactttaccgatagagaaactagccgtaccagcgccaccaattttcaagactatggctagcaatactctccgcgagttcgctgctccttctgctgacaatgtggccattgggccacagatcaacatgggagacatgga

SEQ ID NO: 18965 - DNA, 847 bp, Oryza sativa
  unsure (1)..(847): unsure at all n locations
ggagagatgcagccacgtcttagcggataagtcccttcgcgtcgaagtaacggagacgggataagcaagggcgattggataagagaatgactcagcctagggttaggggtgacgaagggtgaggtcgcggccgttatctgttggcgtcgacgcacaagcgaaggaaaggcgacgcgatggatggagttaaaggcgacgggacggggtgacacgagcaaacgtggctccgtgtctcccggaaagaaaccggagcgaggtcgggcttggcgcgacgcggatttggcgcggcgcgggtgccggctcggtgcgggggtggtgtggcncgggtgttggcacnacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcgttgagttcgcctcgccgccgtca

SEQ ID NO: 18966 - DNA, 1501 bp, Oryza sativa
ggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaactttgccaataaatggtataattgaaaatgacaacaatctgaaaagcaccttcttgtaacctgaaagaagggagtacaagacaatacaccatgtacctatagtacgtatatagcatatgaaacgatcaaatgcctatatattgttgcttatcctattgctaccatatgatgcatcaatcaaacaaacaatactacgctttcaggttaaatatttctctcacacttcatttgattactcgtttgttgatctcaaataatatattggatcatacctgtctaacaaatttgccggtcaattcaggtctttgaccaatgggtttcaatttccatccggtgaacgacagcgactggttgatcagggcggcgatgctgctgagcttcaccctgcaggtgatcctcgtctttgtcgcgcccacgcgcaagcgctcctgccacccgcttccccacctcgccgtctggtccagctacctcgtcgccggctgggtcgccgtcgtcggcctcggcctcctcctcaacagcctcagcatcagcggcagcaacaatgggtcctcctccat

SEQ ID NO: 18967 - DNA, 762 bp, Oryza sativa
gtgtggaggattaggtgtagccttggtcaagctgcctgtggagtggagccgtctgcgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaacaaatttagcatgttggttttataatttcctttcatttcttttgaaaccagttattcaaaattacaaaatttgtgacctcgtttccaaatgttttaatttatttcgcaaagtttactttatttacttacttttttttactttgattttctaactttattcaaattaatccaaaaacttgtgctattaattggataaagtcttaactccctcctttcacttgtctttaga

SEQ ID NO: 18968 - DNA, 1501 bp, Oryza sativa
ggagaaacgctacatcgctggtcgaggactaggcagtagtcataactcgaccacttaaagtggaagttgtgggagaaacactacatcgctggtcgaggaccaggcagtagtcgtaactcgaccacttaaagtgaggcgagagagatcactacgtcttcctggttcgagaaccaggagtaggagtctcttaatcacttatgggggcgctaaagttggtttattacatgtgcatatcatgtggccagcatgactcacatacccaacttatagcatatccggatgtcctcttgcaatcatgttgggtgatcaagccgacggtgttcgtgaggagttatccgttaacaaccttttctcgagtagtccagcgatggctggtgctatgagataggtcgtcggtcttctttggtaggttgggcgtgacgactctgcatttgtcgagatcgttctcgataatgcggtgtactcgaccatgacctactcgagtgctcaattgttcctgaaaaatattttctagaaggcaagatatatagcaaataatgtcgagtatgtactcaaaaaactgcatggatgttctagtattattaggatataacgagcagatgtaaatattaggcattatgtaaaccgtaaacaagcatgatttatacagaagaaaatagagcgagcccccagcgttagaccgtagttggtttaacatcggaaacatccgcgcaattgatattgtataaaaaacaagctctaggtaaacataataaattatagatctgacaatgccgtatcatctgaataggtacgataaattgcatataaaatattacgtacctttgtagatacacgctggatgtatctacgaaattagtagaccatttttaaaaaatcaatctactaaatacctgatcacgggcggccgttgatttatcttggtagacatccgtgatcaataatcccgggaacacatgatgtcgggatggatgttctcagtatgcgtcaggggtccaaaatttggatcctaatcggggtgtgagaacgatccgagtcccaaaagaatctagtgaatagatcgagatgttgattttggttcctcgatggccggtgttctgagcaggcagcggcattaccgaggttaccaaaaatcagtttatgatgtcgcttctgaagagatggagatcggagacctcctagttgataatatcaagtcactgttctccgcggcggcaacgtcttgaagtttggtcgatctcgagagatcgagttgttgacgacgatggttccgatcatatcgggagacatactctggtcgggttggatctccccacagcaaagtcgtcgagtagcttgttgtcggagaatccgtcttttgaacccatctcgttgaaattctgaagcaccaaaatccccctacctggcgcgccactgttgacgtttgatgtcgcgactacggtatttagacagtatggggatcgtcggtgctagggtatacgcgagactgaggtaaaagaga

SEQ ID NO: 18969 - DNA, 1501 bp, Oryza sativa
cagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaacaaatttagcatgttggttttataatttcctttcatttcttttgaaaccagttattcaaaattacaaaatttgtgacctcgtttccaaatgttttaatttatttcgcaaagtttactttatttacttacttttttttactttgattttctaactttattcaaattaatccaaaaacttgtgctattaattggataaagtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagcaatagtgaagaggtcccctcagtgatgtttgaagctggaggaagaaactacatccatgcatgtcaggaggtggcaaggatcgccataggagagctccgtgatcgctacagtgatcaattggccgacactgagtatcgctaccatcctccccaaccttagggaagtgaccgtggcagttaccttgagactgaaggaattgagaatgatgtaccaccaaacatttggttgagatgttgtgggctatggatgaaagtcgtgcggagactgtgttaccagctcaagatcgtgaagatcggaatcgtggtaagatttgcaagctagaagacaaggtggatcgtttgaagaaggaattagccgcattgaagggagaagcaccgccgcagaaggccaggattcgtcttaccgcaaggaagagagctttatttgtccctcgctatcaactggcgccaaaggttcgtgtggtggagaaagaagttgctccagctcaagcggatcctccggtcatcatcataagtagtgatgaagaagaagaatccaagcgcaaccattccaagattgagtgggtagcaactcaagatgatgaagacgagccttcaatcgacctccgatgcttggaagaactagagtgacttgttaagtcgttgtcttagatcgttgtgttagtttgcttgctttaagtttgcttgtgtgtggttcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcc

SEQ ID NO: 18970 - DNA, 1501 bp, Oryza sativa
cttggaaagctcaggatgaatttgaatgtgggaccaaaaatatctgaaactagatctcataagctttctaataagaagctgatattgtcaagagggcctattcaacagctctgcgtggtggattatgtcttgtgcctaaaataaccagcatcgtaaactcatattattctttttctttaccgagatttgctcatggctttatcttgttaggctccaatagttctctcagatttcttcataactagataggtgtgagattccttttatctgtgtttcacaaactctgttctatttatcggataaccataaaatactctaaagtaaagtgctacaccaataaatctgtgttttcttggatacattttgtgagggcataagaaataccaacaataaaccaaatcacaagtaatacttgcagttttctccttttgaattgatgtcttagaagtagaatatattatgacaatagaacaaatgcagcgtatgtagattggtaggttcatgtctttagtacagacagcaagtgtggatccatggaaaaacttttttttttttttgggggggggggactaaacatattattaactagctatggtttaatttgtttctttcgttgtaatgcccggaatactcttctcaattttttttcaatatttttcacaaccatttgagtgatatgcaaacaatgaaagggcatccccacgagagtttagaatagtttccccctcccacgctggatctgtcattgcaaactaggtagtgttccctctaggcagaccttgataattaagaataggttgatgacaaatacattcctctttcattgtcaattgcctactttcttccttggtaattacttcaattgacatgtaatgcgttgaaatatcatttctatccgatctactcgatgcagtatatatattcccattatcaaaaatgcccttctttaaagctatgtattctaatgccatctctacttcccgcattgaaggctactcttgtctttccaattagttgatgccccgcgttttgctacgggatatgtgaatgaatatatgttatacattatagaaatggtagatgtgcatgtttaaataatgtaaaaatgatgtagagataatgatttgatattgcttgcatattgagttatagaaatataacaaaattgtaaatggtatgacatgatatttaaaatgctccatataataattgctagtgagtaatgatgtgacaaacttgcatgttgtaggatcgaatcacaaaaactaagccaaccagaggggtagggtgaatggttggtatacctaaaaaaagaaaacttttagcggaaataaaagttaccctcgaattcgacgtatcgcggtttaaccgaagtatatgcgccggtctgatcacctgatgaacatcggtctgactggtgtaggtcgatcggttgaaccgccgagatgcctgtcgcgcctgtcgccgccgccgatcggaccgcccgtatgccgccggtgtg

SEQ ID NO: 18971 - DNA, 1501 bp, Oryza sativa
gttggtgcactatgtaaacgcagagagaagtaataaagtcgtcatccactttaagagttcttcgatttgtttttaccgggtttcgacggtctaaccggcgatattatgatggtcagactggcggcaagcagcggtcagaccggcggcatacgagcggtccgaccggcggcggcgacaggtgcggcaggcatctcagcgattcaaccgatcgacctacatcggtcagactgacgttcatcaggcggtcagactgcgatccgtcgaattagagggtaacttttatttccgctaaaagttttcgatttttgggtataccaaccattcacccccctagttggcttagtttttgttatttgatcctacaagtggtatcagagtcttgttttcttctttggatttttatcggtctagagtttttgccatggctactcctgctaggttttcaactaagaatcatgttttcgatggaacggatttttctcattggtgtagtaggatgcaatcttacattatggctgaagattatgatatttggagaaaagtttctcatccttatgtgattcctgaagctattaatactgctgctgaaaaaactgcttttgaacaaaattgcaaagctcgcaacattcttttgagtggtatttctcgttcggattatgatcgtgttacgcactttcgaactgctcatgaaatttggaatgttttgagtaactttcatcaaggaacaaataacattaaagaacttcgtcgtgatattttcaaaaaggagtacattaaatttgagatgaaacctggagaagctttgaatgactatctttctaggtttattaaaattttgagttatcttagatctgttgatttttcttatgatactaattatccacaatctgagatttctcgtcactttttgaatggtcttgacatgtctatttgggagatgaaagttacatctattcaaaagtctgttaacatgtctactttgactttggattcactttatagaaaattgaaaacacatgagatgaatgttctttctaggaaagttgattctaagtcaagcgctttggtttcttcttcttcttattctttggatgttgatgctttttcatctaagccttcttttcttgctgtttttaatgtcacatccgatgatcaactcgaacaaatcgaggaggaggatttggcttttgttgctaatagaattctcgagctacgaataatgccaggaacaggaaaagaggtggtccaaatcgttgctttgaatgtggttcaattgatcatcttcatttgcattgtcctaagcttgggagaggcaaaagagaagacaaagatggtgagaagaccaacaacaataagccgaagggttcatcccaagggaggaaactagagaatctcaggaaggcttttcaacaagtaagcgccgccttcgagccacaaaatgatgtagatggtgaaagtggagatgatgataagggaaagaacatctccgatgtttgcttcg

SEQ ID NO: 18972 - DNA, 1501 bp, Oryza sativa
  unsure (1)..(1501): unsure at all n locations
gacccccggtgggagtgggcggtgattaggtcggccgcccgtcgcctgcacgccgccactccttggccgtaggcggcggcggtggggcaggggagggttgtggtagggtggggtggggggtaggacgtgaggggtaacattttagttattatgcactctgggtctagtatagtatgtctctgtatatatgtacatatatacatatatatacatatatatacatatatgtatacatacatacatacatatatatacatacatatatatatatatatatacatatatatatacatacgtatgtatatatatgtatatgacactcatatgagacaccatggtatgaaatacgcaaatgagtatatatccaatttgaatgagtatgatatttttttaaatgtttagcattaacattaactattttactaactagttcaaagcaagtttgaactgaatttaaacatgtttttattagaatttgattctaggtgtatagcatgaacccaatttggtaatctgagtagctcacataacgaaaatagttatagaatgacttaaaaatcaatttttgttatgttaagataaaattgtacgactttaccagaagtctttttcccaaaagactgatttttgaaagttgttcaaccatgaaaagatattgaatagtatttgtttattccgaacatacgtggcatacttttgtaattagcaagcaaaattgcatttattaaacaataacaagttcatcgatgtcacgttcaatccataaaaaatacatgaccaaacattacatctaattaatagatacaattatgcatgtgaatgagccaattatgtcactctccatcggctgtggaatctcattcatcctgcactatatataagtatatactgtttattggaacagtatatactgttttgttacaagtatgtgctacttattccttggaacagtatatactgttttcaaatttctggctagtatatactacttcctccatttcatattataagatattctagcattgtccatattaatatagatgttaattaatctagacataacatatattacctccgttttttaatagatgacgccgttgactttttctcacatgtttgaccatttgtcttattcaaaaaatttacgtaattataatttattttgttatgagttgttttatcactcatagtattttaagtgtgatttatatcttatacatttgtataaaattttgaataagacgaatggtcaaacatgggagaaaaagtcnncggcgcatctattaaaaaacggagggagtatatgaatatgggcaatgctagaaattcttataatataaaacgaagggaatacattagtattgacggagcatatactagttttttttaaaatttggtcagtatatgctgctatattttttttgttcggtcactacatacagctgcatctcatcgctaaaggagataatactgctttcttgtttgctcagtatctgcatac

SEQ ID NO: 18973 - DNA, 1501 bp, Oryza sativa
agctttgtttatgcatatggtattttcttgtgcatgctagcaatactttgaaggtttatttgtctctagcatagcttgtatgtattctagtcttttcatgagatttagattttgcttttaagggagatgatacatgacatttaaattctatacttgaattaagcaaatatacaatgttgatgctaacatatggtttgatttctaaatgctttatatatatgctttattgaattgttattcctcaaatagctttaattggtcattgtgaaaagagaataaaaatatgaaaaaaaatgaataccgaatcattggaaacagtcttgaggacaagaacgtattcgatatgagcaaaataatgggtgccgaatccctggaaacagtcttgacgacagggacgtatccggaataaaaaagaaaaaatatgagcaaaaaggctcaagaaaagaaaaagttaaaaaattctcttggttattttgtgctaaaggttatttgagaaagagtgataaatgcaataggtatatgtgtttagtgtttattcttcaacctatgtgcttgttaagatgttgcattataaatcatatgaaatcatgaattttgattgttgattaaagcttaattataaaatctttggttcatggttatactttaatgcatgcttgttatattacacatgacatgatatgctatatgtgttagggtcatggatatcacatacctaatagtagttgactaaatctcggcaggatccaccacatatcatgtcttatacggaaactgacttcagatatggagggagttctggataaggaaagacaaccagagttctacatggaaacgacaaggactactcagattgtatccatattggtttccctagttctactggacaagcggacacctgtgggtataaataaaagcccccctaggaagacacgaggacacccatgatatgagacgatcaacacgatcaacaaccaccatgggggaccacgagacaatcaactcccaacacaatcaacatagaagcctagatacgccaagacaaaccgccgaatatcgacatcagagatacgcctggatcgaccctatccggtaccttcagaggccggccgtagggatctagcactgtctctgattccgtcgggcgcgagctcgaggaggaaggctaccctgttgtcaactatgagttagaccttcagaccggcatgtcgacaacagttagataggctaccccacatattgtactggtatgattatggtgaataaaaagcaacatcggctccggccaacaggatgtagggctattacatgatagctcaggggcccgaacctttataaaaatcctcgtctccatctcttttacctcagtctcgcgtataccctagcaccgacgatccccatactgtctaaataccgtagtcgcgacatcaaacgtcaacagtggcgcgccaggtagggggattttggtgcttcagaatttcaacgagatgggttcaaaaga

SEQ ID NO: 18974 - DNA, 1180 bp, Oryza sativa
cggattcaccgcccgaacctcctcgtctccgagccgtggctggatgcgcctcgccgccgctcctcctcattcctgaactgccgctgccggagccgcacgccgatacggccacaacccgacgacgacccccggtgggagtgggcggtgattaggtcggccgcccgtcgcctgcacgccgccactccttggccgtaggcggcggcggtggggcaggggagggttgtggtagggtggggtggggggtaggacgtgaggggtaacattttagttattatgcactctgggtctagtatagtatgtctctgtatatatgtacatatatacatatatatacatatatatacatatatgtatacatacatacatacatatatatacatacatatatatatatatatatacatatatatatacatacgtatgtatatatatgtatatgacactcatatgagacaccatggtatgaaatacgcaaatgagtatatatccaatttgaatgagtatgatatttttttaaatgtttagcattaacattaactattttactaactagttcaaagcaagtttgaactgaatttaaacatgtttttattagaatttgattctaggtgtatagcatgaacccaatttggtaatctgagtagctcacataacgaaaatagttatagaatgacttaaaaatcaatttttgttatgttaagataaaattgtacgactttaccagaagtctttttcccaaaagactgatttttgaaagttgttcaaccatgaaaagatattgaatagtatttgtttattccgaacatacgtggcatacttttgtaattagcaagcaaaattgcatttattaaacaataacaagttcatcgatgtcacgttcaatccataaaaaatacatgaccaaacattacatctaattaatagatacaattatgcatgtgaatgagccaattatgtcactctccatcggctgtggaatctcattcatcctgcactatatataagtatatactgtttattggaacagtatatactgttttgttacaagtatgtgctacttattccttggaacagtatatactgttttcaaatttctggctagtatatactacttcctccatttcatattataagatattctagcattgtccatattaatatagatgttaattaatctaga

SEQ ID NO: 18975 - DNA, 1055 bp, Oryza sativa
tcggtgatgtcatcgttgacgtcatcgggatcttctcccgtaagccggtcgtggaccgatcgatctcggccatccgatttggatcggatcaatctcgaccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaacccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataag

SEQ ID NO: 18976 - DNA, 1459 bp, Oryza sativa
ataagacatgtacattttatgaacaatcttataaatttcttcatcggatgaagaaatgtccaaaatagaagttatagatcttgatgagttatacaattttcttattgatgactttttcagatgaaattatttacttcttcaaaatatcatttgaagttttgaaattcaaatttttaattgataaaacaaagtcacaagaaaaaatagccaatataataccagtaacaacacaataacatgatagagcatgattttagaaacatttaggaaaaagatcatctaatttggagttcatatgagtgagatacactagtttcaaatttttcaatttttattttcgcatacggctttcttaagtggtccgtatgaaaaaatcgatttttccatatggtcgcttaagtgagccgcatgcaaaatgagctcatttttgcatgcggccctcttaagagggccacttaagcagccgtatgggaaaatgaccctcgatttttgcagacgccactagttatggtctgcatggaaaaatgatggggcctcgtatagaaaattcacttttgtattagtgccatccattgcatatcagtagtttaaatgcaggtgaacaaatcgaggctagtagttataaatggtttgctttgtaaatgctcttagcacttaaaaaatggtttttttgcggaaaaatagattttggtaggtggccaggccatttcacatgcaattcaagacctttgaggcggtcaagttaagtcgtccgcatgcaaaaacacattttagcgctaaaaaaaaatcaacaaccgatgtcgtttatcagtagccctcaaatccaattgacactgacagaaattcacaaatccacacactcacaaatttagattattcaaaaatctccaattagatcaatccatcaatagcacaactaacaggatctggccatcgcgagctccccaacaaagccattgagccgcgatcatcgttgtcatcgccaagtaacgaagccacctagacgcatgttgccgttcgtcgccgtcgttgagaagaagtcgccaaggaccgcatgcatggagaggtctcccaagtaccgcctcaccatatccggcaccctccatcgcaaccgccatagcggacgttgtcgtcatgcaattgctgaggcccaccaacactggcgctcatcgaccaccaccaacacaccccaccactgagcaccatcgccccacctagccacctagggaatcgcgtggcatgtctggatacacctctccctagcacatcggtgtcgggtctaccttccccaggcccgccggcggagggttcgcctctcccgagcttgctggcagcggatccgctttccccgagctcgatcgtagtcatcgtcatcgtcagggttcatatgcagtcacagcgaccatagcgttctaagcctgctggcttgtaaggccatgtacaacgcgtgaccctgact

SEQ ID NO: 18977 - DNA, 1501 bp, Oryza sativa
cattagttataattgtactttgtcactgaaaggggaaaactgaaaaccagtatagctttttgttgactcgtagaacccacattaacaaatactagcataaaagaaagagtaatagtgaacaatctgctacttactgtagcataatttggtattgaaccaaacaataagatcaatttcactaccatgattatttagagaacatgaagcaaccaacgataaaagaaaatgtgactatgttaacgaatactcctcactaatgagactttcatgagcctggtcatggcaaaacaggcattgaacaagcagatggctaagagcttaaaattccatgtctgaatttttctaccaagcctgtcaaatgtatatggacaaagtttaccggaattgctgaaagagtgaaatttatatgtcctatagttgtccactttcagtctaagtctctaaggcctgctcaaatagttctgaatggcaattccaaggttctagtacgtagttttcacagaacaaagcatatcggcatctcctattcggatttttcggtggaaatcatattttgatttatttaccaaacttgtgattttcttccatgatcagggatatagaagtatacaactcatcacacaactaatcagctgaaaggatgccaccagtttagattagatccattttatcacagcacatcctagattatcaattacctcctacgaagtccatggcggatgcttcggggacgtcgcgcgcgcgctgggagatgacaacggcaagctcgacctcgtggtgcagcgactcgaccggctccggcacctcgatggcggcgccggccacgcccgcgtggaggaacgacgaggtgggcttcaggaacagcaccggctcctgcaaccagacgcggcacgggcaccaccgacgccggatcagggcaccccgcgggaagaaggcgaccggagaacccaccgccgccagtggtggttcgggattggagagtactgtaccttggggacggggttcccgagctccttggcgtgggcgacgaagttgcggcccacccctacgatcttcgtgctggccgccaggagcctctgcgccgccgccgccatggccgccggaggagagctgcgagcggcggagggatgcgtcgatcgaggaggtggaggtggtggtgacggggaagaaatggactccagcgcatggtcaagtgacaaaatatacggcccataagacaaaaaccggcatatcatggcccacaagacagacacctgccttcctgtgtcaaacttttataattttgacaaagttttgtagcaactcttgtaacaccaaattagtttcatcaaacctaacattgaatgtatatgttgatagtacatttgtttggtgttgaaaattttactatatttttatataaatttgattaaacctaaaaaaattgacttaaaaaaagaaaaagaaaatcaaaagtggtagtataaaacggagggagcataggaattagtttataggcatc

SEQ ID NO: 18978 - DNA, 1501 bp, Oryza sativa
catggcgcaagcccagtacggataatattttacaattgggacttgggagagtatattttaccacttcaaataatattttcacagtcctgaaaagtatttacaatcatgagataatgcatctggtaggaacgggcacttaccgtagaaaaataatcttacaggtgtcagccaaggaggcacttacccagaattttgtaaaatttactcattaattaactatttcttccgttccataatataagtatttttaatgtttaaattttttccctcgatatagcaactaatcaacctattttcaagtcaaattactttcttgtcttaaccaatcacaatctatcagttaatttgtttatatattttttttctgcttgaaccaatcataaccattctgctctacaatttgcttatattttgcaatgacacaagtatattatatggcacgacaacagtacactagccctgattacccaaattctgccacgatcagatagaaaattgtgtcttccagagaagaggaagagagattctacacttacccatcaaactccctggttatcaccattccatgggctaaaagaaacactagctagtaaccacatgcgcacaccctaatagtgactttgcgtaagttggtttcacaagtcatctttttctgatcttttttaagggtgatcgcgtgcacaaatcctagtaccatcaaaaggttggcacatagaaatttcagtgacaatatgtaaacatgttaggtcacagtcacattggaatgttatgtgcgtgtgtgataatctgattcctttctgaagaataataaacagtgtaattcctctttgcttatgtacattaatcagtgtcagtcttttcatcatcagaattaccggataggagtagggtattacttcttgaataagaaggcctgaacctgtataaaattccttgtcttcaaacccatccattttcctagcttgatagccacccccttttattattgccaaaatcttgtttcgatagttactgtggagattatggttaccccatatctacatggcggttatattccagctggatatacagtaccaaatatagatagaatatttttatgaggactcgggttagattctaaacttgtatgtcaagaaaatacctggtatcctagtcggttacgattgtgttttatctgtaatcccatattccgttaggatatgggttgtactttgtattacggatcccttcccctatataaggagggtccgtgtgcctcttggggcacgattcttttttcccaattatacaatcaataacacactcggcggaatcatctccggacaggagtagggtattacttcttgaataagaaggcctgaacctgtataaaattccttgtcttcaaacccatccactttcctaacttgatagccacccccttttattattgccgaaatcttgtttcgacagttggcgcgccaggtaggggtagcgtcaagttctcgcctactaagtgcga

SEQ ID NO: 18979 - DNA, 1501 bp, Oryza sativa
ttagaccttttgagtgtttatcactcggcccttcttgtattttttgtccttgatatattcaagattgagaagcagtcggttgggtatcttactaagtaccatgcgtgcttcactataaaaccactcggttcttgactatatgtttagtttttcaactaatcacatagtcaggggctacacctaattaggtgcatctactcgatgcaccatgttttattttcgccctttacagtcttttagcactcggcaagccggagcaagttgaattaaagcactcggattattgtttttgtttcgagaagactattttggtcaactgtgaaggtctcgggggctactgtggagattatggttaccccatatctacatggcggttatattccagctggatatacggtaccaaatatagataaaatatttttacgaggactcgggttagattctaaacttgtatgtcaagaaaatacccgggatcctagtcggttacgattgtgttttatctgtaatcccatattccgttaggatatgggttgtactttgtattacggatcccttcccctgtataaggagggtccgtgtgcctcttggggcacgattcttttttcccaattatacaatcaataacacactcggcggaatcatccccggacaggagtagggtattacttcttgaataagaaggcctgaacctgtataaaattccttgtcttcaaacccatccactttcctagcttgatagccacccccttttattattgccgaaatcttgtttcgacacagtgtaattcctctttgcttatgtactttttcttcacttaggcagcgttcgtttggaggacattgagggagaaagcacctcgttttccgcacgcacgcttcccaaactattaaacggtgtgttttttgtaaaaattttctataagaaagttgctttaaaaaatcatattaatccatttttgaaatttaaaatagttaatactcaattaatcatgagctaatggctcacctcgttttgcgtatcttcccaatctcctcaaacacacccttattgtttatcggacatttaactgagcatatatacagtgccaaacagcgggaattggcatcccctgtttctcctttcttcagctttgtcagcacactgaactgtacaaaatcagttcatcttttcccacctaattctgaaaatgacatcaatagcaaaatgatcaaacaatcaaaattttcatagaaataaaatattttccttatcgcaattggcaccttacatttagatttattctaagttactcggcaaaaagaagaaggattaaattagtccatcgcttgcactgtttcatctgctagtgccagctccaacattttgaagagtttactattatagcttctcaacatctcaagcttgatgtaccaacctgtcgtagaaagcgtcctaccagtaagagcaatgatgcaagatcaactgcatataaacaaacaagcaaattaaacaaacacggtt

SEQ ID NO: 18980 - DNA, 1501 bp, Oryza sativa
tagtcttcgctttcgccatatcgcattttcgagaatacctaatgccgtagtaagccatacgggggtcgttttattgcttttatgcttaagtcacacacttcgagcaagtctattgaatctatactcgggtagaagtaatgcgcgctcatctccaacgcctattttgcaaaagaagaagaagaagcagaagagagaaacagtggcttttgtactactcttgcacatagaaccccttctcgacttgctatcaacagttggtttgaaacttagcatttctttgttatgcgcagttttgctgaaccagatgccgatgcagtgacgattcgttggccgaggatcgcgttcttataggcccgatttgcaaaggtactactgcagtggcggagcttgagagagattctagatggggccagctattatagagtggaaatgttggtaatggcagaagtagaatttgtagaagggctattcatattgtaaaataatttccaagcatgtttttgttaagaaaaaatatatgttatacctaagtatagctgttaaacaggtggaaaaggatcactcaagttataaaagacaacatatcaaagttattgtaaattaacaggttttaagagagctattttattaagataaaaatgtttgtcatccataggaggaaaatgatttagtaagcaattaaactgaagaaaaagaatggacttctcaggatttgaacaccaaacttccaagaaagcatctgccctcttcacttgctaatcaattgagcagaaaataaattttcttactagatacttgttaagtatatatgtgtttgctgccaaagctgagggggcaacacccaggttggcctccatgaagctccacctctgtactattagctgttgttggaactatattggtcgcatcaagcttccgccaatgtttgcagggttaaaatacttggtggtctgtcatgctgtatgttgatgttatgcattgcttttggtacaaccgagttcctttttcctgactggttccatggttggttgagatatggatgctatgtattgttctttaatgttacactttagcaaaattttcccagattacgtaagcaactactccatccattttatattataagtcgttttgatttttttcctagtcaaactttttttaagttggaccaagtttatagaaaaacataatagtattttaaacacattatattatcaaaatatattcaatgttagatttaatgaaactaatttggtgttttagatgttgctaattttttctaacttataatatgaaacggagggagtattgattacaaacatgatggctacttcatttgattttatttagcattagctgtttcaatcttggcaatttaccatttccatctgttgtgtggttttatttatgtaggagtgcttgtaaatccaatcataccatttcgattttcatttgaccaaggataggcaagaataggaggaaaaaggagagtggcatataa

SEQ ID NO: 18981 - DNA, 1501 bp, Oryza sativa
acttatttcaatattgcttatttttaattctgaattttagatatttttaaattgtacttctacttggactcttcttttctttttttttttctttttctctgattaatgtgggaatttctagcccccacagcgaacatggtgcctcctttcaatgctgttttaataatataatagattgattgattgattcaataagctagaaatttaatttgttttctgttgcaatgcacggactctaagctagtatagccaaaaaaaaaaaggaaaaccgttgaaaacagtgccccttaaacataaacggcgcccaattgattgagaattttcgtgaccattttcaccccttatacacaccgaatccgccattgacgctgataccatgtttatcttgcggtcttgccgcagagctggcgtacatgagggtgacgaccaagtgcgacgtgtacagcttcggcgtcgtggcgatggagatgctcatgggcaagtaccccggcgggctcatcagctcgctgcaacactcgccgcagtcactgtcagccgaggggcacgacggcagcggcggcggcggcggcgaggaggcgtcggcgtcggcgtcgcgccggctgctgctcaaggacgtggtggatcagaggctggacgccccggcggggaagctggccgggcaggtcgtgttcgccttcgtcgtggcgctgtcttgcgtccggacgagccccgacgcccggccgacgatgcgcgccgtcgcgcaggagctcgccgctcgccggcgaccgatcctggacaggccgttcgagatgatcaagataggcgacctgacaaattctcacagatgagagagaaaatttgtgacaaattatcgattgctttgtgcttatgtgattccgttagtagattctcattagcatctgtatagtttttgtacagtgatatttagtcccgtttgagaacagatgatgaagagtgttgattgactttttttaaaaaagaaattaaaaattggatttatctatctatgttttaaaacaagttttatggagaaagttatttcatgaaacacgtcgtttagaagtttgaaagtactaacgaaaggcgaggtaaaatctacatgtaaattaccgaacgtttgggctgaattgatgccttcctacgggctgaatttatgcacagttatcggctgaatttgcactcacataagggccgaattcacgccagcttttgggctcaatcgacgtaaacttgtcggccagattgaccagcatttctgggtcagatttacctgcatatatgggctaaatatgcgcaaaccaacggaccattgagcagaaagcattgggctgaaattacgtcaaataatggccgaatttatcctcattgggtccaactaacgctcactgttgggccaaatttacgggcctaatgggctaaatttgcgctcattttcggtccgcactaacgctcaaataaggggccaattttacgaccttttcggccgaactatggactgaat

SEQ ID NO: 18982 - DNA, 1501 bp, Oryza sativa
acttccgcgaggtcggagtagccgagtaggagtcgttcaggatttcaaatttctttcgccctctgttgttatttttcaaactgctaatatgttttgtataaaaaatttctaaatgaaagttactttaaaatatcaaataaatcttcctttcatcaaatttgtaaagattaaaactcaaataagcatatgataatgactttcttgtgtacgtgttcttacttactccctctgtttcacaatgtaaaccattctagcatttctcacattcatatcgatgttaatgaatctagatatgaatatggaaaatgctagaatgacttacattgtgaaaaggaggaagtaatattcttcttcatcaggttcgttcgaatagggtcttctacatgttattttctttcgttcacaaataatctgatatggataaatttgctcgaaggtaaaaaaaattgatgttgaaaaaatatgtaagactttaattcttttataatagatgaaccctaagttttgttatagaactgttacctcgtattctagcgattgtgtgaaatttatagaagtaggataaccattcaacagtattcatggtttaaaaaaacatgcggtaaccgtatggttaccactgttatcgtgtacggttatcttttcagtttttaaaactatggtatatctcgcggcaaccgccaaaccgtagggtggcggtaaccacccaaaaaaacagtttggaaaccctggtagtatctatctatactctacctatctttttgtattttttttattttttttagcgaaacacaagttcatttgtattgtgtttcgctaaaaaaataaaaaatagagaaagataggtagagtatctggaggtctatcaaatctatatgtggagaacggaaaaaaaaaaccaaagttgggaattccaaacattggacatctaaccaggtcgactattcgatttgatcttttctttaaaagaaaaaccctcaattttgggtttaggatctattttgagactatgtaaggtgatgctctaacaatgaaaacaataaagaaacccctaaaattaatcctaataatatcgaatttcataatttttaaaataattttagaccaaaaatgacatagagcgtaaaatccgcatgaatttcatcaacccatcagcctatcacggactcactggcgagcgggccaatgcgcggaccaggccgccccccgccgcggcccaccgtacgcaacctgtcacgtgggccccacacctccgcctccccacccccaagtgtgaacgcgccccgcttctccggaaactagccgttggggggccgccgccgcgccgcgccggaaagctgccccatccacgcaaccctgcagcaacggtcactaaaccaatcccttatatactccccaccgcgccgcctcctcctcctcctccctctctctctctctctctcttctcgaagcgcctccaccgatctcgaattctctcgatccaggcaaggagggaggagga

SEQ ID NO: 18983 - DNA, 1501 bp, Oryza sativa
caagaaataaggggatttaaatgaaaggaagatcatgcctgcacatataggataaaaggacaatcaaattcaaaagtatccgataataggcaggaatacctacagtaagaacttgccaaaacatagaaaaaatacaacagagtaattaatacctacgcctccatgtgcccacaatattgaatgtcattctagttgtaagtctcaaaaggtataactatttttcttatctttagacacaaaaaaaaaagtcgcatgcaagcttgaataataaataaacaacaaagatagttgtgttcatatgttgtataattgctacccttgtacatttaaccacattaaaagtcccggaacatccataaaagaagctagaaaatatactccatgcagcatgtatggaaataagacaactctatcaacagctggttcagcaatacgaggccttcgagaaatcttaaacattctagtctatcaacagctggttcagcaatacaaagccgtagagaaatctgaacattcaaaatcagttgttacgactatgcgggaggggacaattgttgtttataagacacaacaaacgaccagggttgcacttcgggaaacaagcatccagacaatccctaaacatcagtaatccacgatgcagcctacacttaaaatcagctccaaagtaatcagcatcgatgcattgtagtaattagatctgacgaaaactgcagccaacgatagcatcaacaaacatatcagcgaaaaaaaaaactaaccgaagtaccctctaatcattctagattgtgctcgcatgggaataatcagaacccccgatctacaccaccagaaatacccacggcatagccactaaatcaagcatatgagctaccagacaggatcaaaacacagaaagtagatcagatccgaagaccgggaaacggatcgggcaagggcttagggcgcttcatcggcacgtacccccagaactcctcgacggtgtcgaaggtgtaggccttgcggagcgaggtcccccacgcggcgccgggcttgggcttggactggatgtcgtaccagaacgcccactgcctatgcagcttgtgcggcgccttcgccgccgccgctccctccgccgccgccacctccggggtctccgccgccgcaatcggcgctgcctccacctcagccatgtccgctccgccgccgccgccgccgcctctgctcctcctcgagggaaaacgaacgagtaggcgatgcgagagagagaagagaagggagaagccgccgccgccgccgaggggaaagagaaggagaaggggaagaaggtttcggcttctggatatggccgcgttggcgagggagatgtgctgcgttttcacctgggctacgaccccacgatgccactagaggcccggtccggcccgtttataacgggacgcaagtacatcgcagtctccttgtggcccatatagatgggcctcacgtgaaacgaaacccattcccgacacaaataaaatgg

SEQ ID NO: 18984 - DNA, 1215 bp, Oryza sativa
caatgtgtcaaaagcgctatctatcaatgtgtgctctttttcttgttcctgaaatatgaagatgcagcatagcactgcagcaatatttatggaattttgtcttgtatcttgaccaaatacagccatgtcaaagttccagctttaaccctgtgtgttcttgcctttttggcaatgcatggggagaatctatgcacaccactaataagtagggatgaaaacggatcgaatacggtcggaaactagctctatcatattcattttcatattttttttcttggaatcgaaatcggaatcggaaacccggatatgaaaacggaatcgaatattattgaatatagttacggagcaaatacgaatcgaaacaaatacggtaacgaataattatcgaaatatcaagacccctcaaagtaagcttcttaaatcgaggaagagatgtagccattagttttcaaaaacaacacattaatattttcaaattttatctctatttgtaagggcaagggggagatagaaaatgttgtgtttattttccatacaaatttatgttaccatgaaacaaataaattagtgtgtaccactgaaattttcacaggcacattgaaatttttgaaaattggttgaatattttaaattttgggttgaacatttcaattggagttgagaatttcaaaattgaattaaacgttctagaatttgagttgaattttttaaatctgagttgagagttttgaattcgaactgaaacttttcaatttttgaattaaaagtttttaaaattttcataattgaattgaaagtttttgaaaatttgagtggttatttttcagaattgaatttttccatttgtttgtatgttaattgctattccttgtatcttattcatatggtttgttttgttccacctaagtagagaaaagtaaaacatgtttttgcataagaattccggatatccgatggaaaaataccggatagtatccgatcgttatccgattttcgacggatatcacctatatcatattcgtttttatttctgaaaaaaatatccgaattcatttctgaattcgaaaattttcatatatgtccaaccgaaactatccgaatccgaaaaaaggtccgaatcactttcaaccctactaataagagaaccatagcagatcgaaccatagctgacataattgtgtagtgtacagtatcattatctttttacattttaga

SEQ ID NO: 18985 - DNA, 1464 bp, Oryza sativa
tacattttttcatccattttagctggattccatgtcgacacggtctatgcccaacttatgactgattctgggcctaaaacaggtgtataataccgccccgtaattttttccatttgggctgaaaatgtgcgtttggatgggctgtgatcggattacaatccgtcggaaaaggcccattactaccagggaaaaaaactgcccaggagtctcgccttgccctctcgccgtccgtgccgccgccgccgccgcctgcatctccccttcctaatctgtgacgacggccggagacaccgtacgttctggctggctgcagaggagagatcagaggagagggatatggtccaaggcgacaacagcaacaacatcaattgccactggggacatatcctctcgtctctcgaccaatgcaaggcatggaagcagttatggccagttgaatttggattggagtttttgttgatgatttttacatctgcggtgtttgattctagtttgcttcgttgccaatgttcattgctctactatttcatgaattgattttggatcctagcttagcactcttcaatatttccatatgctaggtaacatccatcacccaacaaacggtttgtctaccaagggaaatttatttcactggtaattatgggtaacacaaaattacactcgtatttcaatcacagacagttgatttgtattttgtattctactccctccatttcataatgtaagtcattctagcatttctcacattcatatttgtctagattcattaacatcaatatgaatgtgagaaatactagaatgacttacattatgaaacggaggaagtatctatgttgtttgtaacctgtattgcaagcttaaatgctcagactatgtctctttggggctacgtacatcctacgggatgtagaggctgtatatgacatgtgagtcctcatgtgtccataacatgtagatccagtggtaaataatttagcaccactcgtaatagtagcatatagttaattattccggggtttaatccattattaaaaaaattaaataggaatattaaatatgaaactcttattcttttttatctatggaaggggcaaaaatattcagaacccctttcttaacttaaggtttccaatcttcactttctcgtttttcgcacgcacgctttccaaaatactaaatagtgtgcttttaagaaatatggccctgtttaggtcccaccctaaaatttttcaccatgtcatatcgaacgtttgaacacctacatgaagtattaaatataggctaaaaaataactaattgcacagattgcgactaatttgcgagacgaatcttttaagcctacttgctccatgatttgataatatggtgctacagtaaatatttgataataacggattaattgggcttaataaattcgtctcatggtttactgacggattctgtaattatttttttattagt

SEQ ID NO: 18986 - DNA, 1501 bp, Oryza sativa
gattgaacttactgcattttgttattaaacacctcactctgagtttatttgtagaattttccaatctaaacttagatatctcttgctctaattagcgaagatagttttagttgtaattctgttagtttgctgtaaaatacaccatgaggcaactttaaactgtgggaagaccaagaagtacgtaatacattttcttttgataaggaacgttcagtgactcaattttaaccaggattttattttgcttatggaaaaatgtgttctatcaaaccgattgttggtgtgacctatattcgttatatgtaggggatgcaattgttaccaatgggcatctgctagaaagaaaaacatcgtgtaaactctgtggcgttgcactccaagtgtttgtggttttgccttatgtagtagttattttgctttgcgatatggtgcttgcaggggctgatcactggaggtgtgattttgtttgccagttgagggaggaattcacacgcttctgttcactgaggacatcttctcaacctattgcttccaccgatcatctttaatgatagattagctttctgtgtacctgtatttcatgtggttagctctcaaccaaagtggagtttactttttgtacttctatactgtaataagaagtgccttgtattattttaatttggttttgtgtaatttaatcttgagaacaaaatgtgttgcaataggactcacttgagagattcatatggttcagaagtatacatatgattgtattattttcgccgttttatataaaatgttttctatatctctgaatttatcaaacccacctttttaagactttctcaaacgcatgtgatttctgaatatgaaggtacacttattgaactggatgtatgaaatagataactgcccatctattcctctgaaattatactgaaaaatgaattaaataatcatgcatgccatgtcccaaacaaaggactcttcccctgaattgcggtcttaaaagtattgcatcacagcaatacacggaacccttttacaattagaggacatccatgagtggaaattatttacttttaaaatgcgtgtgaatcatttagattatttttcttgactatgcaaatataaactttatagagaattatcacctttttactctgccctatttcaaacctaggaaattgcatgcgtttctgcagtaactgaattgcttaatgtatatttcttttgattagttaataacagtataagggtgcataatttatatttctgtgcaaacactgttagaagagtttgtgcatgcgataatagcatatattgataggagatagaatcggtttctattttctttcttatttcacaagatgtattctatctctaattgtcccagtttgtacacgccacgatgagggcttttctcatctatattaacacgtaacgcggcctcgagagaggtagaacgcttctgccaaattacatggtatcagagcctcgctagccacgcacgagattg

SEQ ID NO: 18987 - DNA, 863 bp, Oryza sativa
tcatcgtaggccttgggttaaggcaggttcgtgtgggtccacggccttgattaataatactgtgtatctctagaatcgtctttataaaatagctttgggcaactaagtgtcttttaaatgctgtcctgcaaaacctaatcccctatattattaccccttgtttcctttgcattaatcatgcatctcccggtgtgacttgctgagtactgtggttgtactcattcttgctctatattcccccccccccttcagtaagagaagctttggagaagaagtcttaggtggagtcctggcttataccccagttgagcgcctatgaagatggagccgtaggccaactagtccgctgctgtttattttttattgtcaggcttgaagtgcctttgtaataatgtaaatattatcgatataataaagatgtgtcgtttgtatcatgtttgtgtggtgtaccccggcttttcataggacggggattaatacactagcgttcgtgaaaatgcaaattttctcggtcgcgacacaagctgagaatgaggcagttcttaaagggttgcaattgctcaaggaggttgaagtcgatgctattgaaattatgggagattctttgttagttatcagtcagttggcaggagaatatgagtgcaagaatgatacgttgatggtttataatgagaagtgccaaggactgatgaaaacgtttcggctagtgactttgaagcatgtgtctcgagagcagaatgttgaggccaatgatttagctcaaggggcatcgggatataagccgatgatcaaagatgttcaggttgaagttgctgccataacggccgatgattggagatatgatgtgcatcaatatttacgaa

SEQ ID NO: 18988 - DNA, 561 bp, Oryza sativa
gatctagtatgtatgggctaaaactccgatactactttatattaagatattaaagcaaataaaatatactaaacagagatctaatatacttaaatgccacaagatcttaacatgaagggcagatctaacatattaattgagcatatagagcaagagcaactagatcagataagatcggctgaaactccgatactaccctaatcggcaaccagtaggcaggctagagattgaaattctaaacacgacttaatagatcgaactcaactgatacagcattaagtatgaaaagaaggacaatatctagacaatcaagccgctggatgtttcatagggtggtggatatctcatataatctaagccaacatcattatttaacctaatcggctgtcttctggtagcagatgttagctgattgtaggttagatgacgatattgtcaaagattatgcaagatatatgataacttgacggattacataaacaagattagagtatcataaagatgtaagcactaatcttgagaacacaagccgtcataacaagttttacctcttgttgaaga

SEQ ID NO: 18989 - DNA, 1501 bp, Oryza sativa
tggtagttttgcaataacaatttaaaattgtggcaaatttgcaattgccccaatatatttatcagcccattaccggaacactaggcttctttctgcttcctgaaactccaaaattattaaagatcgaagttaccaatgtgattccgattcagaagtacatagaaaatatcgtagtacaagaaaatatctccaaaattatttgtgctgcaagaaaatttggagcagcaccaaatcacaagccaaagtgcacaagcattacattagtgttccaaaccattgctgcgaagaagaacaaaagttccaaacccttacagaatgaaacattatctagcatcaccagtggaaatcctcaacagtaccaagttccagacttccagcacaaaaagttcctgtgtagattatgggtaccccatactcacacggcatgtttatccgactagttataggggataactcatatatctatgaaatatgtaatagatcatgacttgggtattacgtttccttgtatattacggaacggcctaaagtcctggttcgataagattgtaaagtagatttaggaaaccgataccgtattggttaaggtttctatcttgtaatcctgccctccatcctatataaggtgggcaggaggccctctagggggcatgagcacgtatgatcgtcagatctatactacacccggcagattcaaatccccaaacaggagtagggtattacctctcattgagagggcctgaacctgtctaaatccttgtctccgcatccatccacttttaggtctcgtgcgctacccccttttattattgccgaattcatgtttcgacagttggcgcgtcaggtaagggagcatcgagtttcctgtcacgagtgtgatggaaccaatgtgcgacatcaccagattcatcaagcatgtctttttcatctcggattcaatccagccgaagggatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgta

SEQ ID NO: 18990 - DNA, 1501 bp, Oryza sativa
  unsure (1)..(1501): unsure at all n locations
aaaagtcatgacaacccactcaaacaaaccaacaaatcccgggcacctaaaagccgtcttgtacatatcttcttccgccataaagatttgattgtagccagcattaccatccaaaaaactaatcaccttatgacccgaggcatcattgatcatcatgtcggctataggcataggatatacatctttgggagtagctntatttaaatctctaaaatctatgcaaactctaatcttaccactccccttcttctccaccaggactatgctagaaacccactccgcataacgacatggcctaataaaccccgccttcaacaaccgatcaatctcctctttgactcgatcatatagcaaagattaaaacgacgaggtggttgtttataaggcctaaaacctggtttgattggaagccgatgctcaacaaactcacggctaagacctggcatctcatgatactcccatccaaagcaatccacatactccttaagtagctcgattattttaaccttataatcggctctcatatttttgtttacaaaattcggccttggctttgttccatcacctatgtctatttcctccaatggatcggccgatgtaaacccttgtccaagcttctctacttcatcaaaatcttcaatagtttcaccaatatcgttctttgtagaccgatattcttgcaccctcttttgcaaccactctaaattagcttctttactcattatacaaatttatatagcctagccgtgctacactagccggctttacagagataagtacaaatttgccatcggagatactaatgaaatcatagtagaaagatccctccccgataagcattggatattccatgacgccattcaaatgtagcatcggccattgcaacctcggccgatgtatccgttttaacaatctcaacatcatcgccgtcccattgaatcaaacattgatgcaaggtagaaggcacacaacaattggcatggatccaacaacgacccaaaataacattgtagttaccttgcacatcgactatgaagaaagcggttggtagtgtgttgtttcccacggtgagctccaccgaaaagatacctttcgcctccattggttcaccattgaagccattgagaaccatgttggtcttcttcaattcattatcctcacgccccaacttcttgaataatgaatacggcattaagttcacggcgacacctccatctactagcatcctagagactggcttcccatcaacatgacctttgagatagagaggcttcatatgacggtttgattcatcgggcttctcaaaaaccgcatctttaggacctagtgaaaattgagcaacctcggcttcatccatagcacaaaactccataggcaacatacacaccatgttgatatccatgtcctcctttggagatgactcatctttagcaaccgattgttcttctttctcctctacaacaaccggttcttccctctctacggatttatgcctccaaaa

SEQ ID NO: 18991 - DNA, 551 bp, Oryza sativa
tttgttcaggactagattgagcaccgagttaatccttacccattagacatgtggttagtacagtagtgctttgcaacagaggcccgaagaccggtccttatagtggccgaggtgctactagcaaaaccctgcacctcaagcccagcctaaaaccattttgggggttttgaatagaggggggaggtgtgtgttcaattccatcacaagccaaccattccacagtgtccaaatgatatgagaattcccgaagtctaaagttataaaaccacctactgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcaga

SEQ ID NO: 18992 - DNA, 1501 bp, Oryza sativa
attacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttcggaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggaca

SEQ ID NO: 18993 - DNA, 1501 bp, Oryza sativa; identical to SEQ ID NO: 18992

SEQ ID NO: 18994 - DNA, 1107 bp, Oryza sativa
gggcgccgccaccgtcttcgctcggggtgggcggcgcgggaggccagggggagtgaatggttagggttagggtttgggtatatttatttaggttaggattaatctggaccatccattcgatcgaacggctccagcagctcctgtatcgggccgccggcctattgggccaccgaatggaggacgcaaaatggacttcaatggagaaagaaaacaggccagacacattgaatagacaaaagggaggggatataaactgttctatattcggcccaaacatagaaaggtggattttgatttttttttccaattaaataattgttaaatgatgtttgtattattaaaaattagcaatttaagctctgataattccaataaaatttcaaagagcgtaactaataatggagaatttaataaaattaaatttaaccatgtcattttattttgcagacgtgctttacttgtaaattgatttaattatacacctacctacttaaaaataccaaatattttaattaattacataatgtaaatttttctctttttttttttctgtacacttcccgttgcaacgcacaggcacctttgctagtgacaacataaatttaaacagatatcaccgtcaattttcaccaaaattgatgatcccaattttttataccattagattagatctctaatttattttatttaaaaaaagaaataccttattactatatgaactatataactatcagctagaaaaagacaaaaaatcataagtatgccgtacttatgtacaactggaaaaaagaaataaaggtttcttagtactgtccatgggaagaaaagaaaaatctacgcacggaatactataaaaacaataaaacaaaaaaatactgtcactgaaatagatcgatggtcttaatattttctacaatttaaatataaatatattagtctacaaatttatgtaaatatacgtagttaaactatattatattataaatatgaaatatccaatcaatgatctttaaatgtttatatacaaggctgatatacataacaattaatgctatgataactttttattggaaaaagtacgaatcacccccccgaactatcgcggtc

SEQ ID NO: 18995 - DNA, 1501 bp, Oryza sativa
gaccttcgcagtcgaaaagataatcttctcacgaactagattattccaaagccgagtgcttcaatcatcttcgctatgatctcccgagtacttttaccgaatcagaagaccgtggagggctgaaaaacaaagtcaggtgcatcgactagatgcacctaataggtgtagccccgactatgtggttaattgaataaaccaagcatacagtcagggaataaataatccaaccaactgagtggtttttgatcattatagttaaccaagtgacttgatatcaatatatagcatatgcggtatgaatccccaaataacatgatccaagtgatataccgactgctttgtaaaaattgatgcgagcaatctaaagttgactacatcattgaaaattcacttagcaaaacagctataaaaaagcttgaatgcagtgaataaagaaatttccaaagtattgggcatacaccatgcgcacactgctttaacagatgtgcttaagtccttaaaagacacatggtttcaccacacctggaaatatacggcatatgtggtgtaacatccgagtaaataaactcataaggatttaccaaccgcctggaaaatgaccacaatatataatcagcctaagccataatattggtcaataaaaatgcacacttacgtggcaaaaagcaatgatattgtatccaatcaattgcttgataaacccaaatagcgccttgactatataaaaaagtcagcggggtagctataaaaaacttcactgttgggcaccttttaaaatgcattgtaccaactcctaaaaagttgagtaactatggtataaaaagattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacatcctttaaaggatgacgcatgtaacatgctcccgagtaataaatctttcgggtgatatagaccaagtgtagctcatatgaatagcttatgatctgagtgattatcccttatgggatactcccaaatagatataataattgaatcccgactggcgtaagtattcggttgataacccttacggggaataataaatagtccagtctttgagcatagaaaatattggtggtagtgaagataatgataccaatcaaaagtgatgaagttgcacagccgtggaggcgaataaactagtcgatagcagtcaggtcagccagcaatgaatatgaaggcgcccagcgataaagttgcatagccatggcagcaaaataatcagtcggtgacagacgaggcagctggtgaagaagatgaagatgcccattagcggtgacataataagtcatccgtgaaggcgaggatatcggtcggtggtgacgaaagcaagccgagggtgaagatgtagacacgcatcaaaggcgatgacgaaatccaccaatca

SEQ ID NO: 18996 - DNA, 1501 bp, Oryza sativa
cctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaagaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtactctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgctaa

SEQ ID NO: 18997 - DNA, 1501 bp, Oryza sativa
atgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatcgatcgatcagcttcttcaataacaatttcggggacggctaatgggcgatcgatcccctcgagaatttagactatttaccatcaaattcgcgtgcctcaatttttttaccacccaatccgtatgccctttataatatgtcattaggactgctaattagtttatttggtaccacttttatctatctttttatctatctttactgtaattttcttttcttaattttatttgtatatattttcaagatttgtggacatttttacccctgggcccacctgtcagatcaaagaaagatactctgggtctggatcgattcgctccctccaggcgtagcgccaccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatcta

SEQ ID NO: 18998 - DNA, 1501 bp, Oryza sativa
tggaaaaaagttcacctgaggttcctcgtattgttgccaagttacaaaatcgtccataaataaccccggttttgtcttatgtggtagctgagttaacgtaagacccatatggcagcacctcaatcttcttcgacatctatcctctcttttcccatctcaatcaagccttcgggatggctggcaacgggcggggagaaccggggtcaatactgcctaagcacctataatgatccggttatataagtttagggatgccatatatctgattttcggttcaaagacgattttttaacttcgtgacaagatgggagatcttaggtgaacttttttcctttgcgaatacatcaatgtttgctagcctctcctccctattgtgttggttcattttgcaatgggaaaaaagtccacttacatccctcaactaatgttcggtttcatttaaccgcgtctctcaattacaaaaccaggtacaatgtagccctaatctaaagaactggtagagaaagagatggggtgtttacatccaaatttggcacctaggaataaaatagagaaaattaccaaagtttggaagtctgccggttttcctctgagatggccggtctgaccgccgtgcgttggtcggtcagaccgccgccagtaggtctgtcagaccggcggtgtgtagccggtctaaccggcagagtccgatcccgagtctgtttcgtcgggtttcgagttttccttgcttgggaagtcatgtttcgggtttcctttggtttctatcctgagttggacgtggaggagggcctgtagagggcaagaccaacccctatataacggacaaggccggttcaattgtcaagacacaatcaacaatcaatcaatcgaatcgtttttcacattgcttttagtttttacttagtttgttcatctttgtcgatttgcgctgtaaatcgtccgccgccgctgcgagagtacgacacctctttgtaggtttgtcctgaaaaccttccatttttcccacgagacgggtagttatccatcattctatctagatcggctccgctagctggtttagtttatcaaaacccatcttgatttagcgtttgctaaattgaggtggttggcaactctaggatcaccgcaaagctttaggtgttgcaattgtgcttgtcaacttgtcataaaaggttgccaacacagggatagggatttttttttcgtgtgtgtctgacatgtgagtctcatcgtatttcatttctttttgttgaccataagtatcatgtactccctccgtttcacaatataagtcattctagtatttctcatattcatattgatgttaatgaatctagacatatatatctatctagattcattaacatctatatgaatgtggaaaatgctagaatgacttacattgtgaaacggaggaagtaggatcttgggattatatttacatccgttttataagatgaggttcccggtttttctggttgagggactcgattgaaactca

SEQ ID NO: 18999 - DNA, 1501 bp, Oryza sativa
gggcccacgtgacaggttgcgtacggtgggccgcggcggggggcggcctggtccgcgcattggcccgctcgccagtgagtccgtgataggctgatgggttgatgaaattcatgcggattttacgctctatgtcatttttggtctaaaattattttaaaaattatgaaattcgatattattaggattaattttaggggtttctttattgttttcattgttagagcatcaccttacatagtctcaaaatagatcctaaacccaaaattgagggtttttcttttaaagaaaagatcaaatcgaatagtcgacctggttagatgtccaatgtttggaattcccaactttggttttttttttccgttctccacatatagatttgatagacctccagatactctacctatctttctctattttttatttttttagcgaaacacaatacaaatgaacttgtgtttcgctaaaaaaaataaaaaaaatacaaaaagataggtagagtatagatagatactaccagggtttccaaactgtttttttgggtggttaccgccaccctacggtttggcggttgccgcgagatataccatagttttaaaaactgaaaagataaccgtacacgataacagtggtaaccatacggttaccgcatgtttttttaaaccatgaatactgttgaatggttatcctacttctataaatttcacacaatcgctagaatacgaggtaacagttctataacaaaacttagggttcatctattataaaagaattaaagtcttacatattttttcaacatcaattttttttaccttcgagcaaatttatccatatcagattatttgtgaacgaaagaaaataacatgtagaagaccctattcgaacgaacctgatgaagaagaatattacttcctccttttcacaatgtaagtcattctagcattttccatattcatatctagattcattaacatcgatatgaatgtgagaaatgctagaatggtttacattgtgaaacagagggagtaagtaagaacacgtacacaagaaagtcattatcatatgcttatttgagttttaatctttacaaatttgatgaaaggaagatttatttgatattttaaagtaactttcatttagaaattttttatacaaaacatattagcagtttgaaaaataacaacagagggcgaaagaaatttgaaatcctgaacgactcctactcggctactccgacctcgcggaagtcggtttgacgccaccgtttctactcacccaagccgccaccgcacttcgcacccgaagaagaacaaaccgcctccaaaaatctagggtttccacccgcgcgcgacgcgattcaggtgggcgccgctccctctcccgctcgatccctcctattcctcttcctcctcctcctcccgcgcgcacgattgcacgaatcgctcacgatttccgatccgttcggccgcgtccttgcaggtgtagcagcagcggcagagggtga

SEQ ID NO: 19000 - DNA, 1501 bp, Oryza sativa
actaattttgacgctaacatctcatccgagaggtgacacatatttgctatatttatcataggttagcgccatccctactagcgctagcctctatcatgttaaattgttgtgcaactttcagcctagatgatgttcaacctttatctaactcattttttgaataagttttttagcgcagttgactcttataatgagtttttaagaagggccggattgtcaaattttcggtacatattggcgtctccatcgcctgcagttgctcatccatactgcaaacatcattattaatttctgagataacgtcgactgctattcttcttggtgacccatacctgcagcttagctgtagctaaacagaagcacccttacggaaaaaaaaacgaattccaaataccttgggcaaatccagagagaaaaaaaatccggctttaaaaagcattctgcaagcgaatttttggaagcaaaatggaatcattcctccctccatctaaaaaagataacctaatacatacactacgataaatctagatataaaatatgtccaaatttattatattagaatatatcacatcttaagatgatgctattttttttaatggagggaggtacggtatcgaactagagcttattcggaatggagaagaaacacaggaaaaataaaagattttggttcctatggattactttactgtgacgtcattcggatcacaggaaaacgttcgtagaaaatacatagggaaaattcctgcgctagccatatcagtggaagatcacaggaaaaaaaaatccacgctgacctcttttttctctccctccgcgtgggaacgaggcaaatcatgccatcaagcaactaaagcatactattaggttgattaatgttgtttaatttactagtagcatgtgataattttgtaatagtgcaccttttcttaaagattcctatgtttttactttactccatccaaacacatattcacatgaaattcctatgttttcaaatcctctgttttatacttacatttttatcatattctaatgtttttcctattcctatattttttcaatctgcattccgaaggagcctactgttggccggtcgttgtactacatcatatgctatgaatgtgactgtcagaggctcagaggcatgcattaacattagtagtatttttagccccaacttggattgcaaacgcctgattccaagagctcgccggaaccgcggatgtggtggtagctgaacagaaaaccagcacccccctcggctttacttctctgctctgttcatcggctgtgtgtggtgttcttatcttattgaagtcttctgggaatttttggcataaaaacaatatctttagtactttggtagagtaacaagctgaaactgctgtggccacatcacatggtatcactgtcagagtctgaccatataatttcaggccatctggtgccgaagctgaactcagcttgcaaacaccagtacgccatacggagtcggcga

SEQ ID NO: 19001 - DNA, 1501 bp, Oryza sativa
catccttgagttaaaagaaaatatttcttccagcggtttatgttaatctgttccttttatttattggttaatgtaagaactttagcttttgtcattctaatgttaacatgaggaattaaggggcctccaattagtaaagataaatatatttattgtgcacttgatttatcttaccagattctccacttatattgcttacggccagtccaagcttgccaacattttgcactctaccgagcttgcacgaattctgaaggtagtgttcttatttgctaagcatgcctatgagtaaattttgtatgttgtctctgtttgcatatgattatagccaaatctatgaatcataagttggaaaccgttaagtatgaatagggagatggtgtgaacatttcagcaaatgcgatccatcccggttttgttggaaccaacctattcaagaactggactatggctaatggtaatccctagacctttcaatgcaaaattgttgaagatatttttggaataaattagtagtacttgaagaagcatactcttcaaaatattaatttgggatgattcccaaacattttgatccttgctgtctggcgtggaaaggttgcatctcctaaacacatgatgctatttgtgaatgcatctccttttataccattataccattttcaattgttcttctccattacagctgtggtgaacaccattggaagaatcgtatgtaaaactgtagaacaggtgaactttttttaaaaaaaatgaaaaatctcgtcttttatatatgttgttatgttgtagtgtggaacatctaggcgactctaacctcgtgatattattttttagggtgctgcaacgacatgttatgtggcattacatcctcaagttactggaataagtgggaagtacttcagcaactgcaatttagagaccccaagctcacaggcttcaaatgcagagttggccaagaaactatgggaatttagctccaacattgtgtcggctgccaaactgtagtttgagttattcatatatgcatgcgctacattttatttcgtgtaagccgaacataaaattttcatagaaagtctacaaataaagagagtgtagttcctcccaagaatcttctctgttatactccattaaaaaaagaagtctgttttgactttgagttgcctaacttcgcataaaaattgtattttaccaataatatcttatacatcatttactctgggtcaaaaccgatgagtatccgtgatggagggagtatattgcctagttagtgtggagattcatcccacctcaccacgcactccatctgttctaaaatataacgtattctgataatctgattggacagaacatactttaggctgcgtttggcaagactagttgagaacccactttatttttcccgcgtgaccgcttttcaaactgttaagcggtgcgtatttttgaaaattcaaactgttaagcagtgtgcttttttaaaaaaatttctatacgaaag

SEQ ID NO: 19002 - DNA, 1501 bp, Oryza sativa
aatgacatcacccgtttgaatttacgagcataattgtgcaacgcgagagatgatttgtgccttttgtgcctaataagctaggagtagttaaggtcccgggaaaacttaaagatcacgaaatggtttcaccttttttctcaccgagaagctcatccacgagagcgacatcggccagcgagttcgagctgggaggatggtttcgtcagacccgacgggcgaaggcgtcgcttgcttaaatccagttaggttcaattcctcacattttatgaacctatattaggttgtgtttagttccacattaaaattggaagtttaaagaaattgaaatgatgtgacggaaaagttgaaagtttatgtgtactaggaaagttcgatgtgacggaaaagttagaagtttgaagaaaaaaattgaaatctaaacatggccttatacatgatttttacatgattaacctgtccacattcaacaccagcaataaccaacagcatttaatcaacaaattgagacagaaacgacatgcatttctgaagttaattatgtggttaaatccttggttattctcttgttccatatgagttgacagcctgacagtgagttcggttgttatggtttctcattgcctggtcctactgtcatgtctggcatgtcaacaatggctcatcagtcttaaactctttatatgtgatttttttttccttctgttaggtgagcagtcgggatgctagtgtgcaatggaacccaacttgatttcatcactgcaaattatgtatcaagttattttcagttttctagttggtctgttaatctgggttgctgttgcatcatgataatttcattggagttgttgtgcagtagacagagaggaggaagagtacctgaccaaactcaattcacaaaatcgatcctcatcatccaaaacatgcctggctatttggctaattacgtcaccgtttcacaattcacatacacacgatcaggaattaaacatgttcttcctgtaggcttaaaaacgaaactaatgactgcgactcctgatactgatacatccatgatctctgatcacctgtcacataattttttttttcagaaccaatattttgtcaataaagtgaatcagtctactagtatctttttctgaagattctgagtggaggagacaagcttctaaccttttctgacttttttagcactagtacgaagttgcagctgtcaagaacggcaatgtattcacaggtagataacccatatgtaagtgggaaaatatgtcgtgtaaactctatatatagtgtaaacttatctactccctccgttctaggttataagacgttttgactttggccaaatttgtagaaaaaaaacagtaacattttctacccaaaacaaatttattatgaaatatattcaattattgatttgctatatttgtctataaatttaatcaaatttaaaatagtttaactttgactaaagtcaaaatgtcttataacctgaaacggagga

SEQ ID NO: 19003 - DNA, 1501 bp, Oryza sativa
agaaagtttagggggaaaattaatgcaaaaagtaatatttacttcatcagagggcaaatttcttattcttccttgaccaggttaaagctgagaaagaagtgttcttttttaccaaaattgacgaaggacttcttcatctgatagaaatatatggggtcactaaacttgttatgggtgctgcatcagacagacactacaaaaggtttctctctcttctctttctctgagttctaacaatcgtggtacagtttcacgttatcagttcttattgattgtgacaaaaatatgactatttttgttgcccagaaaaatgaaagcaccacaatcacaaacagcaataagtgtgatgcaaagagcacattcatactgcaatatatggtttatttgcaacgggaagctaacatgtgtcaggtagggcttcaactaccaaatgggactcttatataaatctgactttattttattgtatttatcttaagccccagttttggcattatttcacagcaaggaatctcaacataacagtacaatatgcagcttaaaataatcacatgtaaatctttcagtatagggcctataggcagccatatgattgatacttcagttttgaaactccaaggcaccgaatcggtattaattggacaaataacagaagggatcacaatcttgactgtttaccaagcatgctgtatgtaactgaaggacgaatagttttccagaatcaaagatcacaagcctattgcagcagataaattctggcagaacttcacatatttagaatgagtagaactgagaaaaaaacatgtgtacatttatttttgccttgtatattctttctttgcgaatactttgtcctgtatatgttattaggacagtctaggttatggtcgagtttgtaccatatttagctgatctacaattcgacatgccttatcttataactatctgcattttgtcatgtaaagtatctgttatttttccataagagaatgattatcacaagtttattgaagcctaaataattcttaatttttcactactttgaatttttcttccactaaacgtctctgtttcttttcgcctagggaggccagttgttgccctgtaaaaaggtcaaaatcagcacgcctaccttcttctgtagacagttgcaaggtggatcttcaaagtttgcttgagcctaatatagaggtaaataccactttgtactacaattaacatgagcttttctagcgcggcttagtagatgttcacacaggaagaccattaagcatgtacttcagagataccaagaggtctctaaaactgttctgaagttaggaatgtggaaatgctataataaactcgaaacaaaatgaaacaaggtagtcttggctcagcaggaagaagttaaaatagttttactctgtgtttcagatcctttgcgcttggtatgccgtattatataatatccaaacttttacagtattttctgttaacaatcgctgattgcatttgcagg

SEQ ID NO: 19004 - DNA, 1501 bp, Oryza sativa
tgaatgttaaatggacaataacatgctttgggggtagatgcttggccacgggatgctgtcatgcattttgggaaacttcaaaccatgcttggagaattttcctccgtgtagcggccatcaacagacctcttaaccaaactcgcttgagagaagttcagagaagaagaaagaaaaactgactcctatcttgtcctcccctattactatcagattctcttaagaaaacatgaaagatgctttttcagatagatagttcctttctcagtttttcctggcttctagcctgctatgtttttgctatgtttagctcagtaaacaactggtttagctaaattgaagctagtgtttagttgtcttgccaggaaaagctggtctagctcagcatgctctacaagacagagtgatttgctaattgctactagaaaatcacccattcaataggaccatttcctgtgaactactgatcaaagtggacctaaaataactgctgtttctatcagtgagcagctcatttagctcataataacacaatatggtattatagtcatttatatttctgatgctatgtcctatgaggctatgatgatggatcaaatccatctctgatacagtcagcttcaggtgtgtagagctgctcgtgtttggatcgttgcgccttacaaaatcatgcataaggaaacaccattttctcacagattgaggtgaattaatgcagcagcttcagttgatcatttccaaaatttcttgttatctccttacatctcttcatattccatttgaggaaactttgctgctaatgcttgtgatagagtatgagtgctcagagcaattttggtatagagcagtgaattactactatgatatcgacaataaaagaagagcatatgctacaaacattgaattgtttggccaaaattggcagctaattctaaaggcgcaaaaatgtacgatagagaattatatgaggaaactagtagctaataaccaatatcactttccagtataactgggtttcacaaaccatgagcaatctcccagagtttattatcacaaattgtgccttttgtggctgcttagttattcttcaataaaatgttgttcattaaaaaatcagaaggaaaagcattcacattgtggcggacgcaagattagcaaaacatccagagtaggtacttgaaagttgaaggaacttatacagttatatgctagttgagtagtatatatgaaattgttcattttttcctgggacctcaggtttactaccttaccttagtacgatgcacgaacattatgtgagcgagctacaaatcagaactaaaacctactggaaggaagtccgttacacaattagtcacttaacaaaagcaataggacaaaattaaatcagttactaagcgtgatctggccacgacactaagaaaacggttaatttctcccaaattttaacatcagtaggcataaagtaacaatgctgagaaaatcacaagctcaatttttttta

SEQ ID NO: 19005 - DNA, 1501 bp, Oryza sativa
atagaagaacctcaactatttaaaccaggttcttcactttaataggatctactagtttctacatgcaaagccttagagcaagtacaatagcaggctacaagttagctataagcataaatggaataaataagagatgagagagaaaaaaacgggctatagttttatagccagctgcaatatggattccaaaatatatgagaggtgggaccatatattaatggtgtattatatatttataactaattattatatcaataagctatttgattgactatagacgatttgaatctattagttggctgtttaataaacttgctcttacgcgtttgggttttggtttaacagcatgcatgtcaacacgtgtagcagttcttctcacaaattgcctttggtttagctttctccaacaaaaaaaaatttgggccgtattgccttcacgtacgtgcgtactcgtgcccgaccggagctagacctacagtggttagcttgtgtgtcgtggttgagtccgactcctgttgctgcgtgcactaaaagccacgacggtaacaaactagaatcgagcgctgggtgctcctggaataaaaacgaagttggcgatcccgtctacaccgaatcgaattgctcggggagtcgtacgtcctcgtgccacagcttgagctcgccgcctaaagcctaccggtgagttgaattgctcgatcgttccggtgcagagggtgatgaatcatcagtcacgccgcggagatacatcgtacgtgttgccctctagcaacgcgcccaggcggctcgagttccgcatccttaagcgcggcctccgcaactagtggcggacgcaggatttcgagaatggagtagaagttaagaaaataaatatcactcaaaaataataataaagtcctatgtaaatatagtgtacattaaattattaaaattacaaaatacttaataaaattaaaattatactcgatcggaacttttttttttgaaaaatgggacattatgtttttacaatgaatatgtagaaaaaaaagttgttttcaaagaatttaactaactaattattcaagtttttttatgtaagttatatttcttatttattttatatagaattagttgcaatattctgggtacaaaatataaaagcccatggacaaatcatcacaataacatttagatggttcaacatattaaactttttcagaaaatttaattctttgaaggctccatagataaaatattcagcaattttaaaggttctataacctaaagtcacatttagcctataaatttcttgttgccttgtagttgtcatggccattggttcgtgccagtgattaagtgcaggatggactatggagggtgaggtattaattggactgaagtactaatttaggtgcagatatattcattttaacccacttttggtatatgtatgaaatataccatatgtatattgttctttttgcaaaaaaaatttgggggtacagctgtaccccatgtccct

SEQ ID NO: 19006 - DNA, 1501 bp, Oryza sativa
aacttttcagaaaacaaaataaaatatcattatcttgcaccttttttcttgagcactggtccagatagttgtccacattttgcatccggctttcttcagcaaaaaaggaatcaactaagacaatagaactttgctaaggattatgcaaccgaaaacacaatagaaacaagaagtaatggttagaggaaataaaccagaatatggcagaaagccagaagctaaagattatggtacaaacatcataagatagctatatgactatatcacctcctttattgacatcgagaaaaataactttagataaagccactgcacataactaaccaaagttcgatgtagtaattatgtggatgatgatgatctccgtgctactggatgcatgatcgataacccaagacagtatggacttgccatcggtgggttgctcagggagagcaacataaaccttgtctctaaacagagttttctgcctgagcatcatactcatgcatgcaactggtaaggccttgaagatggaactaagagatacttctatctaccagtttgcgtttcccactttggacaactaaaagagggaacacactgcgtattagcattaaagaataagattccagtttaaccaggtaaaaaggttgactcttgactgagactatcggaagacaacgcaacactcaactaccaagtcgcagtgaatggattatctgaggaaagtcatttggtacgctgtcatgccatgccagtacaacacggcaaaatttgctgggaacagggacatgttatgaattaatgtaagactctacctttctcacatccttcacccccattgctcaccacaaattccctgcctttcatttctaataaaaaaaagatgtagtgcatcgattgtgtgccagtgatagagccatcagtctatctggtgatctaatctaaagatctcggcctcatatttcagttactccatatgaacgggagaaacaacctacgggtagtgacgattcagcaataatagcatatgaaatttgaggcgaacaaaattgacaacaagcaaacatctcatcatcaccagtactgcatatgaaattaaatcatcgtggtacagtcaaatcacctttgacgattgactagaaatggcgaacaccgaataaatacatcgcggcggcggcggaatcgcgcagggagacggcaacatcggcgcgcggcgaggcgggagttgggggaagccgtcgccggctcacaggatcccaccggggtcgcccgcctcgccgtcggcgagggggaagccaccgccgctccggcgagcggcgaggcccatatttatccctcgagaaaaaccctcgcctcgcgtcccagcccaagttttaacgtgcggcccagtaagaagatacagcacgagacggcccattttaaagtgggccgcgaatctgcggcccacgaggaatttttttttttttgacgctactggtttgggagtttgacactgtgacgagtagaggtcaagttg

SEQ ID NO: 19007 - DNA, 1050 bp, Oryza sativa
ataatattttgaaatgttttactatatattttatcttttgtttatagtctccacgtctcttctaaattgtgcatcgatcatgcatataaagtctaaatttgcataagttaaccgcaaagtttaatttactttgcattttatttgctttgcatatgtgtgtgtacttttatgcttctctctaacccacctcataaaaagaattgccattgatgatagagattcaccaaattagaattgtttgaaggaaggtagaaggtacctaaaaccaacccactttgttattacaatgtgatccccacacctgggccacctctgttgttctgttattaatttgttgtgacaatgccaatgttcaatgggatcagtatctataatcctagcttaatttccgtgaagcatctaacacaagtctccttcggtagatatccatacgtggctacgtataatgaatctctggcaagtcattaagtcaagacacgcttgattgcttttcataccagaagaccaacagtttgtgtcctgatgacaatgggtattgagacagcacggttttgaccacacatatatttgggagcagttcgacacaccaagtgaattttatgtggaacaaatcctaccctggaaatttcataccaagtctaaggccaagtctactattttcacactaagtcagagctcaaattgttgttagagcaggcttaattacgcattgatcgaggccggtcagctgctcaggtgctgcatgggtaccacggagaagttttcgcactcacacatgacacatcaaacacccccaatgattactagtacaaaactatgcaaatgaactaagggcatgtttgattcaaccctgagataatactctatcttaaatgtgatctacatatcattgagatatcaccaaacttgctctccctccgatttttagtatttaacgccgttaaattttttatacttatcaatcttattattaataaaattacgaaacttaagagcttatagtatgtactataaggacatgccctcgagagcttggacctgttttgtagg

SEQ ID NO: 19008 - DNA, 585 bp, Oryza sativa
ccctcgcttgccgctgctccgtcgccacgctcgcgctcctctactctgtccgcggcttgctcgcgctccactgctcggcccgccgccgcgctcgcgccttccgctgctccgttgccgcgctcgccctccgctgcgccgcccgcatccgtgctcgccgctccgctcgctgccttcgctccgccgccggacggccgcgccgcgtagcctcgcccacggcgatgacgacggcggcggccacggcgcgcggctgcttcgccatcagcctgaaggagaagagaagagagagaaaagaaaagaggagaaaaaagatgtgaagctgacatgtgttccccatgtgtttttttaatttttttttactgattaggatgccacgtcagtaaaaccggacaaaaaatactgccgagggacctctggtgaacggtttgagtgagtttaggggtacacatttctggttttgtggttaagggacctccaaaaatctcgctgttaagttgagggacctctggtgaacttattccttttttttaggatgggcccgttcggcctaacttgaggaattgggttggtgaggcccaattcggctgg

SEQ ID NO: 19009 - DNA, 1501 bp, Oryza sativa
tcatgtatcagtgagaggaaaacagaagtgtcagaacatcagtggttacaagagcattggctctgttttactgttcaatcaaatgtcgtatgaaattatgaattgttctgcaatgtgcaatatagacaggtaaagaatcatctgtaggctgatgctgtagaatttgggaggaatgttcatgcagggacctccattgtggatgcctgagtctccattctgcataaacagatgcatatttagtaacatgaatcaagtgatgttggaactcataaaacatgggtgcagtctttagttgcagaaatgcagagtgcaagatgtcgaattgtttggactgaaatttggttcattcaggaatcaggattaactgtgtctgcatattcatttgggatgttcggttccctgtggctgtggctgtggctgcagtgctgcacagtcacagggctgcagtagcctagtatagcttgatataaactagtagttattgtggttgcagctgcagcaacatccacagcaacgtacagcaatctcaactgaacacccaatttctatcaggctaagatcaagtagtccatacattttactttatttttgttttggattttttcttgcatttactttaatggatcagtagatatgaattgtattaatgctaaccttctgtccgatgatcctatccaattaagatgtctttttgttctgcagagaagtgtacttacattgtaacagtgttcatccttcagtttattcaccaaactaaatgaaatctttgttattttgatcacagttgggcatggatgctcccctgccaaactcctaaatccccaattcctagtcaccaagcattttttgtcagtttcattcattttgtttgaattgcaagcaaacagttatttggatatggtacatgatacaatgctgtatttttgtgttaaaaaaaaaaactcctctagaatggaacaaacctgattagaaggtataatattgtgacaagttgagtcgcaaggatatgcgcaatcgatttctatgccaggccctctctcaaagtaccattcaccaaccagctctgcaattgtctgaaacaaaccagatatcatctatgtctgcctgcaaatacaccgcatatacacaacattttcatgtagattgccagtaccttgttatgcaacctgggcgaatttggtgctaaccatgtttcctgcagctcactctggcaatgtgcaaaacaagaatttatgaacatccctacaccctgttcattttggaacggcttcagagccgtcaacattgcattcctgagtcctgcagacagattcagaactctgaagaatgtcacgaagacaacaacttgaatccagaaatctcacatatgcctgttcaatggaatctaaatctgaataatctttagtgtgaatttcgtaagagcaatagacttgcacctattgtttatatgaaaattgcacagattagtatttagctctaccaagaaagagaaaaaaaaagg

SEQ ID NO: 19010 - DNA, 1501 bp, Oryza sativa
acataggagtctgtaagtccgaacatggagaattttaaaagtgaaagattagatttataaagttatcctgttggatcagaatcccgtgctctagtaatcctctttttatgaaaatctccgaccgttttcattccatatacaaaccgcggccaccgttcaaacaatcaaaccagcccaacaaaacaaaattgaataggaccacacgcagtcactcacgctcgccgccagcacacacctccgtgaagccggcgccacggtgaggcactgacgccgtgggcccacgagtctcccgggcccacgcgtcatcctctccatcccctcgtcgtcgtccgctcgcctctgcccccgtgccgaccttaactgccgccgttgtcttctcctccacccaaaagctcgcgaatcaatccacgcttcagagagagagagagagagagagaggcaggtggcgccgccgctgtcccgctcgtctccggtggccggcaggcggccgcagatctcgtctgtccaggatccagtgtgtgcggccgcgggccgccattgtttgggaggaggaggaggatgggtagtagcacaagcgccttcgtcatcaggtggatcaacttcttcaccatggtcagtcgccttccactcctcgcttgctgctcagttgccttcggctcgctgcccctcctccgcttgctgtgttgagcttgagccgcctcacggtttctttcctctctgggctggcggctgatttgctgaaaatgagttcatattgctgccgcggcatttgtaggattcgttgtttggttgggttcctcggctgtttctgtttgtgaagcttagctttcctgcaccgaattcagcctgtttgattcaatgcaacacatggattttgagttttcggttctcctaaatgccaaattacaatattcttttattgcattttttgccttcacatttgctctgagtttcttgtcttcctaatttcttcttctttcatttagtggctactctcaattaatcaatttcacttcttttggatactagtagcactcagtttccagtttaatgttggcacatatccaggctccacaaaatactccacgaccatacggaaagaaacattgcatctttcagcatcaatgcattttatgacactcttaaattctcttcttggttggcagatactggcactactggtggtggggttcgggttctggatgagcacccacaacgacgaatgcaggcggtccttgacgatccctgtcatgggtcttggaggagtaattttcctcatgtaagaatccaagtgtgtccccatgatgttaatctgatgaaccatggtgatttgcgccgtcttaacccggctcagtgttgatgttgcagatcgctcgtggggtttcttggtgcttggaagaaaattgcttgcttgctatggacagtatccttttatttctgaagaaattgatgcatatgatttttttattttatttttcttgtacttttggagttagctgtt

SEQ ID NO: 19011 - DNA, 211 bp, Oryza sativa
tgaatatgatagagctagtttccgaccgtattcgatccgttttcatccctacttattagtggtgtgcatagattctccccatgcattgccaaaaaggcaagaacacacagggttaaagctggaactttgacatggctgtatttggtcaagatacaagacaaaattccataaatattgctgcagttgctatgctgcatcttcatatttcagg

SEQ ID NO: 19012 - DNA, 1501 bp, Oryza sativa
gtctggatggtgagattaaaaatagttagtaaaagagacgaacttgtctattgtagagtggatatgcatgtactattgattactgccaataaaaaggacaggacagccatcatagtgggttaatttagaagactagcacaagtgctcagtgatttgtttgtgattttttttattttaaaaaagaagctgaaagtgagaggatggacacaggacaggagaattgtctgctacttgaagcctgataactacagatgctacaaacatagatcttttggcccagcccaacataaccaacacatatgagctttaggcccagcccatgtagccaaatagcccagatggaataaccagaaactggctaggctgcaccagtggtctactctgctgccaacgatttgtcttgtaaatttcaataagaaatcttttactagacaatcttttctcttgtaatctaaattgtaaaacaactgaagctcagataagtacaaggagcagcagagcacctatacattctgcatttatatacatgatcagtgtgacataccattgcaagaattttcactggaaatgggtttcagatatgtgaactgatgacccatagatagcataaacccccagagaagatctcctagcgtatatattcttccctaatgcgtctgaaaatttgatcagagatgcataagtcatgaattttatttaggccatatgataattcagaaggagcatgtagagttggagataactaatagtgaaatcgagactaaaaatatcaacaaaataatccctaacccaaactgcatgcataaacaatatcatggcccgtggaaattaaattcgataactgtatctcacgagataggtaggtacctgagtgcctgaatttcaaatctgtcgaaattaaaaaaaggaatacccactgatgaacacacacctgaatgtcatatgctcgtcagaaatatatttttccactgcacatctgcattcgtcatactgctcgatcaggtggccggcttacgtcatcgtggatgcaggatgcatatgcagacatggccggagaaggcagcgacggaggctgctcgtcgccggagatccaagaaggcgggggttccccttgcgcgactaaacaatacaataggagataattgtagggacttttaaaaaaatagaccaactcccggtttgatagtggatttatgcataaacacccctgttcccgttcgaatttacataaggaaacctccactgaactgcacgcaaagtttaagaaacgaattcaacttaacagttggattccgtttcgaattaacaaggaagcaatcggttcggaataacagttcaaattagatccggattcaattcaattcatcatgcaataaatatatgagctcatggcacctgatcggcaatcaatcaccaaacgtgggtcgtctcagagatcgatcagcttcagaattcgccgtcgatcaatttagacatctatcagctcgcgtgacatcatcaa

SEQ ID NO: 19013 - DNA, 179 bp, Oryza sativa
atccttcggtgattcggccacaacgcgaggcgcagtggctacatgcaatccggcgacgacggcgtggtggttcatcggccgatcggcgtcacgacctaggcacaactggcgtcggaggagatcgtcctcctcgttgttggtaccaatccttgatttctgactgctagatatatattctg

SEQ ID NO: 19014 - DNA, 1501 bp, Oryza sativa
tccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatgg

SEQ ID NO: 19015 - DNA, 1501 bp, Oryza sativa
aagtcatgacaacccactcaaacaaaccaacaaatcccgggcacctaaaagccgtcttgtacatatcttcttccgccataaagatttgattgtagccagcattaccatccaaaaaactaatcaccttatgacccgaggcatcattgatcatcatgtcggctataggcataggatatacatctttgggagtagctttatttaaatctctaaaatctatgcaaactctaatcttaccactccccttcttctccaccaggactatgctagaaacccactccgcataacgacatggcctaataaaccccgccttcaacaaccgatcaatctcctctttgactcgatcatatagcaaagattaaaacgacgaggtggttgtttataaggcctaaaacctggtttgattggaagccgatgctcaacaaactcacggctaagacctggcatctcatgatactcccatccaaagcaatccacatactccttaagtagctcgattattttaaccttataatcggctctcatatttttgtttacaaaattcggccttggctttgttccatcacctatgtctatttcctccaatggatcggccgatgtaaacccttgtccaagcttctctacttcatcaaaatcttcaatagtttcaccaatatcgttctttgtagaccgatattcttgcaccctcttttgcaaccactctaaattagcttctttactcattatacaaatttatatagcctagccgtgctacactagccggctttacagagataagtacaaatttgccatcggagatactaatgaaatcatagctagaaagatccctccccgataagcattggatattcccatgacgccattcaaatgtagcatcggccattgcaacctcggccgatgtatccgttttaacaatctcaacatcatcgccgtcccattgaatcaaacattgatgcaaggtagaaggcacacaacaattggcatggatccaacaacgacccaaaataacattgtagttaccttgcacatcgactatgaagaaagcggttggtagtgtgttgtttcccacggtgagctccaccgaaaagatacctttcgcctccattggttcaccattgaagccattgagaaccatgttggtcttcttcaattcattatcctcacgccccaacttcttgaataatgaatacggcattaagttcacggcgacacctccatctactagcatcctagagactggcttcccatcaacatgacctttgagatagagaggcttcatatgacggtttgattcatcgggcttctcaaaaaccgcatctttaggacctagtgaaaattgagcaacctcggcttcatccatagcacaaaactccataggcaacatacacaccatgttgatatccatgtcctcctttggagatgactcatctttagcaaccgattgttcttctttctcctctacaacaaccggttcttccctctctacggatttatgcctccaaaa

SEQ ID NO: 19016 - DNA, 778 bp, Oryza sativa
cctgtcgatagttaccatgcatgttatttggtgtcccacagttaataatatatgttctttggatatcctacagtaaagatggtaaactttaagtgtactatcgcaaattttaccttaagataaggcagattacaatgtttcggtgttaaaaattggaatcagaaaaaagtattacaatgtctgagcacaacatgcgacaacaaagcttctgaagcaaactattaattatggagttatatcatgtggataacgataggggattacaaatatagagatatgcatgtgttaatttcaccacacagtactactcgatcacctctgttgtccggtgcctctcatgattcatccatgtcttgtgtgccccatatttagttgaaatcgctgcccagccaaagattacgacgcagggccaatatgtaattagcgttcgaataaggagaacacgtgcaataactggcaatacctgatttcccttcctaacatacatcgctattgcaacacggggtgcatgcaatggctccgtgaataagcatagagatgcaatcatcatcattacacagattgcaattgcagtccatcgagccactggagccagtaccaaatacatacctagcataaaagcagcacccaaacttatcaccgaactgaaggccaggaataaagatatgttgaagtgccggcgacggaggggccaactaaccatagccattccggagtacatgaggtggatgatggctaaagttgagcaaatgaatgctattgtgttggccatggtgaa

SEQ ID NO: 19017 - DNA, 1501 bp, Oryza sativa; identical to SEQ ID NO: 18989

SEQ ID NO: 19018 - DNA, 1501 bp, Oryza sativa
cctttgccttggagaaccgctgcatgcaatgcgttctgtccacttaggcccgaatatgaaagattctctggactcatttgatgcaataactttgcgatgtcactacgttgtagcacgatagctaggtacaacggtgaaattcctgcttcatccgtaggggaactagccaattctggatcgaattcaagaagcttggtgatcatttccttgtttccgatgcggattgcatcatgcaagggaagaaaggccgtcccctttctcagaacttccttcaatctagccgctacctgcagatttgacctcggattattagccagatcaattagaaaagaaaccatttgggaatggccagccctgacagcgcagtgcaaaggcgtgccgcctttgttgttctgcaccagcaggagatgcggggccttgctgcagatgatctccacactcctcaggtagctccagccatcaccagaggtggccaaaacatgcagtgccgtgtcgccttcaatggtgaccccctccaggtccaggcatgactgatgcccatcatcaccagaagcttgctgcgtcgccatggtaggaattgcagggttagcttggtccaggggcgacgagtctgcagagggtgcaggacgatgacaagcaccttcctctttagcagccttctgttgcgtcgcagcttccatgttcagaagaatgtgatcggttatcccatcacaatcacctcgcgatgcaaggagtagcaaccatggattcatgggaggctttgcggtgtcctcctttgttttggccaccgtcagtttggatttgactgccgatgccatgatgggcggtggaggagcaccgaggctagctagcggcagttggcatctgggggcttgcggtgggtgctggtgctggtgcagcggcactaccactactcgacaatattgtggttaatcaaggagggtcacttgcagttgcagctaataatttgctgggcactgttgtgatctgcctacgtataatccacgttaatttataggttcattgatcggggagtatattgtttgccttcggcaacacgcgacaaaccacgagcaacaacattgttcgacacaaaaatatatcatgtgtacatgtgattgtgctttttttttttttaccttgatgctggggacggtgcatctgtcgcgcgactaccagccataaaagctctcagtcgccgtctgctgtctgctggcagggagagatatccacggtgtgttggagtttctaattcaagatcttcttactttagccaataaacaatcatcttctcttaattataatcaattcactgacctacgtttgaagccatcaatgattcctctgatttttcacttttcctttctttcttcttctctgtttcttcttcattttgttttttcttcttcttcaagaaccccttttagggcccctttaaatcgtaggaatgaaaaagcagaggaataggaaaaacacaggattctgataggaatataattgt

SEQ ID NO: 19019 - DNA, 1501 bp, Oryza sativa
gatctcctcatggtccttgctgaatggaagacgtggtggtgaaacctcagcaccggtgaacacatcaacaacgagacagtaaccactgcggcagcatatgagttgaccatgagaagagcctgcaaaaagcatcttctgcagagtttctcgaggaatctggcagcggagcggggtgtttcggttggctagatcaatgacctgacatgagcgtagtagcttgtgaggaccattgctggtagaagggatacaaggggatttgacgcggacattgggtcggacgaggagtggtgggagtaaggtgcgaaaggcagattttgatgggtatgatgagaaggcagcacgccaagaatggcaggtgccagcaaaggcgagaatgtcgacgaaggagcccaacagaggaacaatggagtgaagcagttcttcttggaacctttgcgcacagacgtggcagggggcattgagccagaggcatcagagatcttgctggggctttgcatgatggcagattgccgaactccctgcaacacataacgaatttgatcacaagttagaaggatgaaactgactaatctggaagcctgctagaatttcagctaccaaatacatgcagaagacatctaaggctctgttcgaaagagcaggttgggaacgtttggctctggcacgaaaaacggaacgatccattagcgcgtgattaattaagtattagctaatttttttttcaaaaatgaaacaatatgatttttttaaacaactttcgtataaaaactttttacaaaaaacgcatcaaaatagtagtttgaaaaacgtgcgcgcggaaatcgagaaggagaggttgagaaccatcacaaacgaactgagcctaaatcgtcattatacaatgggaaagaagatttcaattcaaccaggtgcatttttatgttcagggagatacaaatatacaatatcatagaggaaaagggctagtttttttctctaatcgaaatgttttcctgcatagtacagttttgagcttttctatggagcacttcagtactgtgtaatcaaataacgcgcataaaaatgatctgagtgtatttttgcgtactgattcctctctccatttgtacatcaatcaactcatgcttggcttccaaatttctattaaaaaaatcaacaccgctcatccaaagagtactatttttctattaaaaaaatcaaccccaaaagtagaagaggcacgttgatttacatgacacgattgataaacccacctaatcaaccatatcaatctagggttgttactttgttagcaagcacatctaacaacaaaaatccagtggaaattccaaccctagcgaacgcgcccgtttcttggttagggttggatgacacaagagatcgagaaatttatcaagaaaaaaaaaagaggaacagggtttaggcgcgagaaggcgggagggtagagagagcgcagaccttgtggaggaggtccgatctccggcgacggggaggacgacga

SEQ ID NO: 19020 - DNA, 1501 bp, Oryza sativa
cggcgccgcctccgtcgtcggcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtcaagccgttcccgttcgtcgtcctcgcttcgtcaaggtcgctgcagcccccgtcatcgtcttcgtcctcgcctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccgtggaccgcctctgtgtacccggtctaccgcagtcctttaggttgacatgtggggtccgcatgtcaacggcgcagccttcctgtcctttccaggctagcgcttacacctgttttatagttgcaaagcttaattataataatccgcaaatctccatataacagcattaaacctcggatgatcatattttggtcatacgaactccgaatcgacccgttcaagtctcttaatgtttgttataacctaaagaaccctgtgctttgtttttatgtattgttattgcttcttcataggcttgtagctttgcttgtgtgcttcgcgtagctttcgtcgttccggaggttcccgaagcgtggttcgcggtcgtcgccgaaggttcggaaggccgttctctctgagcaaggcaagtcacatcacccttgagcatattgaatcccagtttataaaattattttgatttaaattatcgtattatcgctttgcttaaattcccgcgttatcactgttttatttagccatgcctacttacctttgttatgacattattattgctattgttattattaccttgttcaccctaggaaaataagaaccccaactagtgggtactctattcatggttccactagtataaatttaggtagatgcttcgctgaataattaggcaacattaggtggttttataactttagactttgggaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaa

SEQ ID NO: 19021 - DNA, 360 bp, Oryza sativa
atgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagc

SEQ ID NO: 19022 - DNA, 1501 bp, Oryza sativa
  unsure (1)..(1501): unsure at all n locations
atatgaatatgagattaattatcgatcagtatatatgtacctttggacgtacttccagcggccaggcatgatcccttgcaggatgtcgttcatcaacttgtcgcaatcctccatttgcaggaacctcttggcctcgttgtagcagcgaggcagcctgccggcgaacagctcgatgacgacgtcggagaggtggcggccgacggcgtcgacgcgcaccttcttggcgtagcagcagcgccagtcgaagacccgcagcttgggcgcgcgcaggcggaagtacgagtactcggtgaagctggcgcggaagagcgtcttcacgcagagcatctcgtggctggacggcgggtcgggcttgccggcgtcgtggcaggacacgcgcagcgtggtcagctcgtcggctgagggacggcgatggcgggcggcgtgccgagcgacacgacgctgacgtcgtggatgcggaggtgcttgaggcgcggcatggtggcggacgtgatctcgatgctgccggagagggtgcagcctgagatgtgcagctnctccagcgacgggaaggcggtgttctggagatagcctgggtggagcaccatgaagctgtccttgaaggtgagcgacttgagcgcgctggcgccggggccatggtcgtggggcggcctcaccgagtaccagcacgattccatggacaagcaggcggtggcagccggcagatgcagggaccacggcccggcgtcgtcgttgcgtaggttctttgggcagttgaggaacagccccagcgaggaggcggcggcgagcgcgatgaactcgtcggcgtaccggcactccatgggcacgtccttgcggtaggccagacagagccgcttcacggtgtcgcggtctggccccgcgcagcgccggcgaagcgtgcgcgccatgctgtcgacgcgctgcctgctctgcgtggacaaggacgacccctgggccccgagcaccgacatgatgaacgacaaggcggggagcttggtgtggaggtgcttccaccgccgcgacaccgcggcggttcgcacggcttccttgtagcggaccatcgacaggatgtgcagcaggatgtcgtcgggcagctggctgattaggtccttgcctttcctcctcgccatcgtcgtacgtacctcgtcgatcgccacgaatattatacggcaggcacgcggcagagcacttgtatatagacacacaacatctttgcggacatggacggatagtcggtctcccttttggacttcgatcgctactgtaaagacgtgtaccaaacggggatgtacgtggtatgtacgtacgaatcccaattcacctaccttgcacacaagttattgtaagacatatatattacttagatcaatccaatagaaatcattggcctcaccgccgtccgagcgggtcgtcgaaaaccgtgtggccacaaggacaatgacggcagggctttctttttccctgaggtcacggggtcggagtactagatatgggatgacaa

SEQ ID NO: 19023 - DNA, 1501 bp, Oryza sativa
tgaacttaattttattgctgaatatcatttttgttgtaatttgtgtaatgtttatgcaacaaaatggtggctgaaccatggcacaagcacaccaaatcttaggaagttggctgcaaggattttgagtttgacctgcagctcctcagcttgtgagaggaactggtcagtttttgaacaggtaaaaagaaatttgtgacctgtagctttatgtgcatgctgtctattttgaattataatgcttatttatggaatttagatctgacctgcagctttgtgttcactacttggcttataggttcatacaaagaagcgcaacaggctacttcatgaaaggatgcgagatctggtgtttgttaaatttaactccaagttaagaaataagagagagaacaagggtagagatcctatagagaaggaagtggatgatgttgtggcagatggtgacaatgaattcattactggtgttgtgccttcatcaagtgaaatggatcaacaatgtgcaaaagagtcagcaccagctaaaaggaaaaggcctgtgcacgctaagaagaggaaagtcagaagcctacagtctttgatgcgcaatgccccagtgcatcttgaagctccatcatccgactcagaagattgtgatgatggtattccaatgcagacttctgattctgataagtcaccctctccctctccctatgtctctgagaccgatgattgatgactagaagaaatgaagattgcaatattgcctcatattagtaatttagtatccactatccagaattcttgatgacctttgtgttgtactgttgtctttattccagaatgttgtacttttgtgaaactgatgtttcagtattctgttaaccacttagcttgtgatgtaatgtactcctatgaacctgtaatgtactcatttgaactggttatgtatcaattggtaatggttatgaagttatgccaagatcatgtcttttatttatttatttatttgcaaaaacagctaaatggcttagctgcagctatctccagctatagctgtgcttagctgttgagaaggtcagcagctaagaggcttagccggagatttaaaactttgatattatctcaaaccaatttatttatttatttttcttttcaaaggaaagatttctattgcctagtattacacgattccatccatggtagtggtgtcaatctttttcatcggtgtgcccccacaggattcattgtactactacttaccattagtccattattattaccacagggattaaccacacagccattaatcagagttaggtccagcaattgtaacttgcttgcagctattgtctactgccactttttctgcactggaaagcggtggcgcacttgccgaaagtccattctacttgagaaatggcatgtggtgggctgctgtggtgccgtagctagcgtgctgcgctcattccacaaagcaaagcaaagcgaaggaaaacaaagggaagagaagactgaagaagaa

SEQ ID NO: 19024 - DNA, 1501 bp, Oryza sativa
ttccatattcaccactagtagagcccttcttagacttactgttctgatttcctttcttcttgaaagacatcttgttaactttgccaccatttttccagaaattcttccctttgttctggttattctggttattctggtttttccccttcttaaaggagctagcatttgcttcgggtgctgctgaacttccagtggggcgagacgtatgattttcagcaagtgtctcatcttctccttgcgcttccatgagcacggagactagtttagaatacttctcgtatttatcctggcggtattgcctctgaatattcacatgattggcatggaaggtggacaaagttttgtctatcatgtcagcatcagtgattttctctccacatagcttaagacaagtgacaatgcggtgaagaactgagttatattgctccacatatttgtaatcctggaaacgtaagtgaagccactcacgttttgcttttgggagcaaagcctttacttgatggccatagcgatccttcaatgagtcccaaaggacattcggatcttcctcagtcatatactcattcttgagagtagtattcaaatggtgcctcaggaaatgcagtgcctgatttttctcggctgaagttggtaaattattaactcctccagctgatgttgcaatagttgggtcctgaatgcagttcaggagtttcttagcaccaagcatgattttggcatctagtgcccatatcaggtaattctagctgctgactgctagttcagcaaaatctctcttagcaatatcagtcattttcctacactagtcatgcaaaattcaataagtactgcaagtaagagcatgacaagtgtgcaaatagtaaattgtctggttatccaaatttagtactgtgtcaatatattcccataattctcccaacatttctcagaattgttgtactatttatttaggtaccaaagtaattactgaattactaacccattaaatagtatcctgaaaaaaaaataaaacagctaggaaaataaaccataaatatgatgctctctcgtgtgtactaaatttcaaattatgagagctcatttcctaaaaaccatgtctctaggattctatggttgattcaaaaattaactaataaacagttaatatacagaaaattgaaagtacggaataacaaaaaaaaaagtgatattctctgtaatttctatgatcccgagggactattccgctaaaattccaaatccgcgtgtatcctgaaaattcaaggacatattcagaagtttgcctttttcgggccaaatttcgattcgagcccgactccttttataggcctaatttatactcggcccacctctatgtaccggctattcaaaggttaaccggcccgtcgggaccgtcgtcctgctaatggccttggcccatatgcggcccaacaagggcgccgcaccttatccaatcgggtggctagggttgaaaccctagcccctaattccaccgattcga

SEQ ID NO: 19025 - DNA, 1501 bp, Oryza sativa
ggagtcgctgacaggtggggtccaggttgccttttgaatcggattccaggtgtaaagcgaggatagaaaactgcaggatttggcccaccagatagatcccatctaaaccactaactcctgtctgagagctgaaataagtaatgcatcttgcaaaaattagctgtatatcaaacaaactgatcttggaagagcatattttcttagcatactgttacttttttactcctacctgattgtttaacttgtagacttatctggaatattgttaagcacaaggcagagtacacaacactacactgtgtatagaacgtgtaggcagaaacagatattgcaagttctttttttccttaaaactagtgctctctgaaaatcggaggtgaggtatagcatctctctctcggatggacaggtaacaaactatcaatcgcccctgcagattgtcgctgggcaattaaagtctgtgtcgtattgggcatctagcaaagtagcactcaatcgccatctcaatatttgacatgtaacacgcgctcctctttttggcttttcctcagcaagggccttagaaacaaaaatgtcaatattatccaaagttttaaatctctggctatagctgccgctatagccggagatagctgctgggaacggacggagctaagagatgcagtttttagcgctaagaatagcgggacgctaatagcgccatttagccggcaatagccgctaaactggccgtaatttagcgtagctaaattgtaaaacacggccggtctggcccaagaggaaaccggcccaactagaccagagtcgagaggtgggtaaagtgctgcaaaccctagctcgtaagctcccagcagcacactatccattccaacttcgaagcgctcactctccagctgcaagaaaagtggaggtggccggcggcggcggcgcaaaggcgtccggcggcggcggtggcttcaagcggatcgaccaacgcaggtggctcgtggaggcgaccggcgccggctgctgcttcgagcgggcgtccaaccagcggcggcggctttgaaggcagctgagcagcggcgcaagtccgacgaggaggtccgtcagtgcaacgtctccgaagcactgaagcagcagcaccaaaggtgacggcatggcacaacaatccggtcagttctcacatcctcctctcttttttgcttgtatgttgcagatcttacaatatgtgaacaagttgtccatatttgttacctctaatttcagatacttgccttatgatgtagatcttactatatgtgaattattttcttactccctgagatctctcgtttgcttgtttcgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcaga

SEQ ID NO: 19026 - DNA, 1501 bp, Oryza sativa
agccttgacttggactgcagcgggaacaccactccataggcatcctcgacggcacggacgaagcctactcctcggagaagccaccatctgacatgtactcaaactctagggtttgggggaaaatagagcaagactgagtactacccactatactcagcaagtcataccggaataggggtatgatgcaggatataaccaaaggataggtagagcggttcatttgcataaagcgagcatttaaaaacagtagttcaaagcagtaaaacagtggtagtaactaatcaatattaatcatccactgtccaacgctacaccacgttgcaacaggcccaaccattcacctgaactaaccaattccattagactagactagggtgagactaatcacggtgaatctggttgaccacccataaccgcgggcacgactatttgaatagttttactctgatcagaggtgtacaactgtacccacaagacacagccccatgacacgttaccgtgcgccgacatgccaccacgacataccggaaagaggctgtgacaggacctttcacataaccccctctagccaagcacaccacacctcaggtttcacccccgtccccagcgggcaacgggcagtcccctctcgtgcctaggtgaatccggaagcgacagaggccgtcgtagggcccgccccgctccatcacgcccacccttgcctcgatgcgtcaactagaggaaagctacactacaagcccagccgttgcccacgctggcttgtggtaagtacgataagttcttccagggcatcctgcgaaccggtccttaagtgccatggacgcgaccatcaaaaccatgcacccatagcccaccatttaatgcattttaattgactaacaccaggacggaggctttaatccaacaccaacactagaacctgaagtctatgcattaatgtgattctcccattgtgtgctagttgaactaaacatggctaagcaatccctagtgcaatatctagtcatgttatatcccaagctaacaaaggagcatagtacaaaaatagcatggttgtacagtagatatacatcccatagtaacattataaaacaatgcagtatttaagggaaaacaatagagcatttgcaatataggatcaacatgttcaagtgataagtatgacttgcattgctctgctgctggaggaacctcggcgactatttcaaagtacaccggagcaccgggagagccggaatctaagcgacatacaaagcaaacaatacaaacaggccaaaagactactgaaacagagaacaaaaccatttttaatggattctatgcatttttcttgatttactgagacttgaatgggcttaaacggagctcagatgaattttctatgaattttagaagattcactgtgtttttactataaacagaaaaatccttaattgatttattgcgcaataaataaaatcccggggagagagaggggcggcgtcaacatgcgggccccaca

SEQ ID NO: 19027 - DNA, 1393 bp, Oryza sativa
gccgctccctctccccatctcccgcctctcccctccccccagctggccgcctctcccaccaccggcgccgcttccctgcccttctccctcccttctcgctggcacggcgcggcgacggcggggtgtggcagagacggcgcacttcccccacgctagctgtggcggcggtggcgaccttccccacgctagcggcggtggcggcagtggctctccttcccgtctcgccgacacggcgcaacgacggcggggtgcggcagagacggccgtccctccccctccctccctctccctctccccgtcggcctcgacggtgacggcgccctctcaacggcggcgtcgacggcaacgacagcgtcggcgtcgtctgagggtggatccgtcggcggtggcggccaccgcgggcggatccggcggcggtgctccctcctctgcctctcttcttcctccagcggcggtggtggcgtcggcggccgccgatttttttttttcaatttttttccatggctattgctaaccgaatcggattgcgtacgtggatgaacgggacgaaaatagatgtgacgaaaggaaaaatacgaatatttatattagttatatattatgactcatggcacataatcacatatttaattatttaaatattttataaattttgcatatattcaaatctaagttaattttagtatatttgaaacaatatttttcaatgtaacaaagagtaaaactaccaatctctgtcaagagctcaataacataaaagttcatacacattctattttaaaaatttaagtaaatttatactcaacaagtataggcgtggagtcttgttaaactttagatccataatatctgaagttatgtaaataccaattataatacttagtttttctttttgcaactctggctataaaatatggggttttcaaaaatttattctttttaaaatattactgcgtccatatttgaatatatgacactattgatttatttggtttgggtgtgtaacttttgaccactatttttattagaatgtaattcttagatgaagcaaaactataatattatgaaagtacctataaaaaaaatctacacacatcgtttttatgtttctagactaaaaacatttaggagccgttgatggttaaatttcaaaagtttgattgaattgagtcaattgtgttacttttccatggggaaacatcctatgtaggcatattttgatcactttatcaaaacaaaatttataaaaacggagtactgtgaattaatcaaggtgatgtttaatttatattgctctgctatcataaaaacaatgcaatggtgagtaactttatgatggtcttaattggtagtattatcagcaggtgattttaaacattgatttataaattct

SEQ ID NO: 19028 - DNA, 1501 bp, Oryza sativa
tgtaagcgaccgagccctagcactgcacgccctcgccgccacatccgctgctgctgctgctgatcccctcgcgccaacgcgattgcccgccccaaacgagttgttgatccccaactcgcccggagccgcggactatatctatctctgcattgcagactgccaacacttactgattgggtttttttttttcgttttgtgaaggaacaagcaatcttgatggatttgaactcggtgccgggcagcgattcggatacttctatcccaaaaattgatgatgacaggtatgtggcctccttcaattttagcttaaagattgcaggctctacgcagctgtgctcgctgtaacctggtccatgatgagattaaagaggcacccaattttgtttgttacacggaataggcgaactcacacaccctgacgagtttcatacccttagcaaacgttctaggctttctagcattcagattcttggaaaattccataatattaaaatattcaatagcttattgaagcgcgcactgtgcgtgcataaatatttgtacaggatttggatttgaaccacagtggctagagtaaaacactgaaagatggaaagactgtgcacgctccaaacatgtgaaaccataattattttagaactttgtggcattcgctgaaatctgatttttctttccctgcctttgtttgcttcttctttaatgatatatatgagtagttctactatttcctcgataaaaactaggaccataagcttccttgaattcctaaaaggaaaaaagttaaggtttttgctcgatgtgtaactagccaattcctccttagcttgaattccatctttcaattggtaagctaagccaagtttttattgtgtaccaaaacaacaaaatagttaaatgaacaggcctagtattagaaatataatctattcactgcatgctttagttgaagtaggagaatagcaagctataggaatgcttctgtttacatttatttatatccacttgcagtgggggagaatatgtgggattacagcccctggacaatcgtgattccactcgatcatcgccatataaaaatgaccaggaactggccgatgcttttattgctgcctgcgaacgctatgctaagcccttcgcagagaagtggcgattgcctgaagatttggaaaaacgcaaacgacaggatgaatgcaagatgttgaaaataccactacgcatgtatgccaagcaaaaaaatatgccggtatggaaccacgaaattaatggcgatatattttggttcgatcatcaatccaaaatttctaaatctgtcttgttctagaagtgttagttttgcctaggctaattgggcaaagttgaaaattttttttatgggttgggagttggaaatgatttacatatctggactaatatcattatgtttatttcagcctgccgagttagagattatggaactgaaagaatatactctttttgatgaacatgggaaagtatatgcaca

SEQ ID NO: 19029 - DNA, 157 bp, Oryza sativa
gccgctccctctccccatctcccgcctctcccctccccccagctggccgcctctcccaccaccggcgccgcttccctgcccttctccctcccttctcgctggcacggcgcggcgacggcggggtgtggcagagacggcgcacttcccccacgctagc

SEQ ID NO: 19030 - DNA, 1501 bp, Oryza sativa
cacttagaaacataggacaaatgcgagcaagctcatctctataacgcacacacagacaccttatgtctatgagtataaacaaaaggctaggttggcatatcttgaaattgatgaaagtcaccatagacatctcgttatcgataagtacgtcgtctatcattgaaagtcagcctcgttatcactatcattgaaagaatacaacatgtattggtattgacgaagtcaatcgatgggtacgttatctatcactaaaaacaattagccgtaaatttgagcccatgtcaagtcttaacttgaactcgagtaagcacacgttcctttacaaataatttaaccagttgaattatactcaattcgcgagctttgtgatttgattttgagcaattctacggtccttgaggaggtaccatgaggtaccaaaaatttaatgtaaaatttggtacctcatagtacctaggtactaagaggtaccaaatttacaatagaaaaaattgtacctcatggtacctccttaaagaccgtaaaattgttttttgattttccttctatttaatgtacaatgtttccctttggaaggagggttatgatttctatattatgttctcggtacaaaaggagtcctagagaaccttcagcgagtctcaactctcaaaagagagatcaatggagtaatccagcagctgttcgtggctaagctttgggatgttttaagtttgcaagtttaactttcaataccctttttgagactaaatgtttaactggccaactatttgtttcaaaacattttcaaaatgcatagacaactttttttttcttgacaagtttagtggtagttcctactcattttcatgagagagacagatccaaaaccgtagttaattctcacatttaactctataaaccatgcgatttgtggcacgtgtgtttgccgcgttggagtgagctgtagaagcagcagcagtgcctgtgaccagggcccactacgcagctcccccaaaaggtagctagctagccttgccaaagctaagctggccccacatgtcatcctctaccagaccacagttttgtcaacaccttaccaccggcaagcttgccattattaatcaatttccgtttgattttgcttgattgcttggttagaaggggatggctttgtttccttgtgtgctgtcccgtgtaaattcaactgtcacgggcaatgggagagttcttggccttttaggttgttagccgatgagagcgacatattatggttgttgagactagaaaatgtgaccactctagtctgaagtgacaatcacactagctttgttttcatctcgagtgtctacttgtattcagatgtgaagttgctgaaatgctattcataatttcaccaaaaaaaacttgaccacggtttgtttcattacatttccattgaagaagttttccttacggacggttttgcccggtaagtgggcggtcactgaggaaaaacgaattttactatttttttttaaca

SEQ ID NO: 19031 - DNA, 1501 bp, Oryza sativa
caagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctcaagtcaccactctttggttgcttaacatgccaaatgtacttgcatgaatattcaacatgttataccgtcggatctctgcagatattcgggttagggatccgatttttttctgcattttaactactatgtagagaaacatgccaaagcaagggagtttggggctgctgatttctgcttcatgtcctgtctgctgtctccattatagatcgttttttttcccatcttttttagtggaggagatcaattgatcagacggaacctagcgaaggctagaagtattcaaggttgaacagatagatacttcatccatccctctgaaaatatacctaatataaggtataatcattttttatccatgtctcgttatatataactctccaatcatattactttcatattatttgcatacatcgaggtgaccttactgaagagacgattaatttctttttttttaatttatgtgttagtagtgttgtgcgttatattttgggatagagggattatctatagctgctttaaaaagaaaaacagagaaaaatgggttaatttgatccatgcaactgcaagagtaaattgcaccgctagtgtatcaacttgataagtgggtgcaatatggtgtaagaacttgataaatgagcaatctagtgcaacaatttggtaggtaggtgcaatttagtataagaactttataagtgatcacataaatacaacaactttgtaaggtaggtacgattttgatacaataaattaagaagttatgtggcaactttattattgggtgcatatttatattggtatcataataactagtaactgaaaatcaattaaactgaatgtataaattattatatttagttgatatttgagaaggtgaagaaaacaaaaaattcttaaaaggtaattggatgtaaattatatgtgcaatataattcttaaagattacattcaatactataaggtaatatccgtaggattatgtaatgttatattgacatcgtgaaaaaaaaatcacctagcatatgcttagccaagttaatgcaccaaaatactacttcctccgttttatgttgtaagactttctagtattgcccatattatgtctagattcattaacatctatatgaatgtggacaatgctagaaagtcttacaatatggaacggagggagtaaattatcaag

SEQ ID NO: 19032 - DNA, 762 bp, Oryza sativa
gtgtacgtgcgcttgaataaaggacgtgagttaatttgatcggtgtcgatggtgtgtttttttggtattcaaagtttgaattccgaatttggtcatcagtttatatatcttgagctcatctatagccgtgtttagttccttttcaaattcttttttaagtatacggacacatatttgaagtattaaatatagactaataacaaaacaaattacagatttcacctgtaaattacgggatgaatctattaagcttaattaatccgtcattagcaaatgtttactgtagcaccatattgtcaaatcatagcgtaattaggctcaaaagattcgcctcgcaatttatatgcaaactgtgtaattggttttttcatccacatttaatgctctatgcatatgtctaaacatgtgacggaatttttggaagtttgaagggaactaaacacagcctgtgttgtctagtttgtactaccccaatctctcgattgaaatttctcataaacaaatttgaaccctgggataatacgagcgttctgatatgatcaaaaccaagatgaatagatgatacgtgcgtgcgtccaacttgtacttgaaaagaaaatgatatactcaattttcttcacaaagtacaagtaaaatggacctttttttttcctaatgactttactggttgtcaacctttttcccacgataattttactggtggtcttaaaaaggagagaaaacctcggaacgtaaaagacattaagtgaaaactcaaaagca

SEQ ID NO: 19033 - DNA, 1501 bp, Oryza sativa
ccttcccatttcagataatcagcgttctttctgtagtggaaataacttttcttgtatcttctattgattgttcagttcatcagggagttcaccgctagccggatttcagaaacactgcatgcagatcaagatcagcaaccggacatatattgatggaaaatggcaaatatctctggagaagccaaaacagaagaactgtgctttgttcagcagcataagggagatggctggccatggaaacctgccatccaaggtatcaatgtactgttcttgtttttcttatattaaaaaagctaatcgtttgtacaagctgttaaaccaatccaattaattaaaagaaaacatggtaaggactagggagaacccctgaatgcttgactgaataatcaatacagaaccatggtaaagagaaacctgatgtcaaaaaagaaaaaagaaaccgaaagtttcagttaaatttctgtacaaccaatccaactaatccaaacaattagttgcataatatttcataagtttcccccctttcgcaagcatgggagctcatcaaactccccacttcatggattaaaacagaactccaaactttcaagggttccaaacaaagcagagacaaaacagcctaacagtacaaaaccaacaagaagcacatccaagagcagggcttcatgcaaaacctacctgggaatgcagagatcatgaagagaagctccagcaaccggccctctctttctcccctcctctcctctctctcactcagcaagtcacatacaagaagagccaacagattactcagaacatgttcttgaccatgtgaacaggcgttgggacctgcaaccttgagctgtccatcctttcggcaatccggcgacgacgaaaggaatcggaggcttttcttgcgctgttagctagcctaatccaattcctggtcagtatcaggctatcagctttactctccctctcttcttcttcagtcttctcttccctttgttttccttcgctttgctttgctttgtggaatgagcgcagcacgctagctacggcaccacagcagcccaccacatgccatttctcaagtagaatggactttcggcaagtgcgccaccgctttccagtgcagaaaaagtggcagtagacaatagctgcaagcaagttacaattgctggacctaactctgattaatggctgtgtggttaatccctgtggtaataataatggactaatggtaagtagtagtacaatgaatcctgtgggggcacaccgatgaaaaagattgacaccactaccatggatggaatcgtgtaatactaggcaatagaaatctttcctttgaaaagaaaaataaataaataaattggtttgagataatatcaaagttttaaatctccggctaagcctcttagctgctgaccttctcaacagctaagcacagctatagctggagatagctgcagctaagccatttagctgtttttgcaaataaataaataaataaaagacatga

SEQ ID NO: 19034 - DNA, 1501 bp, Oryza sativa
acacagtacgtcgtgctgtcttggcgacgacatggagatcaaggtagatgatggatcgaacctaaacatcttggaattagcacgaggctgcttgcagcccggtgctttatgcccctgcggctctgcaatgcagctaagctaacacatcattggttgattaaggcgcagagatctggagttgaatagttggatgagcccagatgcactgtcagtgcttgtcggtgatgcatgattatcgaataactgatcggcgccacgtgaacttttggagggagatcgatggttgatgacgacggtgactcaatcatttagccatggctcctgttgtttttgtcctcttcttccttttgaggagaacccacacatgtttgatcttcatttttttgagaaagaatgtgcatacacatagttaatactatagttaatgtatctttgcgatcagcggttgatttgagtaggcacaactcacaagctcgtcccgctaattgtcggcttcgacaagcggtagcaaactagcaaccaaaaccagctaaaatgtgtcaaaattaaaaaaaaaacaaaacaagctaatctgggccgttcatcccgagcccattgcaaccccaatgcttataggccttatgttagtgcacgatcttgtttcggcccaatactaatggcccagaggtaggcggcgatcctgtcccgtgccaacaatatgggccgcacgttggacgctataccgttacggcccaacatttctcggtcacatgtaggcctcatttccattccagcccaacatttatcggccgcacatagtacgtcgacccgcgaatctacttatttaaaagcgattttgctatatctcactcgaaagattttttttcttatctatcactcgattttctctctcaattttacattgcattttcttgtaagttacagtgtaatttatgaaacttacactgtaacttttgtaagttacactgtaatttttgaatcttcgcacgtaaattttaaattttgtattggatttggtctttttcttgaggatatggtaatttagtgtccattatggtgtttcttaattgtcttttgctttttattatatctatcggattttaatccaaagattaaaaatctgtgtgatacgattataaaaatctttcgaaagatgtataggtactccctaggccgcattcatatatgggccacagtgaggccgcgataccgaatggcccaatacatgtgggccgcacgtcggtcggagatccagttccggcccaagtatggtggtgggccccacgccccaccgtccgaatcgacgccgcgtaggcgtagcctgcaccttccccgccacgtgttccgccaccgctctcaactctctctttctagatcgactcgcctcaacagccaaaccgtcatccccgttcgtcgcaaagagagaaaccccccgcacgaagcaaagaagccgcaaccgcaagccccaagagcgaaaccgtaacgaagggaaagtttggga

SEQ ID NO: 19035 - DNA, 851 bp, Oryza sativa
atgcgaccaatatagttccaacaacagctaatagtacagaggtggagcttcatggaggccaacctgggtgttgccccctcagctttggcagcaaacacatatatacttaacaagtatctagtaagaaaatttattttctgctcaattgattagcaagtgaagagggcagatgctttcttggaagtttggtgttcaaatcctgagaagtccattctttttcttcagtttaattgcttactaaatcattttcctcctatggatgacaaacatttttatcttaataaaatagctctcttaaaacctgttaatttacaataactttgatatgttgtcttttataacttgagtgatccttttccacctgtttaacagctatacttaggtataacatatattttttcttaacaaaaacatgcttggaaattattttacaatatgaatagcccttctacaaattctacttctgccattaccaacatttccactctataatagctggccccatctagaatctctctcaagctccgccactgcagtagtacctttgcaaatcgggcctataagaacgcgatcctcggccaacgaatcgtcactgcatcggcatctggttcagcaaaactgcgcataacaaagaaatgctaagtttcaaaccaactgttgatagcaagtcgagaaggggttctatgtgcaagagtagtacaaaagccactgtttctctcttctgcttcttcttcttcttttgcaaaataggcgttggagatgagcgcgcattacttctacccgagtatagattcaatagacttgctcgaagtgtgtgacttaagcataaaagcaataaaacgacccccgta

SEQ ID NO: 19036 - DNA, 877 bp, Oryza sativa
ttgaaaatccatagtaaatcaaccccgattgaccccgttcaagttcctaattttttttaaaaaaattgagatctacacagtggcatcattgtttctctgatttgagcttgtgtttattgctttttgttaattagtttcgcttttcacgtttagagcccgagtacgagaaagctctggacgccgtttttgagggagaagacccccaaccctgtgcaagccaagcctctttgatcacattgcccctatatttactaatatatgttgtttgaaaaatgcattgcttagttcacacgaataacatgttttggcctcggattgtttatacaactgacggactaacctagtagccgcacttatattttataggttgatgtttccatacctttgatagctccacaaatgtttacgacggtatcgttatacgattaccaaggtagttttgcttagccatgcttgtttaaaaatccggtacgttgtaccgaggagttctgaaataaaatgtgttgtgaaagtggtgatgatgcagagtcatgcctttgtggtgtgccaatggttgtggaatgccgagaatgaggagatgaagttttacacatttttgcccatcatgggtgtctttttgcctctattgtggcatggtgccagtaggagtaggagacatcctcggtatttcctgagtggatgacggctgtccttaactgatactcggctatggatcttagcctttaggtggcatgtgattttcatgggttagctttagaaatgccttatcacgaacttccattaccgacgggtaaatggtgtcagtttcgtgtcgtgtgggtaaagcgtgcaacctctgcagagattaatgaactgttcgaatagccgtgcccacagt

SEQ ID NO: 19037 - DNA, 595 bp, Oryza sativa
atactcttcatctccccaatgcctccgctttctctctcccgccctctcaccccgctcggtggggtgccggatttgccgagcaaggtcggcggcgaggagcaggggcagcggatgtggctcgcgccgtctccggcaccgctgctcgccctctctcttacaccttcctctccttccccggctggagctcctcctttcctctctggcggcagcaactgctcagcatagcgccggtcgagacgacgacaacggctcgccgggcggcgtgcgaggacgggctcgactgcgggccttttatccaccaccatccgcttccaactcgccgtggtacagatccaactaactggtgttctcctctatccctctcagctgccggagaggccctctcctcccacatgctggcacgccgcactcttcgtcaatggggtaaaaaactcgtgacatcgcgcgggagttgggtagcagttcgccgtcgacgacgagctccaacgacaccaccacctttccctcttgtcttggcggcgagtgatggttccaggggtgccagataaagtggcatgtttgcacctactgttaccatgcattacaagaatttaga

SEQ ID NO: 19038 - DNA, 1501 bp, Oryza sativa
tatatatatatagagtcggttgatatccattagttaaccaaacagagccatcttaaaatcaacatgtattgtatagcttacagtaaaaagaaactactcaaatatatgatccaataataagatattgttgcctacacatatactatacatcccattatagtggtacggtatagtattaatttgcgtgttgcatatatgaaattaagagggagtgtatgacaaacatgtatattagataaatactagttataaatcttgacctcatataattataattatagttaacctgtaaattaggattactcattgtaaaattatgtgatgggataatctgtaaccataatatgattaacctaaacaactctaacatacaaagcatggataattattaaccttttataatttactgtgacaagtaaaatatgttcataattaaagtaaagcttccatcaataaaataaataatacaaatgattcactgtaattatttgattgatcctaaatccatccgacaacagaacctctagtatacgaccattttatttagatagatgcatgtgtagccataatccttccatagccattagctagactaaaccacaaattagccagatacgtatctcattcatactatattggctagctcctaaatagaccaccatgataacagaaagattaagagactttagcccttagcatgttggaacccattagcaagcgcgaataatatgagcaaccttaggttcaacctcaacaaatatattttgtttgtgcatatttgattgttgcttgaatattggtttttctcgcgtattatagacttgtgtatatcggttagtcgtgaggcaacgtcagcaacttccaggaggtgaaggttgatcaagaattatatcaagaataaggactatcctgagcaaggcaagtcatcactattccttgaacatgttgatcccaattgcgaaattgttttgtttacaaataaaattgcatgcaataatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggactgggccatgaagttaagcatgaaacgacccccgtacaaccgtacttctcgaataggtatagacctagcggattagatagccgagcggaggcagtatccctgcatagatggttcacccctgagtgaggcaggtgcgctacgatgggacagccgttgaggt

SEQ ID NO: 19039 - DNA, 287 bp, Oryza sativa
aatagttttactctgatcagaggtgtacaactgtacccacaagacccagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtccccgctcgtgcctaggtgaatccgaaagcgacagaggccgtcgcagggcccgccccgctccatcacgcccacccttgcctagatgtgtcgactaga

SEQ ID NO: 19040 - DNA, 1501 bp, Oryza sativa
acctactgatatatgtatatgaaacatactactagtttttatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtacccttccacaactgtataatctagattaaattttacaaaaactacatgtattttacattatttataacaaaactataaatttaaaagcttgtttttttcgctgggatggtgaagaatgccgcccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcgagga

SEQ ID NO: 19041 - DNA, 1501 bp, Oryza sativa
catcccctaaccgcaaaaccagatatataatatcctcaacttacaataccgtttactttagatctttggtggttttgacccggttttatctgatgtggcagctgagtcaacgtgagacccacgtgagacccatatgtcaggatgccacgtcatcactccccctatctccctttctctccctctcacatttctggtctgggcaggccagccgacagggcgaggcgggagaggatgaggcctggcggccagcgacgtgggagacggggcaacgaggcggtgacgggttgggcgcgacggcgacgggcggagcgatactccattgtcaccgccggcggtagcacgtcggcgcggctccgtcggccagacgctgcaagaactagcgggagtgcgcacgaggatgagccagacgatgaaggtggcggcgccggcgccgaggaggaggaaggggctggttccttttcatataaattcaaacaaaattaaaccaacactttagataattatataaatttatacgctttaaaaaaaagcctcaatgaatatgtacaggatataaactagatgaactggcgcgcctatttgctagttttgatatacgacgggctaattaaatttcagcgaggactattgccttgcttcgttacacacgaaagtacgaaaccgattgtggctttgttctctaccgttgattagacatacacatcacatgcaattgttttaaagccgtactatagacttaaaaaagttcacagtatctgtagaaaaaaaaagatttgcaccttcaagccagtgctgaaatgcaagtttctaagcagtttctgagctagtcatccttggacaacccctttccaacctaaatttgtgtggaattcaggttaattggtccaaaataaatgggaccaagagctagatattgaccaagatgcaataaacaatttaggtgtgaaaccatgaaatgctcaccttggtttctcgtgttcttgctctcgcccatttggacagtgcggattcttgcttctcgaagccaaagaaggacacggagctcctcctcagcagtacaaatctaggagctttcatctgcatatttcatattccagcacaaggcttatcaatggccgcggtgaggttttttggttgttttgggagagatgaccgtgacggtgacgaactcaccagctctgctcgaagaggactgtgcaagggtttagggtctaaattcttgtaatgcatggtaacagtaggtgcaaacatgccactttatctggcacccctggaaccatcactcgccgccaagacaagagggaaaggtggtggtgtcgttggagctcgtcgtcgacggcgaactgctacccaactcccgcgcgatgtcacgagttttttaccccattgacgaagagtgcggcgtgccagcatgtgggaggagagggcctctccggcagctgagagggatagaggagaacaccagttagttggatctgtaccacggcgagttggaagcgga

SEQ ID NO: 19042 - DNA, 1501 bp, Oryza sativa
ccctttgcagctccttctcttcctcaacagccaattgcctttccccatccacacacgcaaacctgggggtggcgcgaccggcgagctccgacatgcacaaatcaaagccatctctccctctcatgatgacgaggaagtagagaggacgacgaggtgaagaagaagaatgaggggtcgacgtcctcacggttcgtgctgacgatctcgagctcccctcctcatcagcggtctcgagcttcagacccggtgacgattgaggggtcgtgagctcgacagaaactactcgaccacgagtctggcagtggtgcggcatagagctaggggctttctccctggctgccgagacgagctctctttcctccctctcccatggttgcacggggcatgaccattgttggatttagtcccacatcgttaattgatgatgggggagcacgacttaaaaggggggggcaatacttacccatcagactaatcttttgagttgtgtattcccaggagctaaatttgtggctccggttgagcctgtggtggagcaggcccagttgtgacatgggtggcccaccaacaagtggtatcagagcccaagattggaatccggaacaattttcatgggtcacatggtggggagcccaggtaagtcttcggggtcaaatggttaatggtttgatgtgatgcgggaggttgttgggcccgatgtgtgataggggagattattgggtttagtctcacatcggtaattgatgatgggggtgcagtactcacccatcaaactagtttttgagttgtgtaggcccaagacctaaagttgtggctccgattgggcatgtggtagagcaggcccagttgtgacttgggtgtggcccatggttggtggcccggattgcgcactgtaacagctagtgtgggccggtaccgacgatgctgacaaattcttttgaggtacgagtgtctaagtttggatccgcgttcttcatttggtcatgagagagacatatatatacgtgactagaaggcacgcagcggagtgtgcttaacatcctgagctcgccgagtcacggccttgcaggagcatatctcccaatcgctgggccctattggcactagtctatttaaccactgatctagttgtgggccaatatcatagctgagaagtaagcttcccggccttctttctcgacgttgagcgttaccgctgttcatcttcgtccccaacaaaagccgcaatgacatttctccccatggttttgctatgtagttgaactattttcggtaaaaattggagggtaggctagagcctgatggagcctacctgctagaatcgccattgctttcgagtgtagaaggtggtcagaagggtgcgtttggatccaaggctagcaggggcctagcctggccaggccagtcgtttgaaatcagaaaaaaatcctagcctgtgggggcgagctagcccataggagcgagaaaaggctggctcacaagggagagctgaactataggg

SEQ ID NO: 19043 - DNA, 1501 bp, Oryza sativa
agaggagacagtagtgcgacagctttgtattgccaagctaccaaggggatcgttttgtcctgtctccacctgcagctttaacaaatgaaacttggttagttttcaatacttcttttttgttaggttagagggcaaacacattgctaatcacacaagggaacatgaagaatggagtgaaccatgtgtgctgcatattcaaggactaaggagtgcattggtatgtaacaataattaatatatgtacagttagaataattaaggacttgctatttattttctttatgagtatttttttattattatatatgaaagacagctacgtgcacacactacacttatgcattggtgagtactccctaaaaaaaaccaacttttggcaatgcgtctagttcattgctagaagttggttttttatgggaataagggagtacatgagtgtggatggaagtgctcttgccatatcaatttaagatgaaaaacattgatcttgatcggtggcgtttaagaaaaaaaaagtaatttgtagtattaaattaaactgcaattttcaatataaaagtaagttgatagagtatttgcagcaaactaaagttgaaacaaaagcatcacattgtttggtttgaagaatgcaaggacattttagtatcatgtactccctctaaccacaaatgtaaacatttcaagcgtttaaatttttatccaccaatataagtattcatagagtactacttgatccatcaatcattttttatttcaataatttgtttttcatctcacccctaaccattattcattatataaacacaaaaatcttgggaagcttctagcagttacagcttttacagcttgtcctataatcaaaagttcctccaaacagtttaactttttttatattatgagaagctatagttgtaagataaagaaaatgaattagaagacataaactaaggaaccaagcttttctaaattatcagaagttgactaccaactagctgcttctataatattaagttatcccaaacatatcatatccttaggtttagtttggcactacacttccgaattgctaaatgatgtgtgttctggaaaaaaaatctatatgaaagctgtttaaaaaatatattagtcaatcaaattttaagtattttagctaatacttaattaatcacgtgctaataacttgttccatttcgtgtagagattcccaactagatatgccgaacatgaccaatatagaaaaggtcatatttgtgaatagagagaagtaataatatgaatagcaaatacggagtacgtatatagcatcatataacacatggaagtctctttcagttagttaatctatcacatgcgggatttgcggttaaaagctctgttccccaaaacgataaactaatctaaaatcctcgcaaaaaaatttaaaaaatctgtaatcttaaattcgaggaaactcatgtgaagaatgaggtggtggtgacgtcaccaacaaacagatgcgaaa

SEQ ID NO: 19044 - DNA, 1501 bp, Oryza sativa
ccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccaggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacctattcgagaagtacggttgtacgggggtcgtttcatgcttaacttcatggcccagtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcattattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgacgttgcctcacgactaaccgatatacacaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtctcttaatctttctgttatcatggtggtctatttaggagctagccaatatagtatgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacagtaaattataaaaggttaataattatcca

SEQ ID NO: 19045 - DNA, 1501 bp, Oryza sativa
accacgcccgtggagacccaggcccacaagtcaggcagcaattttgacccgcctaccgccgctgcggcggctatctctgcgaggcggtccggtcccacccgtcagagagacgtcctgatcgcggcaggtgtgaaaggcaagggggatatttggtgggctatttaagcagccggtgcggtaggtggtcgactcgctgcacgcctttccgcgatttcgtcagttacccagatctcatcttacgcaggtgagctccgatctcccctctcccgcgctgcgattttgatttgatccgtcgcgccgcatcgcgtcgtcgcttggtaggatcatccatccgtcccccgcgcagcgcgagctgtctagtttctgctcgattttttagttcctgtttatgggggagggagggagagagggagggattgggtggaggcgaaccaggaatcgtcctggcggtgtgatgtctggatgaattggattggcagcgtcttttagtggctgagagattgtttccttgttactgttccgtggggtttacaactttagaatttgtttcttcgacagcatgcagcaacttggtagaatttagctgcatgttctaggtggtttgttgctgctgatcctgctcgtttggatcaacgatttttggggggctgagattaattggttggtacagtcttggttagttacatccatgggaacatgcagttggttattggtttgcacatggagtactactgctaatggggtagatatagacagtgtgtgcgccaaagctttgctaccactagtttctttaagtatagtgcctcccaattaccaatattacctattttcagtgtaaagtgttaaatagaaagattgcttctgattgctatctcctttacctgaattggtagttaggtgcacatcttccattgtaacgtatgtgttaccatggctcatgtactagttatgctagatatgttgtgctgctaaacatatatactagaaagaatgctaccactcgttccttctgttgttaattgtggaatgttttgcaatctctagtttgtagctcacaactgaccatatgattccccatccaagtgtcgacctcatgtgtgatttcataaataaaaaagagcatattttcaggatcctgttatgatcctcatttcatacatttatataccttttccataatacatgaatgatgcctcactcaatgctataaatgttcacattatatattacctcctcctacaagtatgaaatatgaattgccataggccatacaaaagagcccactccctatattggactcgataaatatttttagtacatagctcttaacttgcatgtcatagtctgatgtactgtcctttttgaattggaaactctgttactttataaaaaggattgacatttgtattccattgttaaaagaaaagcaacatctgcacaaactagtttgttctgcgcatgatgtattgatacatttggtgcatctatctgcaggcagaga

SEQ ID NO: 19046 - DNA, 1501 bp, Oryza sativa
ccttccctttgtctggctttgttttctcgtgcgtaaatatttatggggttcataataaatattttattattataattattacttagctgtataactttagtttaattttccattgtgacaatttatagtttggcaagtaaaagcaaccataacatccagcatgatgcaaaaagtgttaaaaagttcaaaattttagtaatttttattgttgagaattttcaggatgttacacaagccgccatcgggcaatcgtcgtcgccgtcatcttcctccgcgccggccgccgcttccggtgaggacctctcctcccttcccttttttttcccgtccccctttcttgccgaccgccgcctcttggggtgcgtcgccgtccccgtgcgcggcgttgtcctccgaccgcccgccgccattccacgtcgccggctgctgccgccggtggccgcatgccgccgccgcgccttggctcggccggaccggcttcgtgccacgcctgtgcccctggctgccgctcccctcggccgcccgatcggctcaggctgatctgggccgtccacgtggtggacgcgcacccgacgccacgtgtggaccatgtccaccgtgcgccctcccgctttgactcgctgacgtgtggggcccgcgtgtcggcgccggccgccccttgctgacgtcagcgaggtccatttcctttgtaaaaataaataataattgcgcaataaatcgagtttaattcttaaaattcatttaaatggctcaaaacttctaaaattcatatctaattcatacgaactccaaattgggccattcaatttgcaaaattcatctaaaattgatctctacatgtttgtttaatttttatgtactattcccttggtttttattagagtttttccttgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttacaaatgttttactatttgcaaataaatatgcatattttgctaattacatggggtcagggttttacctatctgctcgcttgtgccatatttacttgatatatgtcctttgtcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgtgggatgccctaaaagaacttattgtacttaccacaagccagcgtgggcaacggctcggttgtagtgtagctttcctctagtcgacacatctaggcaagggtgggcgtga

SEQ ID NO: 19047 - DNA, 1058 bp, Oryza sativa
atcccaccgcaaagctcatcactgctagatccatcgccaccatccgctccaccgtatcaaacccgctgccgccgggctcccaccccccctcccgcgctctcgctcctgcccgccgccgagctccccaccactctcgctccctctctcgtccaccgccagagaaagtggtcgtcggccgctcccgagctcgccactcccgctcctgcctgccaccggcagaagtggttgccggtcgctcctgctctcgcctgttgtcggccgctcctgatcccgtccgccaccgaaggagagaggaggaggaggaggagcggaagtggaggaggtggaggaagtgatgggtggagagcggagaggatgagtataagagagagagaggacttgatattttaagggtaagcttgatctgatgagctggtggcaggcggggctttgaacatgccgtcttacgaaaatagatttattttcacacgtgatttttgaactgtgtttgagggaacgatttttccataggaaagcagctatggaccacctgcaacctaaagggattttataaaaaaaaaatcgattctgtggtagcgtgcacgtcgatcgtcactgctgatcccattgagacttgagagtcacccactagctaacgcaatctgctactcactagctagtagctgtttctgcagctgcaagaacctattctgctccgacccggcgaaaaaaaaagaacctattctgctcacatgtcgcagctgagatacaaatattgttcattaagctatctcatgcatgcatgcatggtcctaatagtttagttatacgaacagctaataataagtttattcgaatataattcctactgacattagcgttcctgcttccgatctgaattcagaaataatgcaaattaactgcctaataactttattcgatcgaatccattcaactgatggaggctgatgagctgctggtccagtggcgtcttttaattctagttgcatgcaacgtcgcttgcacatttggtagctagcaagaattgagctcagctcatgcacgtagctgtgtcaaga

SEQ ID NO: 19048 - DNA, 1501 bp, Oryza sativa
tccccttggcctgcttcaagtaacccaattgctccatctcatctgatttaaatagtcttactaactctttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttcctttttactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataa

SEQ ID NO: 19049 - DNA, 1501 bp, Oryza sativa
taccatcctggaattaatagccaaacatgagacttttttgtgggttttttttccatacatgcatgatgtgatctagaaccaaaccttaattaatcaaaccctaattattagtactactagtaatgtatgaacattttatatatttttacaccgacctagtatccaaagaattctcagttgtcagttttatttcgtacatgctgatgtcaattctccattagtactggagtatattggaacaacaaataattaggagactgactttgtggtgtgttctgatgcatgattcatgtgactataaccaaaccttaattaaccaaaccctaatttattactcccatgtgaacatttttgcataccctatcaaggaaaagaaaatatcaagcgaagaacgttatactatttacttttacacacctaatcagaaaaagattctcaattatctatcacccatggagaactattgtaagattacttttacacacctaaaatagttctcaattattaatcggctaatcgctcgtaaagaaccgtcatagaattgtttatggtgactttggtctgaaccgaataatgtttccaacaattttgggtgtttatttctcatatattcagatgataaatattaacttgacaaatactaccccatcccataaaaaactaatctagtaccggatgtgacacattctagtatgatgaatttggacatacgtagaatatgtcacatccggtcagacggaaggagtagccaatagataaagattttttttcaaccagggtatggtttgcacccaaagcctttttaatcaatcgcagttgcgagccacatattgcagccagggagacagaccaatgtcactaacaccagacaataaaaagctactccttcaatgacaatgaatgactaatatacccctcgctccccttcctcctcatctgttactagtgttgtctctcttctcctgggtatcgcatttatatttcatagtgaagatggccgtatatgatatagtttgttcatcataaaataatctataattaattcaccatagtttaataggggttaggataatataattaaggtagtggatacctagaagatttacctctataataatgtttagtagaaaagagcattagataaccacgatgtaattttacttcaattctattcatgtctagtatacacttaacctatgcagtacatacttacaacaaaggacctagctccgggcactctgatactatcgagagaccacttcctgttggtataccagcataggttatggcatttacgcacttttacgtcatacctgaacatggaggaatacaaagaacaaatagaactatcactacatgcctcctacctcacttttcgtggggcacacccacatccaacaaacatttatctaatctaagcaccatgcttgtgctagtaaataatatcagtaactcccttgggactcccacccttcgaatggtcacatttgagttagagcaa

SEQ ID NO: 19050 - DNA, 1501 bp, Oryza sativa
atttatacctagggttttgatggttatgggccttgggccatctgcatattgggctaggcctacgggtattttcaacccacgggttaaaaaggcaaaagggctgccgagtacacttacattgattgcagcttcacgttcggctgcccaattctcgcagagaggaacagggacattgctcgctgttgtagggccgctgatcatcacttgaccgatgcggcgccctacggtctcgctgttcagacctgcagatcgagaaccaaaatcgataagtcgggaggaacatgcacttaaggaatggaacccagaatacaagaaaaataccccaaggagaaacccgggtcgcgtctttgggccctgagtagtcaaaggctggatgggctcgagcctggagcggctggatccgtttaccaatgaagtcggcagcgacttcatatcccgacaactctcgcactcggaggtcatcgacgatatcgatgaaggattgaagggagggggttaaggcgggtttgacggtccaagacgaaatcttgtctggttgttcctcaagaacaacaaagactgggtccgagttttctatctgaagatagaaccacctcgcccgtcatttactacgagaagaggggcactggaaggggatatagcgagacttcaggccatcccgaagtcggaacccaacacatccagataccctgttggattccatccaacgcaactcatagtagaagcggaagaggtcaagaaacagctctaccccaatgtaggcctcacaaatatgggaaaagatactgaggaaggcgatagaattgggattcaaatggagcaaagagagaccgtagaaattcaagactaaaagaagaaactcggatggaggaggaacaaaaccacaaagaatgtaatcctcgaccgcaaccatgcgacccaggacaggttcaggttcagtacctcctggttccctctccatggtcccgcgaccagggagagcgccttcctcctgcaacttctccagcgacacgctggtagaagtggacttgtcgaggtccattccggtcgaagatcgccggagaaggggccgagatgaacaagctagggtttgtgcggaagcggagaagacaaagagctctggaaggcttgaaagtttctcacaactgccggactccaaaatggattcccaaaactcccttaaataggcgcactactgacggtgcgaatcccaaggaaaggagagagatggacgccggaaatttctgggtccgttgcgcgaagcggttccttggacttcaatttaaattcactcataaccgttagacttcgcatggtgttgtcgatcactctttgtctctacggtccctacaccgagatcgaccagtcgagaacgacaacaactccgacatcagaagtcgcgattggttacacgagttcatttaagtagaagtcgggggctactgtcagggttacggataaggtataccctctacccttggatgtatgctatacggaaata

SEQ ID NO: 19051 - DNA, 1501 bp, Oryza sativa
cccctctccaaattgttagaagctagttaccacccaactgtttcttgaaatttaagctttttcttctcaaaagttgactaccatctagctacatcttataattttaagttctcccaaacagattctaagactcttttactaattagtaatcgaaaattttagctacctcgcttaatttgcgtgagggcatggaagacgacgacgaagaagaagataccctgcagattcttcgattacgacgacccccaaaaccctgtgtgctaattaataacgctcttgtttaattatgcccaatttggcggctaaattaatcgcgaacgatcgatcgagttggttaatttagagtccagatcgattgcgtgtgtagagcgatcgagacggcagccacatcgatcacgcgtcagatcatgatcgagacgttttgattttgtcggtgcaatttagctgcagctatgcagcggcggcggcgaaacgtaatctctctctctctctctctctctctctctgcagacgaggcgctgacgacgacgacgcatacgaatgtatttgtgtgcgagatacctgtcgaatcttcagagaatcgcaaggaaaattcagagaaaaattcatggtcggtgcgcacatatgtccgagtcatgcattgcttggcaatttcagcagcaacttgcgtgtcatatcgtatatttgaccggatgtaggaagggattttcggacatgaatgaaaaaactaatttcataactcgcatgaaaatcgcgagacgaatcttttgagcctaattaatccgtcattagcacctgtaggttactgtagtacttatggctaatcataaactaattagactcaaaagatttgtctcacgatttcctcttaactgtgcaattaatttttcttttaatctatatttaatactccacgcatacttccaaatattcgatgtgatgtttttttaaaaaaatttttgggaaactaaacggggccttaactaggtcaagcagaagcaggcagatcatgaacagatggaccaacgaaaaattccttctcgacacaagctacctaccagtaatacgttgtacagtgtagtcattaaacaagaggttaattaacgaaagagtcaaggtcatggaatcgcgtggtacaactacaagtatagtcattaaacaagagattaacggggagtgtcaagctcatgaaattgtacggaaacttcggagggatgtcgtgaagtatgtacgtccacatcgccatgactcatactgtgtgtgtacgctgatcgattcagacattgacaggggctaattaaaaattttctgaatcttttgccggacagggactaactggacaggttgattattgcgtggagatttaacttctacaggtgacacgtttaatttctagagacgctgtgtcctttgacaaaacgaaggaagctagcaaagcttgcatgtcttgtcctccaagaatgaattgtactagcagggagtacaagtacctgctctgttt

SEQ ID NO: 19052 - DNA, 1501 bp, Oryza sativa
tttaactttttcatcacatcaaaacttttctaagcatataaacttttaatttttctgtcacattatttcaatcttagccaaacttccaattttagcgtaaactaaacacacccttagttccaaaataattcttcaaactttcaaattttttatcacatcaaaacttttctacacacataaactttcaatttttccgttacatcgttctaatttgaaccaaacttctaattttggtgtgaactaaacacagctaaaaaaataccgtttctcgcaaaatctttctgtaaataaactcatgtaaaatttgaacgagctcagatctcgaggaacgctgaattgctgaaacaaaaaaaaagggaaagaaaacaaaaaagggcaagtgagagaaaagataaaggacgccgttggcggcggggtatgcagcaggtccacgacgacggagtgagtgaagaactactgaaagcaacagtagccgcctacgattattctcctaccccgtctcgaaacaaaacaaaagagaaaaaagggctcgtcagcttcagctttcctccctgtctcctggcaagctcaggacacagattccttcccgtgtttctgctctctcggcctacgagcaattggtcgacagctccagatgatcattttgctagctagagatgatcattttgctacgagttcttcctccttttaatttctttttccatttgatattttccctgtacgccatgggtgacgggtggggcccattctccgcgttcatgcatgttgcttgatgccgtcgtgcacagccacagcagcccgtgactcgagaacatggacgaaaacctggtgaggacgtgaggttcgtgtacgtggtggagattaggttatggcaagtgaggccagtgtgcacaccccatgttctcttgttggatttcctgcttatatcactacacgtgagatgataaggcaaatggttgcgcttgtgctgttgtgcactgtgtctgtgtccatccttttcgatcgatctcttcttcttttttggacatatatatttcctgtccatccttgatcagctaggtagctaagaattttaagtttttttttctttttgttatgtagtacgtccacatcacgcgtaacagactcgatcgtgtccgtgatagcgtggcagggagttacgagattaattagggcccatgatagcctaagctgcagctgccgcaacccacaagcctttgctgttaagagattgatgaccaatcgaggccgtcgctctcgacaggttggatgccatcgatcgtttcgccagttcgatcgtggccgccccgcgcgcgagagagccgtgcgtgcgtgcatatgcgtggacagtgcgcgcgaccgtgagctgccgcgctcgcgtccgcgccgcgcgcacacgtcgctctcggcggaaacagagagagagcgcggggcacatggcctcgctcgcgtcgttgccgagcaagccatgcatgagcacgggcgggtcgctgttagcgga

SEQ ID NO: 19053 - DNA, 1501 bp, Oryza sativa
tacaccttcaccttcaagtttgcggtgcttaattaagtaagctcatatgacgaggcatgtatgtgccggagaccatagggtcagggcattattagattcggcgccgtcgcgtcatcattcgatgggcaaattaatgggatcactatatatgtgtgtggctttgtccgattggtgcgggcacctatgcagctcgatcaatgtagaacctaattgtacacaaataaatgaattaattcatcttcaatctgtggtcttcgcttctgatctagcggtggtttgtaaaggcgctcccaagtcccaaatgatcgttttaattaatttggtccaaaatttgtggaccacactcaatattcatctgaaattgatccaaagagggaaggacggtcattgcctctgaagactgaagtctgaactcttgagatgcaattaatcccgaaccaatgagctagctagctgatttttgctgtgccccgtgtgatcgatgcatctcaagatgtaagaggtgtgaacttgtgagttgtgatgcacccatgactgactgaaccttaccttcatgtgcttcacacttctggagcagtggagtcgattgaaaaataaacttcgatgaaaaaaacctcaaaatcaacttcaaatttaaggttaaaaattcaaattttagctaacaagtataagcataagcgaaaagatgagatcattcaattttcatgtcagaatatctatctgaattttaagttttttttatcatgtactcacaaagtcgcgagtcacaagctgggtggaatgccatcgagaagaagttggagtaggataaggggtctgtgtaacaatgccggtgaacggatggcggcggagctccggcggacggcggcggattccaggaaggacgtgagatggggccgttctgtgccgtcatgtcctgcaccgttagattgaaatcgtgtggttcagataaaggaggatgaccccgcagcagattcatgtgtgtttgggccgtgcaacgaatgggccgggccctttagtcgcgatgtctgcatatgtgggccacagcccacagccccagtttgagcactgcgcgcggcttctgttgttgcgctccggatcgattcggttgtggtcacaaacagaaattcagaattgatgcttcgccatgatatggtcgtcagattcattagcttgatcgatcgatcgatcttacgtgttcatagatcagaaagaacgatcatattaaaaatgaaaatatattaattgatgatgatcacaatgcattggttatacaacaacaaattacaagtgagtgattccaatggtacaacaaattaatgcggatgcaacaaattaattaaactaacacaaggggggataatagcttattcaggccggcttactcatgcatcatgcaacttaccaatggccattgcatgaaaacaaactcaattaaatataatataaatatgcattaattttgcgcaaatggtttgagcactttccatgctcaattaat

SEQ ID NO: 19054 - DNA, 1501 bp, Oryza sativa
gatcccgccattgttgcttgcgcgagaggttgaagttgaaccctaacatttgatgctataggggagccagggagcagctctggaatggtaacaaatgttccaacgaagctgactagcagtgccaacgatccaatgcatcgagcaaaacacaaacattgctcattgttgtgttgtgatattgacatgtgtttgtctatcgatctctgtctcggctgtctcggctgcagtttccatggatggatacgtcattgcgtatacgaattcagggggtgcttctacgcttcactcattcagagttcactttgcaaatttttttttttgtttttacactcatcctaaatgagtaagcagagatcctgtattcctgtcaagctttttaatagggaattgctaaaacactgtcccaagtttttttagggtaaagaacttttaaatataacttatagtattatagttgtagtttaaaaaagggtaaatagctaatttagtccctcaagttttaccaaaggctcaatttggtccttcacgtttcatttttgttgacggtgggtacccgtagaccggatatagagggtattggggtacgctggtacgaggatctacgtagtacgacatcaaggaaacaagagacaaagattatactggttcaggccccttaacaggtaatagccctaatccagttgatatgggattatatggaaataaccacagattacaaagggaataatagaactcggtggtaccgacgagatcgtagtcgagttgattcgactagatcacccggcgacttggctcctgtagttttcggcttcgtaggctgtggtcgttgtgtaggttatgagatttgatcccttaggtcccccaaggggtcccttttatatcgcaggtcaggcggtctccaagtaggacttggagacatcggaccctacacgatataataacgacacagtcctatacgggtaggaatctttccattggcggacttcgtgatggatttccttagcgtgttcagagaacgtctgtatatgcaccgctataccgtatttccgtatagcatacatccaagggtagagggtataccttatccgtaaccctgacagtagcccccgacttctacttaaatgaactcgtgtaaccaatcgcgacttctgatgtcggagttgttgtcgttctcgactggtcgatctcggtgtagggaccgtagagacaaagagtgatcgacaacaccatgcgaagtctaacggttatgagtgaatttaaattgaagtccaaggaaccgcttcgcgcaacggacccagaaatttccggcgtccatctctctcctttccttgggattcgcaccgtcagtagtgcgcctatttaagggagttttgggaatccattttggagtccggcagttgtgagaaactttcaagccttccagagctctttgtcttctccgcttccgcacaaaccctagcttgttcatctcggccccttctccggcgatcttcgaccggaa

SEQ ID NO: 19055 - DNA, 1331 bp, Oryza sativa
tacaaccgcctttatgcaaatagccacaaaccatccttgtatccccttgcacatctgcatcgttggtgtggcttgctgagtacggtggttgtactcagtcttgcttttattccctcttttcagaagtgtagtgcttctaagctgaagatggagttagaggaccaaggctcagaccccagttgagttttgcctgtggagtggagctgaagccccgctagaatcgcccttttccgctgctgtcgttctgtttcggtgtgaggactaagtgcctcttccgtaagtattttacgctttatttacgtttggaactatatattacttgtcgttttgtgtaccctggctggtcctggacagggatttaatacgcaaaatagtctggaaatttgggttaaatttctgggcgtgacaaagtggtatcagagccaactcgactgtaggttgagccaaatggtcaaaccctaagaacaagttttctaaaaaccctatttgtaaattgtctcctctcgcccttcggcatttctttgtcaaacggtttttcaaaattctcctcccagtctctccaattcttttagttgtcacacctagaggaccagccgtcaacttcatgtctgttcggaagtcaagtcaagtcaagcctcaagcttcatgcaaggagcgagaagatcagttcaaagtcatcgttccgcgaagatcaagtgaagttttctcggagatgacctaaacccaatccttcccaggagggtagtttcgttagcttctagatcgtgtgttgtttgcttgtgtgtaggggtatggtttgcatcactggtggggatgcgaccatactaggctgtttgcttaaacaacttgaatcataaaatccattcacaagagatcaataggcaagtggtttagtacctcatctctagtaacccctcccatttccccctctctctggtgcctgcagcagatggtctgcatgagggacaatttcatcggatcaagaccccgttagtttcatggggcaactcagtgcaattctaatagtattccacgtcagcctcttgaagatcagcctcaaccccaagtcatggctaatcaaactcagacagtggaagagttgttacaacagatgcgacgtcggtaccaaatataccagatgcaacaaatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagatccccgaagataacgacagccaagtcaacgtcagaccaaagga

SEQ ID NO: 19056 - DNA, 372 bp, Oryza sativa
tcaacattgggtaataaatcgactagcttaggttacttatgtgacctagctagaactatatgcttagccatgcttaattaccactagctcagttgatgggataattaccgtattagaccttttagtatcagaataagctgcgtgctcgagacatctggccatgcttcatggtcataattatccaactaaaatgtgactgaatggtgggctgtgggtgcatggttttgctggtcgcacccatggcagttaaggaccggttcgcgggatgccctgaaagaacttatcgtacttaccacaagccagcgtgggcaacggctcggcttgtagtgtagctttcctctagtcgacacatctaggcaagggtgggcgtga

SEQ ID NO: 19057 - DNA, 1501 bp, Oryza sativa
cacatgtgctaatggcggattaattagactcaaaagattcgtctcacggtttccaggtgaattttgaaattagttttttcattcgtgtcagaaaacctcttccgatatccgatcaaacatccgatgtgacactcaaaaaaaattttcgcgaactaaacgaggcctaagtaagagtagtaatcaatggagaagaggaaattaggtgcaaacaagccgaaatatgcatgattatgacaaggacattaagcttaccggcgaagaaagtagccatacgttcttggcaatcaattaatggtgtgggaggtgatgaggaaatcctactcctcctagatagacaaagaagaaagatgtatacaaagatagaagcaagtagtcactcatgatgtgtgcgatggcctcaagagcaaattaacaaattaagcaaaagacgaagagcagatcgatcgagcagagccaaattaataagagagattggacgcgtacgtaattaagagaaacgggattaggattcgtagcaggcaatgcaatgcaaatggggaaaaaagtacgatcgacttcacatgtgtgctagctctgctcatctcaaaagccagccggccagcctcatcaagtaatctttcctactataccaatctcgaagaccgatgaatcgatcgatcatgtgtttaattaactttgcagagattatgatcagctgtggtaagttattagttgctgctgatccatatctcatctttctgatcatcgagcatgcatgccaatgcaagctcacctcagcattatatatatgtttttttgaaatcgtagccacgctaaactgaagttatattaagagaatagaaagtatttacaatattaccaagggactaaatactatcaagggacgtgaaagagagaggaaaataaaagaaacaggaagaaaacataaaaagaaacacacactaaattaaaatctaagcggatattctcgcaatgttttttgccccacacatgctctatagcttgattttgtcatgtattttggcaatgtttttttttttttgccccccacatgcttcatagcttgattttgtcatgtattttggtgagaagttgcgacatggtcttttcttgattttggaatacccttatattttagtggtgtagctagaatctgttttagtggtgtagctataattttgagtaaaggtggtccatttgtatgtaatatgtcaattaaataggtggtccactatacaatttttattatattaactagaacatatactataattaaataggtgccacctagctagctacgcccctgtaatgtttcgttcacatcatatttcctatgccaccaacaagtgaattgacttgtgctttagccctttgcactatatatgtagcccttgcacttaatttgttctcatgcatgctgcatcgcgatctccacttcactaaccactatatactcactagctagctagctgcccagcttcgctagtgttgaggatgacga

SEQ ID NO: 19058 - DNA, 1404 bp, Oryza sativa
gcactgtctccacccgtcgccaccacccatcgcctgccgcctccctttttgcgccgccgcctgtcgccttggctccgagagagaggagagcgagagaaaagcgaacaagaggaccgagagagaggagagcgagagaaaagcaaaccaccagatctggcgaccccagcctcctcgctggctgatgcgacaatggtacacgacggtagcacggtgcgcctcagcggtgcgtcttggtggcggtggagggaggccggaggaaggagggtggagccggggcggcagaggagccggcgatggagatggccatggcagtggctcgatccaggcgaggaggggtgaggccaccccaatccgcttgacatagatcctcctcctcctcctcctcctcccctgctccctcccgagatctcacactccatccaacattttctctcgcgagcacaccaacgcaggagctcgccagccggccagatccagcgcctcatcaaagtcaagccagagacaccgagcagcggcatgaggatgcatggggaaggtggtggacagtggaatttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaagcccagtcgaacggctggcgttcgacacgctcacctgtcgaacggagggagttcgacagggcccaccacccggcgccacgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagccaccaccgagagtcgccacatcgtcgccgtgagcgccggagggagcgaggggaggggatagcaggccggagaggaggccgaggaggcgccggccgggagcaaagggttggcaacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcagga

SEQ ID NO: 19059 - DNA, 1501 bp, Oryza sativa
gaacatcagagaagccgggccatgtgagcagcatttcagtttatctttcagcaatgaattaaaagaaaaaacgagatttggagggagagacgtctctccaaacatttttttaaaaaagaaattgttagcatgttggggattgaacacggctgtcagcagtgaattgtggagcctcaggtacactctttcactcaaaattcaacaatgcggaaccacctatttccttttccctctaggttgttcgcttacaagttcgtggtcagggctccagaatcgtcaagctaggatagattctaccgcatggtgcaaacaaaagatttggccgaagagaatgccccaaagttttgtcactttctgaatcgcttgaacaaaacgagcgctagtacagcacagaccacgaacataagaacgaatcgggacagatttgtacaaccagtggctgtatcatcgcgctctccttgaccagttcatctaaattgcgtgggaaagggggcaaaaaaagatgaactttttagggatcgacacactcacttcccaagaaacagacaaactgcgaactgctacaacttcacgggcaaaagagcaattgaagacagtaagatttcaaagaagtagggaaggtaataagggacgatcattacctatggatggatggatggattggatccggtttcttgcttggtgctgctgtctcagctccaacaagttcttggtgttcttggctccttcctatccttttgcttgctttctgcctgtctggttggagtgttgtgggtcacaggaagagagagagagggttccagaatgcagcagagaggtaggggaacgatgagctgtctcggtcccagcaccctactacaccaacatactcctacgtggagcaacatggctgaacctgcactactactgttaacagtgttattactgtgctacaagagcattttagaaattattatgaccaaaatttgaaagaccgagtgaatctttatcgaaatgttaaatactaagcatttttaagtattcaaattttatacccaaaataaacattcctatgagaccgattctcatacatggaaatcaagcgttttcagccaatgggctgctgaggaggagaatccacgtaatcaaaattcaaaatttaactaataaaataactttaaaaaagaataaaaattaattttaagtacttgcaaaacataaaatgctccggaggaacggacgggatattcatgaccgtagtaaaaatttctctgtttatttcttggtctaccacggtataaacagaagagtatagaaaaaaaaatccggcccagtaggatggcccaaagagtacgcttacctgggccgggcctcctagcaccgcgtctgacagttgggcccacacaaaaccggatttcgctgacaagttaagggacctcaagtgaacttattccgattaattaagcgacggcttcctcctcaactagagacgcccacagcagcagcagcacgccgcgcgcga

SEQ ID NO: 19060 - DNA, 1501 bp, Oryza sativa
cgtttgacctttcgtcttattaaaaaaatttatgtaattataatttattttattgtgatttgatttatcatcaaatgttctttaagcacgacataagtatttttatatttgtataaaatttttgaataagacgagtggtcaaacgttggttaaaaaggcaacggcgttatacattaaaatatggagggagtatattgtacgaattgtatagcaacaactggagtggagcgccctccaagcaaacgaattatactgaattagacaggctgtgccttgattactacaaggtcaacactctctggcttgttaacgaacgagagcatctcgactgccctataatatgcagagctaaattaatgggatatgaagtttgatagtttggatagcatgttcaaagctatcagtaaatagctagttagcgaactgatagattaacttggttggttagctaaacttttcctggcgaaacatgcctattggggttctaagtcttatactttagcaagggtgttcatttttttctatgattagggttaagaggtagtgcattacatatgtggggtatgctcagttaaacttaacataagtgctcgtatgttcgtaggaatttttcagcaagtagtacatacagtttagtgttaaactagctgcatgtcccgcacaattgcacggccagcacccatataaaattatctatttttctttatttgacattacttagaatttgttaatagccattatattgtcctataaccttaaaagatcgatccttatcatccttaaattttttaaatttttatttaaaagttacaccagtcattgcctcttactcttttatcacccttttatttgtttacccaatctatcatagcttttgtatatcttcctttaaacctttaaaaaatacaccttctaatttttagactcaattgtctcgttaggttcccttattataatttttaggagtgttgtcaaatgtcaatattgtatttatccatgatccgcctgttgtctcccatatttattgttgttgggatttaaaaattaaatataactattgttggggttcatcttttactttaaatccgcccaaccgccgccagcttcgccatactatactcatgtatttttattatcattgagattttaaaaaccgaacatgattgtcattgtgacttactttttactttctagaagttccaccaactgtcgtgactatgttgtttaacggcttgtctatcgtctctcctcttaatcatcattgagattctatttgtagttttgtttatagtttttagatgtcgcatcaactgccaacaatttacttctttacaggcctaatgtttctctcctatttattgttttctatcatcgttgagttctaggtggaccttattttgaaaattccatatttttcatttcgatattttcttatttgtaaagtgtcagggttacgggtaaggtataccctctacccttcgatatacgccacgtattgata

SEQ ID NO: 19061 - DNA, 1501 bp, Oryza sativa
tacaaaatcacttaggttctgctcggctgcactacaatgcagcccttgctgctgcagctacagacacatagtactattcgaattggctgtaccacagttgaagcatgtgcagccgaacagggccttaatgattgttcggtagctcttaatagcagttgtctagactgtgttgcacatccaaccgttcagtggcagcgatttaggctaggctgcattttgaataaaattaaatacaatacttttacatatgcatatggtttgtgttggttgtagcccattgctggctgactaatatagccactatagctattgctgcagcgctgcagcagttagctcttttgaataaacccaatgtgataatgtacataaacatgtattgcatcattactagctcttcttttaatcctactcaatgtgcaggaaagtaaagccaaactgtggaaagaaaaagaagtatagtagatccttttcataacaacacaaaagcaacaaaataaagccaaactgtggaaacaaaaagagggagaatcagcaagcatctcggactcaggggcaccaaagtgaataggacatttttccggggagtagaatgaaagcagagcggaggagagcacggagcagcctcgaccgttgtagaactgtctagaagcagcaagcgacgacccaacgctttgtcgtgggcgctataaggctcttcgggccgtgggccgataggagtatgggccccaatctaatatgggcaacatgggcgccatatagcggttcggcccgtgggctgatcgatatgggctccaatctaatatggcccaaattaaaaaaaggagtaaaatcgccgttgccggggatcgaacccgggtcacccgcgtgacaggcgggaatactcaccactatactacaacgaccttgcttgattatgtaatatatcaattttaaattaaccgttaatcatttattcacagtgtagtttatacttcataaacagatgattacgaagagtcaattgcatttttgtacaggatgaaggtaaaaatactaatagttcgaccggcatggagtgtaatttattccaaggtttcactaagaggtatgatcaatcaccatgcttagatccaaacaaaagtttactatgtctagttgaaacagggtacgttgtaatgttgtagaatccggcaataaataaattagattaaacactgtcggttgtggctgtctggtggttccatcatctccagatcgaccagcatcccagcaacacaaagcaagtattattattattattcagttcgtcggtaggtgcaagtcaaacggcaacgcgcgcattgcaaaaacaatcggagtaatggggtgtcatctgctgatttgcacgatgagaactacctcctattctcaaagcaataaaaggcagcctgaatcagaagaagaagaagaagaagaagcagagattaatcaagaggaaagaactaatggtagatagatcataatcatatatcatattcaggca

SEQ ID NO: 19062 - DNA, 270 bp, Oryza sativa
atttgggaatgaaattttgggagagtggcatttgggcactggcatttggcaaatagtaaattctcccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaacca

SEQ ID NO: 19063 - DNA, 486 bp, Oryza sativa
cggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacacaagcgttcgggaaaaggcaattttcccggtcgcgacagagacgcatgtccccagcgcttgctagtgacgccgaagctgcaacgagtggaagtgcctcggctccggccgctggagcgaacgtctccggggacgaataggttgaggcgattccttcgcaagctcgtcagcgggaaggaaaagctccggcggtcgaaa

SEQ ID NO: 19064 - DNA, 1501 bp, Oryza sativa
ctccatccatcgacttgaaatttccagaggaaactcgcttgctaggtatcaccaacaagcacaacgatgtgattggatcctatacagataaataatttagagtaaatcacgtggccaatatctagatttgttcgtgtgtgtcatttagatcctgaactcttaaaatttatttttagttttttaaacttattaaagtgtgtcattctggtttcaaataggcacaactcctccaagatcaattggcgtggcatgtcacacggatattttagtcgtaaaatttatttttccttctcctttcttttcctcttcttttcttttttgccatacttacatgaaggaataagaaaagagagaggagatgaaaaagaaaaataaaaagagtcaatatttacgtggcatgccacataagtgtcacgtagaatcttagaaggatcatggcaacctcggaccggaatgacacattttatcatgttcgtagatctgaaaatgtattttaagagttcggaaatcgaaataatatatacggatgagtttacgaaccaacgaaccaaacactttgcgcaataatttaagaaaaaccatttagattttaccaatggagtggttacatgcatggctgatgggaaagaagggagcaacagatgaacagtacgtagaagttgggagtgtaccgggcaggacgtccaatctttttatttcaactacccacacaagatggtgcggaatttcatattgatataacagaaaaaaaaatcacaacactacaatcctataactaggaagaagaagaaaaaaagatcaccccaccacaagctagaggctccaacacataccttgagaagcactagcaccgaattggctgccgatgtgcgcgactgatcgccgctacccctacacggggaaaccaatttttcggttcaaaacattttcaatatctggtaaacattttaatgtactcgtcactgtaaaaaaacacttagaatttaggcttatttagattatctcaattacatatgattattgtagaaaaaaacacaatgaacgttattacttattggaaccaagatcatgcgaatgggcactggaaaatgaaacatatataaaaccttgtggtcgttgtctgatggagtatttttcttgtacttttttgaggaagccgatgcttcaacaacgctgagcccaagaaagtgtaaagtgtagaacaaatgtatggactgcatttcggaattcaccagtagaatcaagaatggattaattttgcaggatgatattgaccgcaatcaatctcaggagcattttctggcctaaataaaccatatcaagttcgttccatatttggagctagtgtttataattagctagcatatcattatggtttcttgatcagaactccacttagagcaacttcaacagactctttatttagctctccaaggtaaaatttagttaacacagagaaaaaacgagctccaatagcctctctatccggatggcttccgga

SEQ ID NO: 19065 - DNA, 1501 bp, Oryza sativa
ctgagcataccccacatatgtaatgcactacctcttaaccctaatcatagaaaaaaatgaacacccttgctaaagtataagacttagaaccccaataggcatgtttcgccaggaaaagtttagctaaccaaccaagttaatctatcagttcgctaactagctatttactgatagctttgaacatgctatccaaactatcaaacttcatatcccattaatttagctctgcatattatagggcagtcgagatgctctcgttcgttaacaagccagagagtgttgaccttgtagtaatcaaggcacagcctgtctaattcagtataattcgtttgcttggagggcgctccactccagttgttgctatacaattcgtacaatatactccctccatattttaatgtataacgccgttgcctttttaaccaacgtttgaccactcgtcttattcaaaaattttatacaaatataaaaatacttatgtcgtgcttaaagaacatttgatgataaatcaaatcacaataaaataaattataattacataaatttttttaataagacgaaaggtcaaacgtttgtaaaaaagtcaacggcgtcatacattaaaataaaataaaatacgagggagtaatttataataaccaatagctagcacaagaaacttatatataacaagtggtgctacattttacagagacatcgcaggctcgcagccaaaaaaaactagctgtacctccactgcttcccatggccaaggtcgttgttctcacatttgtatacgtggcaatggttaatgtgctactaaaattaataaacagatgaaggatcggagaaatctagatcaacttatttaaaacttcgtgggttacattgaaacggttgaatttcgatagaaattcttttcaatttccataaaattcattaaaactgatcggcggtacctgggccggttgaaagcctacttcccatggtctaggccattaatattctcgtgatactacccaactttctcgaattttttttatttttaatttttttattaaagtatttacaaaactaattttgtgtttcaaaaattgacaaaactagtcgcccgccgccctttgggagggcagtttttaaaatcaacctcccaaagggcgattttcgtgacgtggcagacgaccgttggctcatgccaaacggctggctatatgggacctgccattttgcaggcggccccttaccgcacttagggagggcggtttaacactgtgcggggggcagttcaatgacaatatacgcttcacatatataactatatcaatgataatgtttgtatcgattgttatagctaagacattgttggaggtataccgcgaagggccttcggtcgggcctgccgaaaccgaaaacttgggcgacaggttcaaactggaagcaagcggcgaaggtcgaagagggataccctaagggcgaaagcaatggctcaggaagtacgcgtgcttcgtcggacagggacccc

SEQ ID NO: 19066 - DNA, 1501 bp, Oryza sativa
tagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacctagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacacaagcgttcgggaaaaggcaattttcctggtcgcgacaagctggtatcagagccatctcgacggtaggataagccaagtggataaaacctaaggacatattttataaataaaactattggcgaaagttcctttttctccttcccctaatgctatttgcaaaatggtttacttttttcttccttcttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagttgcagaacctaagccgccctctagggtagagtcgttagttgtgtgtttccttgcttgtgtgtgtagcgcgtggtttgcatcagtggggtgtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaa

SEQ ID NO: 19067 - DNA, 1501 bp, Oryza sativa
ccttattaccttccctacttctttgaaatcttactgtcttcaattgctcttttgcccgtgaagttgtagcagttcgcagtttgtctgtttcttgggaagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaa

SEQ ID NO: 19068 - DNA, 1501 bp, Oryza sativa
aacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaa

SEQ ID NO: 19069 - DNA, 1501 bp, Oryza sativa
aggctttccgagtggaagcggattgttgtgctgctgggcagctggactctgggagtccgagaaaatgaaaaaggctctgggagccgattaatcaagtggaatggctctgggagccgagaagtaatgatctgacctgggaggtcggtacattactaaatgagctgttgaaaagcatctcttaaagtcgaatcgagacgcaagtctcttttcgcccaaacttaaaaagaaataaatcacttagtgatttcaaaaaaaggtcttcaaataaaagatttgcaaaacaaccttgcctctcttccaagcttgcattaaacacctaaattcccgtgacttgctgagtacgaaagtactcacccttgctctatataaatatatatatatatatagttcctccgccctgaagagaagataaagtgaagtgaagattagggtttcgtcctggttcctagccgccgcctgtggtgttgggtgttagttcgttggttccgctgctgctgctgttgttggtgtttcctcgtccgtgtcgtcggttgcattctcgggttgttctgagttgcaacctaagttaaggtaaataagtcctctatttattttaaggattgctatgattcatatttgtcactgtgggtaccagcactatgtcctgggactggtaccgagatcgtggtttcgtaggaagcggttcacgccgttttccctacgacacgctcctgtcaggtgccgttgtacggcggtgccagattggggtgtgacaccacatcctttcttacttaaagttataacccaatgactcctaaagcttaacatgcaaagatgccacatcatcatccactaacaatcactacatttaaacatcatgcaaatatgttatattatctataattttataatttattaaattttagagctttgaaaatgcaagcatgttaaatcatcatcctacataattcacataatatttcaatatatatcttcattatttttttataatatcctatgtacttatatagtttaacctcaattagttaatgttatttctctcttctctctctcattaagacacaacacatcaattgtttttagtgtgtaaatgattaatctatggtccaaattatctccaccttttcttcttcattaagtcatatcacctcagttatttttagtctttagatgattaatctatggtttgaactttctcctttttttttcttctctcataaagtcatataaccttacttttgcatttgaatcattattccatatactatttaaatttaaattatcataaaccacgttaactttatgttgtctagctattttatatattattttttacttattattatcatactgaattcccacagtaacgcacggggtttcacctagttaatgtataattctggtcctcagagcttgagtttggactttgagtagcaatcacctggtacctatgtagagttcatatccaaattccagagctccaaatttacaaaagaaaata

SEQ ID NO: 19070 - DNA, 1501 bp, Oryza sativa; identical to SEQ ID NO: 18622

SEQ ID NO: 19071 - DNA, 1501 bp, Oryza sativa
tgtagtcaacatgttatggccattgataagttacatcatacttgggactacgatacattctttgtagactatagttttctagctcggtatgtttttgtaatattccgaattgtgaggaatgctgcctcagttttctattccactttcttgttataacaagattggtaactcaattgcatgaccgtgtagttgttgttgatgttctacggtttgatctgaaaaaccagttttacattgcttcttgttgtattttgatttacaggataagttgtgtttgtgaactatgtagatgtttgggaaatatttggcaatgttttaccttgacttgcggtgtggtttttgcacgggcaatcgtgtccgaagttatcgaggatcaaattttattagactattttggtgttgcagatttcagtaggtttggcattctctatgatactaataaacgaccacttttggcgccatgtctgtttgtcaaatggtgacattagagtttggaataattgaaagcagactagaccttctgatcttattgttattaactttgtgattacgtttttttcttatttgagatatttaagatatttagtaaccagtgaactcatttgatgttctcttcttcccaggaactcacaaaattcatcaaccagtgcaacgagaagaaggctgcaagtcttgccagcaaagaaggcggcgacctcagtatactcaaggcggacgttgatccctccaattcaaactaggaatctgtggctacctctgcctacggctatgtgctatagaagatgagtgtgtggaatggatattatgttacattgcatacttgcattctagtatttccctgcagaaatgtagtaattctgtatttctctgaagaaggttatgcttactgctaaatgtttacaatcaatcaacggttaatactgtaaagttctcttctcatacatacaaataattaaggcgaaagcaatagacccatgcgacgtacgcgaggcacacgcacgggtttcgccacgcgccgtacaactccgaagatgcaagtagtgaagatgcatcctgtgagcaatggtcaggcttgtagagttgcatataccatttggggcttttgggatgcgtgtgtgcgagagagataatagcatatgtttattgagaagtaagagatggtcgaacatgtgaatggacgtgctccagacccacgatttaagtcaaagggcttaaattctttctgttgtgtgctacagtaagattatgtaatcatatggttagcaaaaaaatgtcaaccatcaccgtaggatcaaacatgcagtataaggatcgtacgggtcattttgctagtacgtactccctccgtttcaaattgtaagactttctagtattgctcatatatttagaagttaatgaatctagatacatatatatgcctagattcattaatatctatataaatatgggcaatgctagaaagtcttacattgtaaaacagagaaagtacgtacaaatgaaa

SEQ ID NO: 19072 - DNA, 1501 bp, Oryza sativa
aagttttcttttaatataaacctcagaaaaaaaggctaaagtttttccatatatagaatcattgaaacaaaacgtttttgtagttgcaaatagtcgtggccaggaagcacccctgatgaccacgaagaatttcgacgttgctatagagactttattttcccctttatttgtctggactatatcacacgatatgttaaaggtctggattaattataaccggttgttctactctctttgtcaaccaactttttctttaaaaggtaaaataacttttatacacgattttgaatataacatgtgtgttagatttgtgtgtataaatgttgatttattttgaaacgatgtaagtatcctcggagtgtttacatagtgtttatctgaaagacgctaaggtcatttccaacccaatgactaggatagtgtccatagcattaaataagctgacacctaggattaaaaatgatgtggcaagtgaataaatgaggaaagaaaagaaaaccatatcttacatgagatatggtttctacacaacatctaagacatatatgagataaatagcattaaacttaagtataaaatagtggtacttgtattgaaaaagtaatatctagcactagtttcttgatgatttggagtttatgaaaactacgtctaatttcttaagttggaaatggcctaaaagaagaatctttcaaaaggaagagatgaggaatgaaaaagagtcaaagctcatgaagggactcaagccaacgcaaggaggccaagtgacagcagccggtagctgtccccatctctacaatatccagcacccagcaaaatcacacacgattctcagcttcttccccttccttcccaactcatctccatctttttatttacacgcacacttctcaaactcgcaaaacgatacggctgaaaaaaaattccctttataaaaattatttaaaagaacatattaatctattttttaaaaaataagataatacttaatcatgtactaataagttactttgttatacgtacctgaggattactccctctatctcaaaataaccaatctcgtataggatatgacacaatctagtactacaaatctgaatatcatatactacgaatccaaacataggtatgtttatatctgtaatactagaacatgtcacatcatataatgagatactctattcgtccgtaaaaaaccaacatagtatcggatgtgacacatcctaatactataaatttggacatacatatgtctagatttatcgtactaaaatatatcacatccagttttagattcgtttttcatgggatgaagggagcaggtttattttgaaacgaagagagtacaccacatgcctacgcagcctcatgtccagtcgagtgtaaccacaagcccacgggaatttgctgtccaatgaagaccccacaaaacgacaaactccaataccacacacctccgcttccctccaaatcgcaacagaaatccgaagcgaaatcgcgc

SEQ ID NO: 19073 - DNA, 1501 bp, Oryza sativa
cctctctctccgggatcagcttctgctcttcccgttgtttgattgattgattgattgattttttttttggttttttgggtggggtttctgacgcgcgtggtgatgcggtggtgtgggaggtctagattagatctcgggtggggaggattgctcgtcgtgatcgggttgtgtgtgtgtgccattttttggcgtgttcgatggttggatgctcggtccacgtctgcgacggcggccacgagtttgagctgtccaaacccgggacgaaaccgaaaaaaaatatatgcaaatttgtttttggttcaattggtgggaaggcggaggacgaggacgaagacgaacagtagcagtagcttctcttgccgttttcctcaatttttgtttggatgcattagcaaggagaggacaaaaggatcctcttgtttttttcctttcaagaatttcttttttttatttgattgatgattttcgcagtacatatgggcttgtcgtcgcatataatgcgcgctgaaagttctggttggttggggggtttcctttcactgccgccgtttcggggaggcatgttgcatctgcctggccacatgacgcgagagcagattgattgattgatgcactgctgatccaatcgatgtgttagcgtcgtcggaatagataatcacccatcaatgcaacgaatgaatgatggaagtttcgacttttttttctttttaggtgctcctgttgagtgctcaacataagccatgtgcccttgtcctaaatttagctcatttgcatgtgtttattagctgttaattgatgagatttacaaagggatttccttgtctaagtttctttggattgataatgatggatgatggatgaaaagtcgttttccgactagttttttttggtgctacctaaagtgaatcaggcatcaccggttgagggcgtgccccatttttcattgtcgctcgggaatcttcagaccaaaagttgtactaattaatttccttttttaacttgcaaagacaaaaacagtaaccgtactgtagggcaatcagatcggtgttgtcagctcttcctgcattaggttatctggtgttctgttacataataaaggtttgtcgtctttgttctattgcagtgttggttgtgaccgtatacaattattgtttttggagctgagcgatcagatgcatgagccttccttttaaatgatctgtgtccaccatggcgatgaaccagtaggaacctgagcagtatgttatcatttttcagttattgtctttttttttggtagttgaaattattttcattattgcagaatgcaggaacttcccgcttaatgggctggatgcgttgtatgcacgtttgcagtgacaagaagacattgaaacgttggttttttattgacaagagggttggttgagtgtctaactcttaaggaatcctatagtctacttgcttgctcttgtgttgttagtaactgttcttacaacaactctgcggagagttctgttga

SEQ ID NO: 19074 - DNA, 1501 bp, Oryza sativa
acaaagataaaacgtcatgggcctttttcttttgtggactaaacccacacggacaaaacaaacacaagcgggattttgttgtgccgtttgtgcaaagcgcactaccagctactcgggtgggatttttgtgcgggaggggatgggtgacgcgtgtatttatcgcacggtgagaaaaaacggctgaaacccaaaaaattttgagccgtttgtcatgtcgagagtccctcttttttttttttgctggctttccatatataggaccgatgcaaagggagaaataaatcaactcaattggcctttgtaacgatggtttactgttccttggcccacacatcagttgcttgtaccatctaagtacaatttgataatatgttatcgagttacttctattagtgaataagatttctgagtttttctttgcgcttccgaacaatagtttgctcagttttcctatgctttataatcactccgttttaaacctacaatcctatcatattcctattatttcctatgttatgtttttaatgttcctacgttttccatatcctgaatttcaaacaaaacctcagacatgatgcctcttagagcaaatttaatagtataaccaactactagctctaattcatctatagccaatctaatagccaattcatacaatagttgcttactatactattgatatatggtcccacctgtcatacacacactgcgtcttggagtccgtgctgcagctggctacagatctgtaacccactattcttctctctcatcttttagctcgttaaaatatatctatagctggctaatagtaggactgctcttaggtgctaagagtggctagctaatgaatgcctatctaactaagtgaaaagtaaaactcaataaacccacgtcttcaagaaattatgggccgtctgatttctacaccagacaatgcgagctgttggatctctcaaacggtgaaacctccccgcgatccttccgaaaacatcttttcacaatgggatccttccacatcccatatttttcttttcatttttccccccttctcttccttgctctatctgtgcgcttccctggactccgagatggcaggagtggaataagtcatgtgacatgatccaattctctatttattacacttactttttattatagtatggaaatgcattcattttctttgcatcgattgcgatatgcaatactatcggagtaaaagaagggatctaaggaagaacgtagtctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattga

SEQ ID NO: 19075 - DNA, 1501 bp, Oryza sativa
gtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggaagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaaaggaaaaggggaaagggccccaacccaaaaaaaccttaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatca

SEQ ID NO: 19076 - DNA, 1501 bp, Oryza sativa
gggggcgacagctcaggcagcgtacctgcgggctcggcggcagcaagtggaggccggcgacaatggactcatctctcacagatgagcgcccgtcgttagtatggatggcgctgcagcacatcgtcgatggcgtggattgggggtggcagttgggagcagcggcgctggcggcgcacctacaggctcggtggctgcgagcggaggccggcggcaatggtgactagtctctcccagatgagcggccatcgttggcgaggacggcgccgcgacacatcgtcggcggcgtggttcgggggtggcggcttggagcggaggcggtgactacgagcagcggctcaggcggcgcacctgcaggctcggcagctgcgagcggacgccgttggcaatggcgacttgtctctcgcagacgagtggccgtcgttggcgagtacgacgctacagcacatcgtcagcgatggggttcgggggtcacggctggtagcagaggcgatggctgcgagcagcgacgtgcgacctcgctggcgccgcccaccacatgcgccgctgttagcattgccgcttaaaccgcgccgcctctccccgccagctccgcgttgccgtcaggacgcccaagaggcggccgacgagctcgaggtcctgctgccggctcgcgctgtcgaagtgtgacttcttgggctccatctccaacaaggacgtgtgggaggcagcgttgacagagaccgcatcagccggcacagcggtggcggcgccggcgaggtcgcgcgtcaccacttgagctctctcctcttgcgcttggtcgagcactgtaatgggtcacgagagcaagagctacagggccgagtaagcctggggctggctgcccgtgctggtctcttgatggtgggtccatgtctcttgttttgacggtggaggctaaccggagtaacagaaatgccagatagggaagaaaaattttgagggtgtctaggtagtgaattttttaagtttagatgctatagagggaagagcaactttttctgatgctacatagggaattttctcaaaaatatatgtgagatgtgggatttgaactcaagatctctcacctcagtcctcacatgcgtttgttaatgaccaaatttggtaattcaagtatcggagctagagataaaatcgaagcgaaatccaagggataagttgtttcggaaacagagtaaggatcggctgaagtccgaatcggctatggtcaagatcggcagagtttgagttggacaaggttagccgattaagccgattttggtaatatgacttggtacacgtcatcgggttaagacaaggtgcttcatatggattgccacgcacggattgagtcccagaaaggcaattgtatctattaattaggatattttatgttatttccttagagatatgtttgggcaagagtctgccgtaaagacttgtggtgtcttagagttgtaatagagttaggagtcgtgtccggcaaggacatactatgtatctc

SEQ ID NO: 19077 - DNA, 1501 bp, Oryza sativa
cttttgtttatgttgtctgcaataattagttaattatcttgatgtcatttgtgctcgtgtgagattgtaatatcgagttatgtccatcttatcaagtcatgtactacttttcccatatctatagcctttttacatgatttgttcactgtttgtgcgcccacatttaactactctcctttttttaggttttaatgtgtgatgtcattaatttttaacgtacatctgaccatttttattatttaaaagtttaggtaaaatatatatgttatgtttaaagtaattttaatgataaaataaataaaatgaatgaaataacataatttattaatgatgaattttgctacatgacatttaaaattcatgtaatttgccgacaaacatcgtaaaaaccgtatcacgacacaagtacaactaataatttgctgaggacatttttggcctaattagagagagaaattaataaaaagataagaaatgaccaaacatgcatgtcctcaaaattgaaggtgtcatgcattattaaaaatcagagaaagtattaataacataaataatcaaacatgtctctaaaagtaaatgtgtcatgcattaaaaatccgagggatcagtatcttagtgtcggtttagccggcctaggatcctgaattcagacagtgctcgtctttatacgcctttatatgaccagctttggtgctccacaccctttaaaattcgtccaaataaaatgtatgtatatggaccaacatacaaaagaggatcacactccgtctctttctgcgaaaagcgaaaaaacgtgcacatccatggctcaacgataaaccaactcgctttcatatgcttatagctagtattggagagctgcacttaacactgtatctctatctcaccatttttacggctatgattgatcaagctttatgcaagaatatgatattaagttccttcttaattagtatcctcttaggtagtagccgcatacgataatgcattatcgcatgcaatccaccaaccggtttcctgtccatcaactgaccccccaggggaccgatttttgctggcgctggtatttatggcccgcctgcaatctaatggggtctcatctgaaaaaataatttctgtagcagtgagttatcatgctatctgtctggagtatttagattacatcgaaaacaagcagtgaactttttccttttgtgggtgaaactatcagccggccgcaaggtgtgaactgaacagatttaattttatataatatatgttattttcacacatttaaatgtcaaatttaaagaacttgcgaattataaacatttaaaacacatgtggcctgtatggtggtagctaggcatattattaacaaattaaagcaaccactcagtagtacatgttgcagatcatacatatatgtttggatcatacatatttgtagtttggtacagagataaaccacctgatctctgtcttgcagatgtactttaaaaggatactcccttcgtgtcat

SEQ ID NO: 19078 - DNA, 1501 bp, Oryza sativa
accgagccacctctccctccactacaccatcgcccacgccaagaccctccactattcccttcgccgccgtctccgtcgagccaagagggagaagcgattgccaccgccgagccgtgctcctgtcccctctcctccctccaccgtgctgcgcttgtcccgagccgccttaccgccccttctactgccctcgcccccactgccaacaccctttgctccttggctgagagtgatggagggagagagggaggaccagagacatgagaaagagctagctcgagctcagttgtgccacgtggctttaatagcgctactaccttttttgcgagcggacctctttatgtcccgcctgtaaaaaaagggacttaaagaggtcctcctatggaaataaaggtattttcgcatgtaaaaattgatttttacagacggggctagatctatggtgcttcttcttattttcacaagcgggattttttttaatttgcctgaaaatgtaaaacatatgtgtcaggaaaaatctttttttgaaaaagtagtgagtatgttgtacatgtaaagtacaattatacctatggatcggaatcagaacaaagagtttttcaaattcatttcatttaaaataataataaacatgtaagataatatttgctttaaaaaaagaaacgtcaagtccaactgcaaatgctttttagtcgatacataagataaattaaatcgagtttatggttatatactaggaataataatattgcgagacatgcggtatatatttttatgacatcaatgtttcagcattttttttcacataagtatttaattagttggcattttaagaagcgaggggcattatatacatatattattctgtatatataacctgtgctgtcaagtactgttcaaacccgcatccgtacgtatatgccctatataacacgtgcagcctccacatccgcaatgcaaggcaggcagtagccatcaacagcttagctatcggcaagcacatctagtcatagtgaccatgaccccgtttgtagcagcactggttgtgcttttcgtcctctctagctccattaatcttgttgctcatggcggagacgctgaacccggcgcctatatggtcatagcaaccagctccatgaaaccaaaagcttcctgctctggccacaagggtataatttcttctatatactacctccattttttaatagatgacgccgttgactttttctcacatgtttgaccattcatcttatttaaaaaatttacgtaattataatttattttgttatgagttgttttattactcatagtattttaagtgtgatttatatcttatatatttgcaaaaaaaaatttgaataagacgaatggtcaaacatgtgagaaaaagtcaacggcgtcatctattaaaaaactgaggaagtatatatgatgaagctgaaatgtgcaaatttttgtacaaattcctgttcctgagagcatcttaaatattaatttttcaaag

SEQ ID NO: 19079 - DNA, 1044 bp, Oryza sativa
ctcatcactgctagatccatcgccaccatccgctccaccgtatcaaacccgctgccgccgggctcccaccccccctcccgcgctctcgctcctgcccgccgccgagctccccaccactctcgctccctctctcgtccaccgccagagaaagtggtcgtcggccgctcccgagctcgccactcccgctcctgcctgccaccggcagaagtggttgccggtcgctcctgctctcgcctgttgtcggccgctcctgatcccgtccgccaccgaaggagagaggaggaggaggaggagcggaagtggaggaggtggaggaagtgatgggtggagagcggagaggatgagtataagagagagagaggacttgatattttaagggtaagcttgatctgatgagctggtggcaggcggggctttgaacatgccgtcttacgaaaatagatttattttcacacgtgatttttgaactgtgtttgagggaacgatttttccataggaaagcagctatggaccacctgcaacctaaagggattttataaaaaaaaaatcgattctgtggtagcgtgcacgtcgatcgtcactgctgatcccattgagacttgagagtcacccactagctaacgcaatctgctactcactagctagtagctgtttctgcagctgcaagaacctattctgctccgacccggcgaaaaaaaaagaacctattctgctcacatgtcgcagctgagatacaaatattgttcattaagctatctcatgcatgcatgcatggtcctaatagtttagttatacgaacagctaataataagtttattcgaatataattcctactgacattagcgttcctgcttccgatctgaattcagaaataatgcaaattaactgcctaataactttattcgatcgaatccattcaactgatggaggctgatgagctgctggtccagtggcgtcttttaattctagttgcatgcaacgtcgcttgcacatttggtagctagcaagaattgagctcagctcatgcacgtagctgtgtcaaga

SEQ ID NO: 19080 - DNA, 1501 bp, Oryza sativa
tctccactgtgaccatgatcttggcattgacttcttcttcagacatgtggatataaaattcgtggtcctaccaggtgtgccaatttgtgttgacgaaaaaatcgaacacgccgccctaggagatctgcttagctccagtgctggtccaaaaggttgatgagatgcggacgtgccagtcagtttgatcctgcaactgacaagatatgcaaacagcagataaaacagccgatcggctgacaagccgatggagtaattccagccgatagccgatattagccgattccaattccagccgatgccgatagggttttgagcaatcagctatatgtagataatgatataaaggcaatcggctgtgaaaaacatacactggcctggaagatctgcttaacttcagtgcaggtccaaaaatcttgcctttaggttcgtgagcgttccagttgatttgatcctgcaatcaacaagaaataaagacaggaaaatcgtggttaaatccataaatgatagccgatcggccagtcgctgatgacatatcatttatcttccagccgatgtcatatttgaatcgattggcaattataaataagcaagacagaactaaatctactcgatcggctgtagatattaacgatatataattcttctgtcgatgtatatttaaatcaagtgattgggatagatcggtcgccatgccgagacagtataaatcacttagatcgaagtatacattaacataaagattataaacgtctatagcatagccgatcagatagatctagtatgtaacggctaatactccaatactactctatattaagatattaaaacagctagaatatatcaaacagaagtctaatatactttattgcaataagatcttaacataaagggcatatttaatatatcaatcaagcatataaggatataaagtagttaaattaggtaagatcggctgaaaccccgatgctatctccctagataaacataaaacaaactagatatcatgattatagatattacttaatagatcaaactcaaccgatgcagcattaagcataaagacaagcgcaagatgtaagcaagatgatgagaatatgtaagagatggtggatacacgatataatctagatcgatagcaaaatataactctaccgattgtttcctaacaacaagaatcagccgataacaagttatatagtgcgattaatagagattataacgcatatatgataactcgacgatttacataaacagaattagagtgttataaagatggaagcactaatcccgagaacgcaagccgccatgacaagtatacctctggttgaagatcaaattgatgcatctcgacccgaaagcaagaactcgtcgaaatagaatgaaagtaaaaagggtggcgatgcgccgaagttgtattgaacgtgtgttgttttttacatggtcctcgggctatatttatacccgagatacatagtatgtccttgccggacacgactcctaa

SEQ ID NO: 19081 - DNA, 1501 bp, Oryza sativa
ttgtccacatgaactatatttaaaaccttaggccttttttttcaacttaggcttttgaatggtctttatttttgctctttggcttctaaacatatatatctaaactaagtggcttacaacttccacaaaagcgttaatgataaagttacttaattgtttgtttgaagctcaggctttcagacagggacgaagctagaacgaaatgaaatagggtaccacttgtttaatttagggtgtgttctttatttccccatcttttccaactcacctctctcgttttccgtgtgtacgctttccaaactactaaatggtgtgtgttttgcaaaaaatttctatatgaaagttgtttaaaaaatcatattaattctttttttaaaaaataattaatatttaattaatcgtgtgctaatgagtcgtttcgttttccatgcgaaggaaatgagttcccaacacagggaaacaaacgcagtcttactctactttagatcaagtttaaattgacgtggatgtctaagtttgtattcagagggtgcacacaggtgaaaataactgaagtatagctaaacaattttcttgaccgggttcctggacacccccttgcccttgctttcagacttataaactggtataagcccaaacacaatgagaatgagagactaagcagagtgcctagatgatctggaagcataattatacacatatatgtatgtttcttttagaaaatggataatcaggccactacatccaactgaaacgatgtacacagcctattttacacatatatgtatacctgaggaaaaccctctgaacatctggaattaagaatatatgtcaactgggacagaaaacgctggagaatataaatcacaagcacacaacacagccaatcaatttcatgcacatccaaatctgaagaaaatataaaaaaccgggaataattgatccttattcgccagattggaccacatgcacgatcgtcgatctggcccccacacgacatatgcatccatacattctccttcatctcatctcttcttctccatggccactaatccctcgagggaatatcccctcgtatacctttttctttcaaattcgatgtaaatagttatgaaaaaatctgaaaaaaattgacaatgtagagtataatgatacctaccagtgcaccaaaattcaagttcaaattcgatctacacatcgagaaacaaaaaaacaaatttagatataaacagtacgctactattcatatgctgaatttgtcttttttatatctcgacgtgtgagttgagtttggacttaagattttgtggagttgtatatatgtgttgtatgaatgttgtcaaattttttcagaatttttcataaccgtttaaatggtttttaaataaacgagggaacatcctctcaagaaattagaatagtttccctataaattcacctcgccatgcacactcccagccacacagcaagcagcagcagcaagctcgagctaaccagctac

SEQ ID NO: 19082 - DNA, 1191 bp, Oryza sativa
cttcccacagataaaattaatacgatacccttggaatactctcgggtgaaatgttacaatggtatatccgtgcgcttgcggatgaactctgtaaccataatataccagaagtatttctgtggcattgctgagaattatatttctgtaatgtcgttaagaaataccaacaattgtaaaatagcaacgctctgtatacaataaaaaaatgtagttaaaattaaaccatccagcacggtgaaaaaaaaaaaacagaattgctaaacttcagtcgacagaaaacctacctccaaaccttgcaaattttggttcactggatgtgcttcgcaattcgtgctccaactgcttcttctccaactccgacgaactcctcttctttctccggcgccagcgacaacccaaactctagcgaagggccgacgaattagggtcctgggggtgggtggggtgggaagggtgggagggggaggggaaagaagggggagttcgccgggcttagagggatgcccggcagtgggtggcggatcgggtgggtggcgaggcgctgacggtggcactagagccgttgggctggaggacaccagtgggccagcgttggtggcaggggcatcacgctgccgacggctcgaggaggaaggagggggaagggggaggaggctggccggggggcatcgccagcgccgttgacgccctccatccagccggcgaggcaggcggcggcgcggtggggcggtggtgacgggggatcgtgcaagggacggtaggagcagtggcggtgcgatctggatgggggaggaggagaggagttagagttaaggggtctgaacgaatcttgaagcagatccaattgtccaaaattaatttgaaagataggaggtaggattttctgtcaacagatacgtagacagccaaaaaaaaaagatccacaaaacagccgagttcacaattgaatggaaaactaaagttcaacgaaaattcctgaacataagactaaggcatgtcttctaaattgatggaaatcaatctaaataagttcttcagctagaaagtgtatcacatctttcatcttccttctattttttttaagggggcatcatttcttcaattattttcaaatttttgggcgtgacaggtaagcatactaacccactgctaccatagttgccgttatataccttgtgataaaatgtcaat

SEQ ID NO: 19083 - DNA, 1501 bp, Oryza sativa
tgatctaattgcttgtccaccttgtcacgctcagccattctgaacaagctcacttgctccggattcagtttactggcatggaacttgactcccactgcgaccaaaacagaatcaatacaacactagacagattatagccaaatttctcagtcttctgaattgaaagggctaagaggagtcacaaacccatgaactaatccatggtttccatgaatttttggccggacaaccatacatataaccatgaaatctttcagaaaaaaaagaagaagagaagaaaaacaatcggatgatgcagttacgtactgacggggatcatctgcggcggcacatgaacatgcgtgacgacgatggccgtggcccggaaatggccgagagcccacgacagcgtcgacctgccggacttcgcctccgccggcagcgccacgaacaccttctccggcgccgccatcgaccgaccttctcgtcaagcttagctccagttaatttaatgttcagttagcataagtacaaagctagcaagaacacgcggctttgggcgtacagaccggagactttggatggtgacaggcaccatatgcgaccgggaggaagaagaagaaggcaaaattaacagtgacacattaatttggacgacacggaaccgcatggagatttccaattttccaccaaaattaagtgatgattaattaactagcgccaatatcagcgtcatcgatagccttgtcattgaaaagaaaacttgcacatctcacagtcgcatcgttatataatttgtcttgtgccttgaccgtctccactgatcggttacatatactactaactccatattttaatgtatgacgccgttgactttttatctaacgtttaactattcgtcttattcaaaaaatttatgtaattattatttattttattgtgatttgattcatcatcaaatgttctttaagtatgacataaatatttttatatttgcacgaaatttttgaataaaacaaatggtcaaacgttgatcgaaaagtcaatgacgtcatacattaaaatgcggagggtgtacaaaattaatctgctgcttcggtttcaactaactgtttgaactcggaagggccgaagcacacggcaaggaaaggaaagggatttggcgggtggcaccgtgcacatcctgaacccccacagttcgttcaggtgtcttttcccggcaaattaattattaggattattactcatctgaataagtcccattgaataaactcctaatactttggtaatgacgttttgaaactttaatgaaatgatatcctccggcatcgtgaacatcgtgataacttcgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggccc

SEQ ID NO: 19084 - DNA, 1501 bp, Oryza sativa
gtttggattatgtatttttaacttgcttagtttgcaccaataccagattgtgtagattaaagtcttttattacagtaaatttacggataggaggctctacgaccaagtttatactcaggacaaatccgttctactttatttcaaattatgtctgatcttaataccttttaaattagcctcatatatctctttttttcatgctgtgtaagttccaattcagaattacaattggctacaccacgggacatctcactaacttaaaggtgattttgttcacttttctttgagatcaactgtatgtacaattctgaatgtgcctctttttttttttctatcaaggtttcatgtagtccatttggactaatcattcatgtctcttttccatattatttcctcaaagcaagaataccactttggtaggatacaaatatcccacggtaacacacgaggtacccatctaattttcctgaagtcagtgccagctagggttctaccgaacctctggtttggccgaaccaggcaaactgtctctctccaccgcctttggtgagaggctgcaaggtgcgcctctcagtcggttcccaagtggttggccctactttgagccggtttgaactaacttgtgggcttttcaatccgtgtgctcgcacgtgattcgtcggatgtatgtttcattgtatgtcggcttcatttcttcttcactttgatgtataactcctgcatccaagttaattctctaatcctaatacaactacattatttattattggtatttttccctttactagttgagtgcccatgcgatgcaacggtgaaaaagaaaatgtgatattgttaagtaatcatggtggctagacccttccaataatacctgactgttgctggtcacaattgagctgccgctagccacaagcattatgaccattcgaaccattttcctgttattatggttagagtaatgcatgtgctgccatagatgccattgtctgcagctcctagcccccttccagttgtccatacaaggatatgacaaagtaacaaaatatcaactaaataatcaacgcagcaaattaaactgtagaagagattaatcatcacctagaaccaaacttgtcagatcaattggtgtccatcatctatacaaaaatttcaaatattgtcttgctaaatctacacctgtgctaaaggaacctgtagtgaatccgatccaaaggagccatgcttgttctgtaccaaatatgctgaatttttgttataattctttttactgaaaagaatgctctatggctctacctgccttaaaatactttttttttctcttaacctttatgttcattaccagagtttcagctaacctgtaacaatgcaagcattgttattatagtaccataatacatattcaaaatgattgtgatagaagttagatatatgacttactgtgatccaaaaataagatgagactgttgttgaatctcttagttaaaaaaactaagaagccaga

SEQ ID NO: 19085 - DNA, 1501 bp, Oryza sativa
taagcactattcgtaagagtggcaaatagttaaaagctccatccaaagcaacgggcatggcttacatttctaatcatttgagagggtgtttccttgtgtatctttttctaaattcaatacaaatagttacttctttaaaatattaaaaatatagagtatagtgatatacaacactctaaaaaaaacatcaagtttaaatacaacgtacacattgagaatcaaaagaaacggaagtcgaatgtaaatagtactcttttttatatatcaactatgaattgaatttggatataaatataaatgttattaaattgtttgagaatttttctataactatttgaatgatttttagaaaaaaaattcctcaagcaatgcttgagtttaagatgggggtattcacttaacctttacaaacctcatgtccctagctagtagtgtttagtgggaaaaagttagggtatttaagatagttggttaatagattagaagtggtgtgagataggagtaaaaagaagtggatttatctctattattataaaaattgaagatgtttttgtcgatacgttggtacgttatccgtgcatgagtcgatttttaattttgttcgcttttggaaatacatatccgcatttgagtcacttcgctcacttttagaaatacataaggactcgtataagatatctatttaaaaaaacccgcatgctaacttgagatgattagactcctaatgtagctcatgattatatatatatatatatatatatatatgtgtgtgtgtgtgtgtccaagccaattatcacagtgaatttcatcttaactaaaccatataacaacaataagattaaaataaccttcgcctgttgtgaggcacggacatttttttcatgttgagaaaaacgatcgagagtgacgtattagatgtagttaaatatatacatatgagatatatctatatatattaactttatttcatattttttttgggttttccggaaatgctcaggatcgatcccattgggtctgcccctgccctttgagatcgaaacagttccatagttggcgttatataaggtgctggagcctcaaattgagacatgcaatcatcctctctttatttctactgctaagcacataactactctagtactaataagctagctaactaagggtctgttaagattgatgccaagagacatgcaatcatcctctctttatttctactgctaagcacataactactctagtactaataagctagctaactaagggcctgttcagattgatgccaaaataagccttaccaaaatttatcaatgccaaaattttgataaattgacaatattaccaaaattttagtaagattggcttaataatgttgccaaaattatataaacattactaatatttagtaacaaactaaacgcagtcacataattattaattttaccaaataatgatatggttgaaaatgtcatcaatctaaaaggccctagctacgtaacta

SEQ ID NO: 19086 - DNA, 1501 bp, Oryza sativa
aacagagggattagataacactaaattatcatgattattacaacactgtggctgattttatccggtctatatatcctttaattttcagcctgtcggtgcgtgagaaccattttcgcatgcttgtattcgtgtttgtcttttggccgggcctcataatgttgactatatatgtatcgtgcatatgatacgtgtatataaattaaagaaaaaaaaaccctgaaaggctgcaatgcgtgtaaccgtatcgaaaagcttcaggcccggttgtcatgcccatgatttctgctttgtcgtccttctcacgtcgttgcagtttgcagattgtagagttagtatctacaagtcatctactcacacaagatgactctttaaagaactgttcattgttcaacactgtcacaataataatatatcatggacagtgtactccttttcagaactctcttttgttgtttagcaatcactggggcgaaaaaatagctggaataataatcaaactgtgcatatgtatatatattaattagtttgcttgcaatggagaacaaatgccttgtgtcaatgcgttgtacacaacacatcacgacatgcagaaaaagtgtgctgcaaaccagctgggtactggggctacacacacctatctattattcatcctgcaagctcacatatgctgcatgtactcgtcgatcgacatagatggtccggcacaaccaatggcagtgggtgttttcaacacctctcgatctgcagctgatctcaacagtttattttatatgatggtgtaaccatctaatataccatgttgctgataatttttaaccagagcaattaatcggagcatggccctagtgttgaacaatttgcactttcacagtcaggtgtaacattttgtacattcagcataatggtatgctctttgcgctttttcagcccttgtgtaacacagcaggatttcaaaaacacaaggataaaaaaacgtataaatagaatagcatgccacaacaaatcatacaggatttttttaaagaaatgttacaggaaatgaatccactgaatttttttttttaaaaaaaagtttggtaacaccataggagaagtaaaggaattaggagtcacgactcatgatgaagagaaaacatgagatttaggctcatgttaattttcctccaaaatttgttgaaatgagccattccatatgaatttcaaaggattttatatgagtcattcatttgttcgtaaggacaatataggaacatttttcaatgaattgtaatcctctataatttctacagttctcctttatcccaaaggaatctttacgtacgcacaggtaaaattgggactcccatgatcccatctttaccagaaggggcgagctagaggattgccgtgcgtaaatttgcacggtgctagctagctagattttgaaagtagatgaaccgatatataacactttgggtttcatactttcattagtccacatgaacatcgaaccctagcttag

SEQ ID NO: 19087 - DNA, 1501 bp, Oryza sativa
accacacgatttcaatctaacggtgcaggacatgacggcacagaacggccccatctcacgtccttcctggaatccgccgccgtccgccggagctccgccgccatccgttcaccggcattgttacacagaccccttatcctactccaacttcttctcgatggcattccacccagcttgtgactcgcgactttgtgagtacatgataaaaaaaacttaaaattcagatagatattctgacatgaaaattgaatgatctcatcttttcgcttatgcttatacttgttagctaaaatttgaatttttaaccttaaatttgaagttgattttgaggtttttttcatcgaagtttatttttcaatcgactccactgctccagaagtgtgaagcacatgaaggtaaggttcagtcagtcatgggtgcatcacaactcacaagttcacacctcttacatcttgagatgcatcgatcacacggggcacagcaaaaatcagctagctagctcattggttcgggattaattgcatctcaagagttcagacttcagtcttcagaggcaatgaccgtccttccctctttggatcaatttcagatgaatattgagtgtggtccacaaattttggaccaaattaattaaaacgatcatttgggacttgggagcgcctttacaaaccaccgctagatcagaagcgaagaccacagattgaagatgaattaattcatttatttgtgtacaattaggttctacattgatcgagctgcataggtgcccgcaccaatcggacaaagccacacacatatatagtgatcccattaatttgcccatcgaatgatgacgcgacggcgccgaatctaataatgccctgaccctatggtctccggcacatacatgcctcgtcatatgagcttacttaattaagcaccgcaaacttgaaggtgaaggtgtacttcacatgaacattacagatcgatcgatgccacttcattcgtgcacggatatactgtatgcaccaatattgtcgaccacaagatcgtttaagagtacaggtagaatacccagatatatagcttagttaattattaagtccgtccaaaaatatactctctctgtttttctctctgttttaggttataagatttttgattttagtcaaaatcaaactgttttaaatttaatagataaatatagcaatatttatattatcaaattagttttattatattaataattaaatatattttataataattttatcttggattgaaaatattattatttttttctataaatttggttaaacttaaagcagtttgactttaaccaaagtcaaaaacatcttgtaacctgaaacggagagagtaacaacctaatttctatccagattcgtgatactaaaatgtatcagtatctagtattatgttgttatgtaattgccggaacaacaaatgccgggccgactcaagcaaatgcatgcctagctcactcactcagctcagctcaatc

SEQ ID NO: 19088 - DNA, 635 bp, Oryza sativa
cgttgtgttgctagcggaactcccttctaaattagggaaagaagggctttcgaaatctaatacacacgtatagatactggcatagcaaatgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagtggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgttttttttattaataggtttaagattcaatggaatacatttcttttttattatagtatcggcaaggaatgtcgattattaactcgatatttaaatattattaaataggctttctttgtacaatgcataggactgacccctccccatttccaaattttggatattgacatagatacaaatactctactaggatgatgcacaag

SEQ ID NO: 19089 - DNA, 239 bp, Oryza sativa
aaccctcttttattccctaactctagtatttatcctgttttttttattaataggtttaagattcaatggaatacatttcttttttattatagtatcggcaaggaatgtcgattattaactcgatatttaaatattattaaataggctttctttgtacaatgcataggactgacccctccccatttccaaattttggatattgacatagatacaaatactctactaggatgatgcacaag

SEQ ID NO: 19090 - DNA, 1501 bp, Oryza sativa
aaatactacgaatctggacataccatataatattaggtgatgttgaggaaactccaaattggatgcctaatcatctctaaaaaaaaatcggacccggtcaaatgtttcagttaaccaccggtgaaacattaatataagttatacatgatgaaataaaaaaattagccactaaaatatttttctgtgaaacacggtaaagacaaacgttgaatcatatcgctattacgtatgaaacatcgagggttaatagattgaaacatatgctttttttatcggaatatagtcatgtgatatcttgttgtaaagatttaaatacaacgtagaatataacggtgtgatatcttgttgtaaagatttaaatacaacgtagatcgaatataacggtgtataggactgtataatgaagagatagcaagacacaagtaggttgttggttatagggttggagcgctcgatcagatcggtcgaccaaaccaaagcgaatctcgagtagcattagttcctatatttatgaaggaagggaatagcatcctattttactctagaccgacaaccttcaacttcaactgtcaaattatgtgttggccattgcattgagtacccgaatcggaataaagtcttttattacaaaagttgaacaatcagaataaagagtaaacggaccatggaacttttgctttgctatgctgcttttgtgaaaaaaaaaatgctccagggatactcaatccattatcttctttttttttttacttagtcacatctataacatcgatcgtacacatgttttacgaaagttcttcaaatcgagcgcccgatgcgggcacgtatgcatcgggcgcccgcacctcccacgccatccccaccacgcaccccaccacatgcgccgttgcaacaaatcacccgcaaattacgaaaacgttctattaagggaatccgtttcattttttgttccaccaacaatgtttcagcaagtatactcgtgttgtttcactatgtatagattaaatgttccagtgaattgaaacatcattttgctatttgaaacattgtttctatatatggtgaaacagcttcaaaaccgttgtttcatacgttatatcaaaatatttcatgaggtgattcggttgtgtttgaaacatttttgatctaattagtgaaataattccgatctacttggtggaacagcgctcaatttattttaaaaaaagatcgagcacccgatttgtaggcgccttgcatgttttacattgcctttttttatataattacactacatatgcatgcgcaaacaccattacactcacacaaacgaatacaacctctaacacatatttataaaactataattaaaaatgtattatctttttatggcatgtatatctaattaaaaagtctatttatcccttaagatgacgcccccttgttttttcatgacaccttaaaaagtcataaagaaattgaaaaactttgccgcaatatatcaatatatatatatatatat

SEQ ID NO: 19091 - DNA, 290 bp, Oryza sativa
aagaagattctcattctgattcgaaaagaagattttgcacttgatttatttaaactataaacttgcaacttaaaagttgcatacaatttcgagaggaatagctgaagagaaagcaaaattacagcattattcagatatcgcccaagtgcgtaagccaagttcgaaggcgtattttagaagcagcagcgaaagcggttttgtcgtccacgcgtgctctcccctttcgaaccaaagctagttccctcttctggtcttggaaggcgagggaaacctcgcttgcagcggcggaa

SEQ ID NO: 19092 - DNA, 281 bp, Oryza sativa
atacggattatctcgaatacgaataagaatcgaatatgaccggacacgaatacggaaacaattttttctcggtacacgaaaaccaagttaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctca

SEQ ID NO: 19093 - DNA, 1501 bp, Oryza sativa
taaatattgtagacgttgtgagctgtatagctgtcgtgacgttaattctgtgggtcaaaattcactcgctgacatattgaaaggtagatccggctccttgtgtactccctccgtctcaaaaaaagaaaccctggttttcgtgtccaatgtttgaccgttcgtcttatttgaaaaaattacgaaaaaaattaaaaagacaagtcacgtataaaatattaatcatgttttatcatctagcaacaatgaaaatacgaattataaaaaaatttcatataagacggacagttaaagttggacacgaaaatctatggtttgccttttttttgggacggagggagtatgttaacatatattggcaaatgtggtgtagcagaaaggaacacctggccagctgcccagctcaaaaggagctagctaggatacagaacggatccgttgtcaagctttggggttaggaccattaattatattggttccttttctatcttttccgaagcatcttacaaactttaatttactttgtgtacaccttaattaaaagcttccatccgctttggatcttcaccatctgatcttgtgaaataagagattttgccactaagcaatgattgtaccatctcactttttctagttctggataaaccaataattcagagtttccgataattttgttcatctcaactcacaatatataatcaactaagacaacatgcaatgcacaatcacacgaaagtgcattatatattcatctcggtcaatttgttcacaggaatccacattgtttcttctatgccctagctacctatattaagcgcttcagtcctaaggacttctttgtttggtggcatatgtaccaatggtatatttcaacctaaatggtttttgcggttgcttttgttgatgagttccatggtttctccccctatgaaacgtagactcccagcccatcccatagcttccgaggtatctagctaattaagagaacttcaaagggaaatttaactattggccactattaggtttgccaattatctaaatacccttattagatttgtccttattttttttacccctctaaagtggtggcatcttaactatttgtcacttttgcccatgtggtatgccaacatagcaacacagtgtaaaaatcgacgtgggacccacttgtcagtctcacagctctccccttcctctctctccggtctggctagccccgtcggctgctcctctctttcccgcggcgaaccatgtcggtggtggcggcggcgtgccggctcgtggctgcggagaaggagggggagccgagcgccaccgggagtccgacctcggcagttgcgagtgaactagctagatggattttcgcttgtgaacccactgctctatgataatgtgttagtaaactatatatcttcagtctgtgcaatctttgatcgcacttgcactatattgtgtttctctgtaatgttcttgtctgcttatctttgatcaaatagtcgataga

SEQ ID NO: 19094 - DNA, 1501 bp, Oryza sativa
aattgcataatctgtaatgcggttccaagaacagcttgagtaaaatgagacagagatccagtctcactcgctcaccgaaaacatgaaaattcagaacgtacagtctgcaagaaatctcctcgcactcgccgacgtccgtgctatccgtacgtctccggcggcgacccctcctaggattgacacacagtgagaggggccgcgtggacccagtctctttttagcccaaatgtctccttggggattccacctccgacgaaccactgggcacttgcatttgttcggggtttagccttcatccgaaatctgaaaacgagtaattcggagatctcctctgacatccgagaattgatgcagatcatgcatcaccgtgtgtgtttagttcacgtcaaaattaaaaatttggttaaaatttgaacgatgtgatgaaaaagttagaagtttatgtgtgtagaaaagtttggatgtgatgaaaaagttaaaagtttgaagaaaaatgtcaggataagcaaggaagctgacgttaccaataggaggcgcgataaggactctgacgaaggcggaggagcagaagacggaggagcagaaggcgtctttgaaagagagaagcgccagagtattactaatcctagatatgttgggccggaatgggccgtgtaatagggtagagtgggctgagaccttgtggcacagctggagagagagagagagagattaaaaactactgtgtactgtctgaaacggcatcgatctggaactcggcggtcaaggcagcggcggcggctccgatcctgttggatcgtgagagaaatacaaagttccagctacctatcgtgttcttgagttcgtggtgaaatcgagtgctagggttctaacaatctggtatcagagccatctccaaccatatcctcttgactcggccgtagaatcacgaagcgcggattggaatctgctctcgagcagaatccgcaaaaagggaactcgcttcccttgctgcgtttgggttggctgagttcggagcggttgcgagtctttgatcctggagaaaccacggtacgttacgaagtaggctgcgcaaatcatggcgtaggaagggatgttggatttgctgcttaaaaccctggaggatattgagaagatgcggactgaggcggaagaaagaaacagagcagatctgaatgagttcatggcggcggtggaagcgaggttgcctcaagtagagaaacgagttggggatttgcattcgtcgctgggggatttgagtgctaaggtggaacaactggagagcgccatgcttcgtcaggccaaggcggagaaggcggtgggagacatcaaggaggaaccaacagctgcatcgccatcaccaactccatcgtttatccatggtatgagagatcctatgttgaattctatttcgccttttgtggtagaatcagcaggagtaccagaagggggtagtggaagtactggaattattgttggaagtgttccacccatgacatgt

SEQ ID NO: 19095 - DNA, 1501 bp, Oryza sativa
ttgcccggaccccaacagttcttagtcacacccactcggggaaaggcacaatctccctaaaaaactagtccaatagaggaagggtggctctcccttttaaggtggtttcctcctcccaatctaaccaaagtgggattattcagagactcacatggtcgccacccgacttttacgtctttgccagcgggtaatagtagaggatgtcctcatcaatagttgtataagaaaaacttatttcaaaaaggatacacttatatcttgacatcctcgtcgtcctaactgccgagatgtagaggatcgacgcttaagagaaggataccgagaacctatttgtaaaataatttttctaaaaatgttcaaaataagtcttttgacactgatctccttcgtataagcaactaatttatcatggggtgctaggagataaacactgagacaataatctcggcgccaatgaccctggtgccaagaaaatgggcacatttatggaataagtttttctaaaggatttattcataaaagaaatttttaaaaggtttaaaatatattttaaaaaatccatcattgctcgtactgaaaccgggaaagaaaaaattgacagtgcaggtttagaacttttaacctcaaaagacaggttataccgttttagacactaacggccaccttaaaatataccaggatttcagtctacgtttgatttcagtaatatttttctgtacacaaatcttttttcgataaaatggccaaaccatgtttcgactaaaatagaaatgattcacgtgattataacagaaacgttgatatattaacgtggatgcataattttcctgaaggacacaaatattagttgcgaactccagaggtgatcggggcgctagccgtttcgtggctgtgggctcttctcacgtagcacacaataaaagggggagctaccggggcacgcgatccaaggttcgccgtgtacacacactccccatagaatacccttcaatttaggaccgcgctgaagtgaggggactgctcacagtctcgccgccgccgtcgcccacaccgacaataccgtccttagcgacgccctcacaccgccacaccgttgacatggccacattaagctccaagaccgacgccagtatgggttcctatctccctcttctctctctcctgttcgctctctaatacaaccaccattattcctatgagcatatcacctctagatccacacatgagggagccctagaatctaacaacaaaatgaaccaacagttagccgggaagaatcctatttttgccgagatgagctttttttagaaataaaaatgacatttgcgatagctgtgttctacgaaatatttctatgcactacttcaaagttttgatcagcgagatatcagtatcagctaaaaaagaggatatggaatatcatgtttttttttaaaaaaagaagaagaattggaatgtcacgtcctacgaaactctgattagtttaatctgacagcggaat

SEQ ID NO: 19096 - DNA, 1501 bp, Oryza sativa
gctgtccagagaaactgaccttttgctccccaaggtacaaagtaaaaaaattcttagattatttgagaattaatagacaaaataccatccaattactcatattgagttatagtagaactaatgcattagggatttaggatccattggatggggtcaatgggagaagcatggattcccgagttcaggaatcaaaagtaacggaccattgtctatgcatccaccaagtttaacgagacggcaatccaatacaggttgaagttagggtattgatcggtcgtcacctgcttcaatgaggaggggaacgtgatcttcccggactcgagcggcggctgcacgacggcgacggcgacgtcgcgccaccggcggcagacgctggcgcaggccaccacgtcgcgccggggcggccacctctctgagccggcctccacgcaccgcaggatatctgccagaaggtcgggcaccaacgccgaccacctctcctcgcctgccccctcctcccccgccaacggcgacaattccgacgagacgtctggggagaccctcgcattggtgcgggcgggacgccgcgcgggccgcgaggaaggggcggaagaggaggaggaggagcggcgccacggaaccatcgcgaatcgccggcgatctcttcctagagacctagcttcgcggcaacggcccgcgggagatcgaatgcaacagaaacagagtcggtgcgaataatcgggggacaaataaaaccgagttcgttaaaataaaataaaaataaatcgcgctgtacgtatagattcaatctacttcaacgagtggattcgatgcttcgttttgaagtatagatcaaaatcaaatcacccgctaactgtttgctacttaaggtttctagcttaaatattagcacgttttatcatattttggatattttgtgcccatttgaacttggcccttatttagttccaaactttttttttcaaacttccaacttttccatcacatcaaaacttttctacacacacaaatttctaacttttccatcacatcgttccaatttcaactaaacttccaattttaatgtgaactaaacacaccctcctctttcttcatttatcatttcatgtcgtagatggcagctgaccgtcttatccaatgaacagtttatatgaaaaaatctccatggtgattcctcctatgtcctagagtggattttgaactcttgaaagtaccacttgttgtttttatgccactcaaataattagggtattctagtgaatcgtacctgttttccgacaggaagctttggctgctaagattttgaccggatacgaaatcactggtgctcaatcatcccagttgtcctggactagacaagtacgtagagatcttcgtggaaccggggagagagtctcaatcgatcttttctaggattccaactcacgccacgcacgaaggcccaggaagcgaagggaatgagctcggctgtttctcctccacacttctttatttctccgtg

SEQ ID NO: 19097 - DNA, 898 bp, Oryza sativa
ggagggcggcagggtctacttctgtaaatattttcaccggtacaatatttctataaatattaaaaataaaaaatttaaaatgaaaaaaattctcacatgcgcgcgatttgttgcttcatcatgtgggttttgttgggccagagccagcagcccgtcttgggtggagaaaaaaaagcccacaacgttttgtcctctgtaaataaaagcccacagtcctagaaaagttgtgactttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgctctctggtggggcggcaaggggcccgaatgcaaaaaagccagtcggggccggctattttgcaggcagccccttgccgccctctagccgggtggcaggcctcgctgcctataaaaggcctgctgcccagcccccagccctcattcttctctcctcaattccagtgaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttttactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 19098 - DNA, 1501 bp, Oryza sativa
catcatcattctatgctagattgatttgaaatttaaaggctaaattaattacaaacatgaatcaatccacaaccaacaaaccaattattatcgggtcgtacaataataggcgataggagatccatgtaggattttctgctgagctggaggggagagggcgcaagcgggcgactaattagtcgcccggctgtacgcatggctcgaggacgtgggcccgcccgtagcaagcgatgcacccgtgctactcgccgttgcatgcgtcggagcgtccaagtccagggccgcgccgccatcgtcgcgcacgtccgcgtccgccgccgctgccgcctttgtccactacgaccaccgctaccctcgtccttgtcaaccatgctcgtcgcctctgtatgccgctgccgccgaccttgtccactgcagctgtcgccgccaacttcgtccgcctcggccacggctgccaccatcgtgtcgttgcccttgccctcgtcggtcgatgttgcggctctcgtctaccgtggccatggagagcaagtagaagagagagaccaagagagcacaaagcttggattgagttctgaggtcttgtgcttatgaatcagcttgatggtttgcccggttgcttcacttctatcttccaccgttccgcgtgcagaaggctagctcaacgctagtcgccggacgacgagctcggctccggtgacccgtttgctctatccccagctacacgggcagcgtgagcctgcacgatgagctgtttatattttctgatggagaaaatagaataacatctttctctagaaaaatcagatagcttaagcgaagtagtagcatacgtatgtgtatatattgttttgtaccgattccttccatgtagatgagcagatgtatagtacaaaacggatgtgtatatagccataaatttgttcatctttttggccatggatgagcttggatgcctagttcctaagaagcaatcgccggcgagaacaggggattaggagagagagagagtgcggatagaagggagattaaaataaaatttcttgtactgtgtgagccatagtagtatagcttgattattgtgtttactggctacaatgttacctatagctgcgatggatcaaaattggagtaagcagctggctgtactattgaccttgctcttatagtaaacaggatcccaaccgaatctagttccttgctacaactgaccaaacaaaacgagatctaacccaattgaccaattcacacgcaggcatccaagatggcaaccagtttctgccaactccgccacctgccaagcgtgaacgcggatctggccacgtccatgtccgtcgcagtaatgccacgggcttcgcaccgaggcagctcagccctggcccccgtccccgtgcatgttccggcagccacagtgatggtagtagtagaaaaatactcgtagctgccccctgccatgctcgcatcaactttttaggcagatcgcgcagaaagtctacaattttta

SEQ ID NO: 19099 - DNA, 1501 bp, Oryza sativa
agaggagctgatacaacattatcagtacgtaagcaagaccctatttagttggcgagacgaaaagttttggcgtgttacatcggatatatgtacacacatttaaaagattaaacatagtctaataacaaaataaattacagattccgcctgtaaactgcgagacaaatttattaagcttaattaatctgtcattagcaaatatttactgtagcaccatattgtcaaatcatggcgcaattaggcttaaaagatttgtctcgcaattacatgcaatctatgtaattagtttttttctatatttaatacttcacacatgtgtcaaacattcgatgtgacagagtgaaaaatttttgtttgggaactaaacatggcccaagttaaagacatgaatttcacccgacattgaatttcactgatcactgctttctgttcccgacatggcctactttatcaatcacaagcagccacccttattgcgagtaaagaatagtagtgactgttttgttttacaaaatcaaggtgtcaaattggcattatcaatgaatggtacctgacctaatgttttttcctgggtttcggatctgtgatgtgaagaaagctggatgtgtagctccggaattcaggtattgctttttgttcaggggtgtaggaatgtttagaaaacaaaaatctaaatgcactcgcacatacttcatacaggagttgataattgattagctaagcaaatcatgtggggattctgaagcacagattgaaaaagagcacacaaaaagttcatttggaggttctgaagcacagattaaatctataacatgcggggatgaagcaatcaagaggatgaggatggaagaacccaagttgggcttcaaatttttttttgaatttgttttttgtggataggtgaggccgtgagggccattttaagcccgtttgtttgtttgttgggcatcaaatatgtatgatatttaagcccgtttgttttttgggcttatctaatagacaaaacgaaaaagggcttcatgctttgatctgacaaaacaaactgcagagaaacgctatgctacgtgcagcgcgcgcgatgcaaacacgtgttgaatccgacgtttaggaattcggctgtaatcacaaatattttcagccgtgtgccacatagacagtccattaaatatccttttggtcatgaattaattcgatggacgttctcactcgtcgccgcaagtccagtggcccactggatgcttccatctcctccttgataatatggctctcttcgtccacaagcgaagaccgtcggtggatcaggcaccacatgcttggataggcaaaccatggccaatccttccacatccttgcatccacgaagcattgccttccaaccatccaatagtgacctcacccttggttatataatgacgaatctgtgcagagagagcctcagtactcaagccggaggcagcacactgcaacttaagtttttctatagctcctagcaagctagcaa

SEQ ID NO: 19100 - DNA, 1501 bp, Oryza sativa
ctccggtcaagggtacgtatgaatctccttccacatctctgaaaaattttgagcaatttgagttcgggaatggggattgtgatggggatcagtttgggcgccagtataaccatagggttcctaaattagatttccctaagtttgatggttcagatcctgtggattggagaatgagatgtgagcattattttgatgtgaataacactttcccagggctttgggttagaatagcaaccatttacttctcaggaagagcagtatcttggttgcgttcctctaaggctcatgttaggtttccaatttgggagaatttttgtgtagcagtgtctgctaagtttgatagagacaagcatgaaacacttattagacaaatggacagcattaaacaattgggctcggtttgggagtattatgaaaagtttgatgagttgatgaatcaacttttagcttatgacccagatttgaatatgagatatctaactcatcgttttactgagggattgcttcgggagattatgaatgcagtacttattcaacagcccaaagatttggagacaacattggcaattgcttctttgcaagaggaagtaattatggaatctgctacggtgtcagcttcaaatctaaaaaagagtgactctgggttgcagttccgaccaaatcctgcttacaagagtgctttgaccttgcccttgccgcctaatcgtgggttatctggtggcagtatgatgcgaacagaagagcgcaaagctgctaataattctaagattggaaacagttctgacaaaatttctgttctgaagcttaacgcagagctcaaggattgtgttatatctgtgcagagaaatggtctcccactcataagtgtgctaatacagtgcaattgcatgcagttcaggaattaatttcgacattgcagcttgattcaatgtcagatcaagtttctgttgatggcactgaagctgtagacagtcaagggttaatggcaatatcagttcaggctttgcatggttctgaatctgtgggatgtatgcgcatgttgggatatatacaaggaaaggaggtattgattctggcattacagctagttttatcagtgctcatgtggctcaggcaattgatggtgtatttcctttaactgctaaaactatggtgaaagtggccaatggttcaatcctctcttgtttggcttatgtgcctaattgtgaatggataactcagggatgggtcttctgcactaattttaaggtcctcaatttgggaagctatgacatgatattaggaatggattggttaatgcatcatagtcctatgcaagtggattgggtaaagaaaactttgacaatttcttggaaaaatcaatctgtgacattacaaggaattgtgtcagaaattgagcaatgtgcacggctttcttctcagcagtttcagaagttgaaggacagacaagcaatctctcacctcattcagttatgtgctgtctctgaaacttcagaacagg

SEQ ID NO: 19101 - DNA, 1501 bp, Oryza sativa
gctatgagcccacgagtaaaatgagtgtctattgctatggcagcatgttctctcgacttaagtgctatacttcttgatataaataactcataaaataaagtcataaccttgcaaaaagtaacagtttgacatcttcacaaacaagggattaagagagtcgaatccacgagagtggagcataacaaccctagtatataggagatatcaattgcattactcaatactcatgcctctgattttactaaaaatatatttttttaagaaaaaaaacacattagaggatgtgaggttccatattaatagagcagaaaaggttacaagattacaactctaaaaacctataatcacggaaaaaaaacacaccaacagtcctgatgattcctacccaccaacttgaggaaaaaaactaacaccgagctgggacctcgcatcaaatagtgtaaaatgtatgtgatttttttacatgccttttgacttttcttttctaaaagggtacatcaaatataattataccaatataataggagaagctttgctacataaaattaacttggtgcactcccatagcattatcagagcaatgtgaaaaatgaacacgctataactcaacatcgatcaatttaatctaaaaattatcgagttacctgaaaaaatcaaaagaaattgttcttcctttgcgtacaagttacgaagcgagcttcgtttgataatttctttttaggttaaacagagtaaatttcataatacgacatatatcactactacaaaaatcgtttttctatacgagggggtcggtaggttccatgcgggccgcttgtggcggcgcctgcaaaaaccgcccccccccggggtgggtcgatgagccgcatgcgaagatccattatcgcatgcggctgcttaacacagccacatgcgataataggtttattttcgcatgcggctggcttaagggaccgcatgcgatgatcggccatatatgctcctccaggcccgagcttgaccatttgaaaacgaagctctctctctctcctaaagcaagcaccaattagggggggaggttttcaactcgaaatttttgcttgaactctatacgaaaggtgaagaactctctctcctccttcatttggctccatttttgttatatttcgttggtggaaagtggagttttttttaatattttgacaaggtttgttctaactagtttttgcaaaatctagcttcaaaatatatgttttgatgggtaaattttgcatgtaatcacttgtacatactagttcatgtattgttgtaatttttttgggagacaaatgcatttaaacttttgtatgaaatacctgcggtctatttttttatctgtaacttttttgcctttatataattagatggatcggtcgtcatggatgtatgagatgcggagaacgtagcctttattaaggaagcacctaaatttattgatcaggctaaggcgcatgctttgagggagaatatgacaaagatcttt

SEQ ID NO: 19102 - DNA, 1501 bp, Oryza sativa
acatgttcaaaaaggagcatcatttaacgttgttcggcattgttatcttgttatagacattcagcattgtactatcgtgttatagacattcaatatttgtcaaaatggacggaagaaataagtggagctcgaaacagttttgggaatttatgaggaacgccatgctttgtgtacacaataagatacaacagcggagtaatgatgtgtatacgaatacgacttgattactatatcgattggttagacgacgatgatgttagcatccattttcattactgggagaggatgatgtgtatacgaatacgacaacataggtagccgattaggtattgaaacctaaccgcctaaatacttgatcaaacaaaaaagttgtatctgcatcgcacggtatggcttgaatggaacatcacaagttatgaacttacaaaatttgactactctcgaatcaaaaccgcaacaaatgtatgaaaatcagaaagatccgcattaaagaggaaatcattatgatatttaatactagctgagtaatccctacacgacacacaatccctacactctacctggctaaccaacaaattccagtaccaaagtaatcaagccaagccagctagtattgcacctcggtgtagcgtgagccgtggccagtccctcagcaacaaatggaagccaccttggatgtttgcttataatggccactaatttactggacagctgttatacttcaatacctccccgcactttctgtttaagcttagcttgataatttgtactcacaccgagtaccagcaaagaaaaacgtaactcactggcgcgcccggagttaaaacacgaagatcactcgcaacagccggtcgagatgaggcctcatccccacaaagtattttctacacctagatgctatgcatgtaatttaaatagatatataaaaattttataaaatttaataaaatagtacatgataatataagacactatgcaaacatgcaagtctaaattcaatcgatatatgaagaaacaaaaataacaaattttgtctgtacggtacgggtactattcactgtctgattttattatttttgtttctctagttgtagatccaatttagtcctatatgtttgtgtatagacttatatcatcacaaacaatgttactaaatttttttaattttttttataactatttgagtcgtatgcaaatgataggtgccatagcacctaggtgtgaaaaaaattttccgcctcatcccaattcccaccaatacagggaacggcgagggcttgatcccataaaacaacacgataaaaaaggcgaaaaatctcccccctaaaacgcgacctgtgcggccctgggcggagaataacccggcggcggcctacggcgatataaaccgtatattgagggagcaagccgtggtacagagcagaggaggggggagagagagagagagagagagagagagagagtcgtgtgtgcgtgtgtccccggggttctagctttggga

SEQ ID NO: 19103 - DNA, 1501 bp, Oryza sativa
tttgtgctcagccccctccacatatactttcgcacataacttgctatgaccagtgtgcatttcaacccaaatccctcaaaatatccctaaatcggctagggtttcgacggtgaggttaggggaaggaggccgagaggtagcagctgtggtggcctcggcggtgcgattagtggcaggaggcagcgcagtgcagtggggttagcggtagcacaaggcggccgtattagcggcggaaggcagtgcaatacggcttgcgcgctaggcatcccatggattctccaagctcgtcctcgtcttgaagtcgctggaagaaagtgttgttaatcatgtgcccgttgcgcaaggataaggttattttggagtgcagagcaatggcaattgctaatcagaaccgcattttctatacatgcaaggagaagaatgagatggaagaacgatgtgagaatttttttgggattctggtgtcactatataactataagaagatatatgcgacgtgttgtgatgtggagggggctgagagcaaaagtgttgcctaggtggcatgccacgttagcgatcaaacgcagtcaaaggacgtttggaccgggtggtacattaaaccaaattcacagacctaaacgtgtaattttcaagttcacggacctaagtgataccactacacaactttagggaccagtcatgtatttcactcttttcttatgtacgaccaattcatttacttttttttcatatgatgcaacacacgatactaaacacacacgcctgctccgctaaagcacatcgtcgccaagttaaacagaaaacgtgacgaaaatgaaaacaaaaatttttatcaaggtattatttgtaaagttctttttcctttcacgatgaagcattacatagcattgcctcctccccctcgtgtgagacttgatttgtcggcgtctttcaacggcgctcaacctatttagtttatttttcaagtaaagcaatacctttaaaacatagtaccgtgtacgttttcttgctctccgtaaatcggtccaaacaatatattgtcgacgagttaaaccgaaagacacaaccgacatagacggaagcggtaaagcactttcataactaaacggcacattgtattacaaaatcagagaacaaccttgagttggaaagagggatgaagttgaaaatgtttaccaaaccaaaaccacataccaaagccaaaaaccatagaaaccagagaaaaagtcctaaaaaagctacacaaagggggtaaaaaggggaccaaaacagggcaaaaaattcccaaaataaaaagggcaagaacagcgagagacccaggaaggaacgaagcaaggcgcttaggcgcacgcacgcacgcacatctctcgagcccctcaccctccccttcttcctcctccttccgccgcattgctcgtcgccggcggcgaccaaccctacccctctctctccctctcgagcggcggcggaggcggtttccggtagtggcggcggcggc

SEQ ID NO: 19104 - DNA, 1501 bp, Oryza sativa
ttgaatctcttcaaaacatttgatcaagtgagctaaaatatttaacttggtgataaaacaattttctgtatgtgctgaagctgtcccaacgcctatctttgttcagtgttctttgtttccttcctatgcaacagcttaccatttagccaagaaccacctagcaattcaattcaattccattagtcaacaatcacatagcaatcactagttttaatttgatattcacctaagtgacttcgttaatctcaaaatatactggcacactcgttagatacacttatagggaatgcatgtatgcacatgtctatgagcgtatatgtcgatactgtgtttcgaagaaaaaaaatcatccaacaacatttgtacctctaaataaactttagtctcactttgatggatcacataggaatattttggcaatctattatataattaaaggaattgaaaaaggagcctccacgttcgctctcatggcctagaaattctcacattaatcggagaaaaagaaaaaaccagagtccatatagaaatacaatttagaaatagctgaaattcgaaattaaaaaataaggaatattagaagaggagactagagtccatatagaaatacactttagaaatagttgaaattcggaattaaaaaataaggaatattagaagaggagtatagagtccatatagaaatacaattaggaaataactgaaattcggaattaaaaaataaggaatattagaagtagagtatagagtccatatagaaatacaattaagaaaaaaatagaaatttggaattaaaaaataaggaatattagaagtagagtatagagttcatattggaatttaaaaccaactaaaattcagaataaaaaggagcctccacgttcgctctcatggcctagaaattctcacattaatcagagaaaaagaaaattcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttattaatataatgagaaaacatatatgctattatatgagagaaaatataatgatgctagccgcgcaatctgtgcgggccaccatgctagctagtttccctaaaagaatattgacttccaatttactatgtttattacaagcctatccactaagaactaacacatcctaaaattagccaaagacgcctcgtttccttcctctccaacaccactggccaacaatcccctagcaattcctagcctcagaacccaccgaacaaatcaaaccccaaaaccaatttgcaatggtcgatcatccaccgtctccatctgtgcacggagggattcattgtccctccggccaatttcccggccggccggaacggcggaacctcgcccatgatcacttgaaacacctcccttgctcttcatggcca

SEQ ID NO: 19105 - DNA, 236 bp, Oryza sativa
agtaaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattggagaaagatggcggcaatataaagcaaaactaaagatttgtattttgatgtgaatgagactaaggaagctaattgcaacaa

SEQ ID NO: 19106 - DNA, 1501 bp, Oryza sativa
ggttttttaccatcgtactaaaaccaaaagtacctttttaaataatataaaatctataaaatgactaatactacctccattttagaatatatgacgccgttgacttttcgcacaaagtttgatcatttgtctcattaaaaattcagtatgaatatgtaaaactataggttaatattatattttatttgatgataaaacaagtggtaacaaaataaattaaatttatatatttttttaaaataagacgaatggtcaaacatcgtgtaaaaagtcaatgacatcctgcattttgaaatggagggagtatatggttagcccaaaagtacaattttggaatatataatattgactaatacatagtccaaatagaaattacatcagtatttctttttgaaaacagaaattacatcagtatattgtcactatggctgcgtttagatccaggggtgtaaagttttggcgtgtcacatcggatatgctgacacacatttgaagtattaaacgtagactaataacaaaacaaattacataatccgcctgtaaactgtgagacaaatttattaagcctaattaatctgtcattagcaaatgtttactgtagcaccacattgtcagatcatgtagcgattaggcttaaagattcgtctcgcaatttacacgcaatatgtgtaattagttattttttcgtttatattcaatacttcatgcatgtgtccaaacattcgatgtgacaaggtaaaaatttttgccaggggatctaaacagggcctatgtaatcttgatgtagtgtagttaatcacaacgtgcttatgagcgcgtaaacttgaaacttaaaattctatctactatatagacataaggaggaagagatggaaatatttttattaaggttacattgaaattggtattgatctattcccatataatgtcaaacatcaatgatataacctacctagtattgataacataacaagggtgttctacattgacatggatgcaatcaagtctcccttgctactttgtacaatctgattttatattccccaggcatgcacatagaacaaaagtacagtacgatagaagatttaaaaaggatgtgcatcaatcatcttgggtaagtatgatgtagtagtaatggattcatgatctattttaatgccctgttgatattatttttcaggcagaataatacatacaggtagactttcttcaaattaagttgacaatacctcaccgtagatgttgatttgttaaaaaaaatcgttttcttttatagaatattcagatcaaacttgataaataaagagacaggaaacactagaatattcagatcaaacttcagtgattgaagtggcaataacaaattcaactttccatcgacaggttcttgtgcttgtgctgatttgtcacatcatcaaaacatcaactcacacaccatctgtttcacaaaactcatcattcacaccaaacacatataagattaaagcaatcaccttccttc

SEQ ID NO: 19107 - DNA, 1501 bp, Oryza sativa
gtctagtctcatcacttggcatcatgttggtaccagtaatatgtatgctgtagcaagatcactgtcttaattgtgcaggaagcgagaattcaatcaattcgttgcaatcaatagatatggtgtagtatcaatttatcactgttgaggtcctatgttaattttggtaacgttgtttcacggcacatgcatccatagactcaaatctcatagtgtttctgggacgaaagtaaattagtgcatctcgggtgctctgtgctttgatgcttgtaggtaacatgaattggcacatgcatgtgacgtctaatttcatgggtgctttggtgctccttggtagcatgaatcgataaatgccctcttctcactttgactatgtttttccctgttacttcactgacacatgttttcaaccattgctttgctgcttatttatattcattttgcatgcctttgcaggttccaacaccgtgcactgccagggctctagcattctcattaaggatatggagtacaccctctacaccacaagttcctctgtattgcacatttcgctgctcgaggaagttcttggctggaggttttctctttacggagacttcctcgttatctcttttgtcaactgcacctgaagatcacacctcattcagcagccgtcttgcctggtcccatgctattgcacattagagtcgactattgattacagtgcagctgtagcacatttcttcgagcatggtgcatctcatcctcttgcatccttccggtagtttttgttgtggcactgatcagccagcaaaagttaccatcggaacttctttggacaatcggatctgacattagatcttcattgtcaggcttaatctctaggtatgcttttatttgagaagctaattgcctgatatttaaatggcatgtgttcctgttctcatgaatttcttgctctcagcaggtcctggttttcttactttccgtttgctctcttctcccctacactgcttgctttttgtttgatcatcccaagatttggtgcatactacgcagttctttgtcaggctttgtgtttgatggcgtaacaaaccggtatgcttgaaatttctacatgacatgcattgttcatgattcggttacatgtaattattatgttactcagcctatttgtattttttatttcttccaaatcttctgatctatttgttgctctttcagagtgaaggtgttcaagtttttttgtcagagtatgggtattgcttatagagtttttccagaagcgttgagtggctttgctgatctacccttcaaaggcatttcagcaatacacatatgagtcttgttcacaacagggctcttctagaataagaccagctttactctccagctagtaaaaatggagaggtaaataacaccccttctctctcagatgttgtgtgtgtgtgtatgtgtgtgtaagggctctctcagatgttcaagagcttgtacctgctgagtgctaacttctttcctgcatcat

SEQ ID NO: 19108 - DNA, 1501 bp, Oryza sativa
tgaaaattcagtattttaaattgtggtgcctaatgtgttctcaaaattgtgttgcctagtcagtaaaataattagggattttcagctcggtgatgagttaataagaaaattatatgaaaatatgagaattgtcagtgtcagcagaaatgtccaaaacaaagcttttgccgtcggcatatcttcgattaatcaagacaggagtagttttacctgacaagcagaagaaatggtctggtgagaagtttatgtcaagcttcaagcagggccattccaaaactgcacttttgagccttgcgtgtatgattcaaatatgccaatgaaatgccatgtagatcaatgaattcctgaagtaacatcaaatatgtcatcgatggtgtcacctccttacatcaatgggcttattttatcgctaacacaagcagattggaactttggaagagtttatggaaatgttagatatcttggaacaaattctaagagtttttctgattgcagctgtgaaagatctctcacatatctgctgcaattttcataatttacaaaagatgatagtgcagaatttttcaatccaggttaattaagtggaaggactagtaacttcaagtaatgtacagttattccgttcatacctgcctggtaaacatagaccttctttgcgcattttatttactcatttccatgcgaaattgcaaatgtggtcaaattcttcagaggccaatttttcaactcataagacaaaacaagaattgtggaatctttgcctccacagaagggaagatacctccactctgtttattataagccaactagtataatattcaattagtatcatgtcttgtgtgcttgaactcttctgctagttccatttcttaggttagtgagtgctttaggtggtattctactttatattatcttatttgtttcactatatcttcttgaaatcatatgattgcctcttgtgaccctacttagttaagtactaaagacagtttttaggaactttatagtcaataatctggttaagtattttgtcaggggggctgaaggtgagttgagagggttcatggaaatggagggcaggggtctgtctgagctgttcaggaacacaagtgaagatatgttcctaaaggcgatgatggagaactcgatgggagtggcggcggcggcaccaagcatggagatgatggggttcagaaatctgtcccaaggtttcagagaagacagcgaggagttgttcaatagctggcttatgaatggagaggcaagttttctgaaaatccataagattttgtctcagtacatgaaagttcatgtttcagaaaaaacaaatcccaactcatctgttgttttatgaagtgcacaactttttgtatacatacatatatttagagatagtgcataagcttacatagatatgaacattgatgtactgattactttcatggttaatgttacctgaaattcttgattgcttgtgcacagattccaggatttagtgcca

SEQ ID NO: 19109 - DNA, 1501 bp, Oryza sativa
gttcttttttttttttgactaattacattgttgagttcatggaccagagcaaccataagagaaccgtacgatctcacttgcaacttcttcctttggtttgtcaatcagaagttcagaagtcaaacatggacagtacaggatgacatctcgtatgaggtttttgtgaacggtaagggccgaaaatcattgtgatatagggatgacaaacaaactgaggctatagttgagggaggaacagtgaactttctaaggccttcttcattctctggcttgcttgaatagtttactcgattttattccgcttttgtacttgtcattttgtcaatgtgatgaccaggttattagtagagattttttttaatacgcaagcagcgcattttttattaataggaataaagtttatgtacaacggacccaaaaactaaaaaataaaagaagaggacgggttacaggacacagaatggagcaaaaggcctaatctctgactagattttgtgaccgtggaaccaagctaggaagaggcaattctggcaccgccgcatttgctaagcgccatttgatgtgacggaaaattgcgagacgaatcttttgagcctaattacaccataatttgacaatatggtgctacagtaaacatttgctaatgacggattaattaagcttaatagattcatctcgcggtttacatgcggaatctgtaatttgtttgttactagtctatgtttaagacttcaaatgtgtgtccgtatacttaaaaaaaaattggaaaggaactaaacacggccttactcccaaaagttctttttattcaggaatacacgcaagacttgcaaatcgaggattttgtacatcagcgcaaatgacataaaaggaaaataagtagagagataaagaatataagggtagaacaacacggctagaataagtagagaaatagagaacagtgtgttaatctctggcatcaggtgcaacaggtaaacttttggaaaccagattgtaaatgcagagcaatgctctgttctgctgcttttggctttggtttcaaagctgggtaatgaaagttgactgttttctaaaaaaatgtagcgcaacgcatcaggacattattattgagttcctggacaagagcaaccagaaaataacacacagctcatggaaatctatgacaaaactgtaggtcctcattaccaagtaccaagcaaccaccatggcaattcatgagagcctgtcgaaacaaacattactgacaccagtgatgtatttcttcggaactacaattttctttggtttgtcaatcagaagttcaggattcaaacatggacagcacaggaatacaagatgtcaggctcatttgctccaagtgactaattcttgtctatctctatgatactcaaacctaattactcctatcaaaatttagctcgcacatgactctgggtttgtgacttgtatttgctgcagtgtcacgaactacagatctattcatcgacagcgacagaaa

SEQ ID NO: 19110 - DNA, 1204 bp, Oryza sativa
ctggcacctattgctcctgctacacaggacagcctcgttgactaataatattattatctacctgtggggccgaggtgtcagtgggcagcgcttgtgacttgggtttaagatatgggtggttacttgtttgccatggcgtggtaatgaaaaataccaggtttatttaataagttactaaaaaattaaataaaaatttaaacttaggatgaaatttgtctgattttttttttcggttttgcatagtaaccgtcgtaaccagactagcaagggtaacccctcttccaacgataacttggtaaagaaatgcacttgcaggtgactgaacatttttttttctttgtttctgttgtgtagatcttagaacagataatgtcggaacatttcttccggaatctgaacttgttttgctgaaatgatgtaaaatccctgccttgaaacagttactaccctggaaacaaaagagagaagaaaccgttaccagtcgtgcaatcaaacggtttctttctctacttttattgttcactgttcatgcaatgagacaatttctttctttgctttcatagtttactggtttttcctccttttgctttcattatttacttttcaagcaatcatacagtttgtttgcacacacttgttactatcaaactacactaaaatgacagttgtccaactaaatacactactgcaactttactatacttcagtagtcccagagtcctagagtcctataactctagggtctttgactatgtgctttcttcggtcgcagtagtcctagagtccatcctttcagagggccggctgtggtcgttagcggccgtcgcttcctttggggaattgttgggagcgtagagtggctctgccccctccagttgtttggagcagagttcctttcctttcgttattttttatctttgtttttcttccttccttggcataggccggtctatttgagtgcgtcgtgtttcaaaaaactctattcttctaatatattgacgtgcaatccttttacgcgttcgaaaaaaaaactatacttcagtagtacatagtagatgtgtttgagtagagacaagagaagggcagtggaggttcattgcatcatcctgattattccagcaaaagaggagatggatggatagagagaaacaccatcatcttttgccatcctcatcctctccctgactcttttcttttctcaaga

SEQ ID NO: 19111 - DNA, 1501 bp, Oryza sativa
tctatccaatcagtttttctcatgttctgttttgaaccattttcagcagaaaggaggtaattcatcatcgcacgaggcaatgagcaacgaatggctggaaaatgggcagtgcccacttgcccggtcttaccgagcaatgagtggcattctgccccttgttgccaaggctttacaaccaccagccggtgtgaagctgaagtgcccacctgctgtggtcgctgtgcgtgcagcccttgcacggactgaacttgtgaagtctctccgtccccagcctctgcctgcaaagatggtagccattgcgttgctcggaatggcagcaaacatccctcttggggtgtggcgtgagcacaccaagaaattctcccctcagtggtttgcagctgtccatgccgctgttccattcattggaatgctgaggaaatctgtcaacatgcccaagactgccatggcattcaccatagcagcctccattgttggtcagacaatcgggtcgagggcggagcgcattcgtctgaaggcactggctgcaaagagcgacgctgattccaccaccgtggctgacatgtatccaaacaagactggaaattgcagtgacaccgagggcaaggcatgggatccgctcgcgatgaagatgatggcgggacgggcttctggtggtgctgctgctccaacaccaagcatgtgtttctgattgctcactgattggaaaatttgtatctaccagtatccctggagagtggagagttgatattgagtctattttatcttgtgatgtaattgcctttgcttgtccctcagaagtattcgtttgtttgtggggtgagacaagtggaataagagtgctactatatacacgatcattctgttgttaagtttgccagttctgcagttcatgtatctgtaatttgatgatgctggatttctactatttatcaatcgtcattatactgtgtgtaacctgttggatgaacgcttgttagctgttctggtgagtgacatgtagccctctttgaatctttttattgagaggataatcactgtatctacttgattgtacaaataaattaaatattttaagaaataaactcaacaaatatcttaaaacaaatggtttaagtaatgcagtaaaagtcctttttaaggaaacatattttttaattgtagagcaaataatttgataaataaactaaaattttaataatctaagagtaataaataagctgaaatttcaataatccgataaatacgctggaaaaacatggcttggacattggctgggtcctaccggcagtgagagagagcagcctgccaagtggggcccagatgtaagagaggtgtgaaagcgagattaaccgggaggaacagcgggctcccgccatttccattcgcgcgtagcgacgcctttcccgcgcagaagaattcccttttcccgcgagaatcctttttaccgccatttttcttggcgccaagcccggctttcccgcggcgcgctcttctcctt

SEQ ID NO: 19112 - DNA, 1501 bp, Oryza sativa
tattttcatataattttcttattaactcatcaccgagctgaaaatccctaattattttactgactaggcaacacaattttgagaacacattaggcaccacaatttaaaatactgaattttcatcttcttctctaagactctaagcagcacatgatcacactgatgctgaccttaaactttcctactcttttttccatctagagaagaacaagactctggcgattgaggttctgagttctgactaagacatcaatcaatcaagatctctcttgaccatctagatacatttatatatccctgatagctgattagttggcacatcagcatcagctaacgatcacaagacggttacagtaagtgctccagcaagctgtagctttgcatcctgcccaaaacggctcccatactatagctgttgtccattgcaccatggatggattctctggtgccggcttcacgacgcgcatcgccgatgacgacccgccattgttttctctctttctttttcaaatgttgttcttgccattttcctgtttgaagttttccaagcaggcgatgcaagaaccgagctgtgcctgcctgcacaatcgcaaacatatattttcttaaaacataaacaaagatcacacagggatagtaaaatatgatgaaacaatattcagcatcaacttgattctttaaaatttgggtttgctaaaagtcttcagaattcagggcttatacaaatatacaatatctgcagtcgcttactgtcttggcctatcacagagccgcttccatttccatcgaaatttcgcttcaaagatcagaaagcgagtacaatctaatacgcctccgctgtcacaagcgtattactatctattacgcctttatgcggggaatgcggaagatgggccttatatccggcccacgtagaggatacctttgcttcgatatgggctggcccatgagaaggcccaactagagcggcctcggcttctcttctaaaaccccacctcgcctcgcgtcctcttctccaaccctagcgcgccgccacctcgcgtcggcatcctcctccgcctccgccgccgccgcctcgccgcccaaggtagggtgccttcccgtccatctcctcccctctcgcgcagcatttctggatcagtcgaggcttccagttcgatctagaccttcgtccattcggatctcggttcgttgtactgcgcgcgcgctccgtttcttgtttgtttctggatgtagtgagatgttgtggagctaggacgagagatctcactgttctgttcttatggcagcaggcgaagcgaagctcgtgatttgtaatttgtagcagtaatttttggttgattctcatgcgttttagtgggatctagaacagggtgttagccttttctttcagtaatctggtgtggatttttgctgcaactgttagtaagagctgttaggaaggaatcgcatgatgcttatggtttgtgtttgtttgatttggtgtaggtaaggtaagcca

SEQ ID NO: 19113 - DNA, 1501 bp, Oryza sativa
gtactcagcaagccatgggaattaagtgtttaatgcaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccagccaacaactttcaaacggccacccgggccaacaactttcaaacggccacccgggcctagctgatcccgtcagctactgatttttcaaacatcgaacccctttccacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccagaaagcctaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccgatacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggaggatcaatgcaacaaattaggtatgtccgccaaactgccttgcagacgggacaacagattaagtgcgatcctatcagtgcataatatttttcaagcaacataattaaattttaaatataggatcaagatgttcaaaggtggcttgccttgctcgagatctggagcttgatcctcgaaatcctcgcactacgggtcttcgggctccgaaactacacgcgaaacggggcaactcaataaacggcgaaaataaagccctattaatgacctctaagcgtgccattagatagatctcgagatttgaggaattttggaagttgaacggagtcaaacggatttacggttgggaagatattgaatttctaagtttattggatttttggtctaaaggaaaaggatttaattaaatcctttttggaaaagaaaagaaaagaaaagaaaagagggagggaaaatagacttttctcgggcggctagggcgtggcccaagagaat

SEQ ID NO: 19114 - DNA, 675 bp, Oryza sativa
tccggcccatcaaagcttttccatccgctcgcggatattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaa

SEQ ID NO: 19115 - DNA, 1349 bp, Oryza sativa
atatatatatatatatatatatatatatatatatatatatatatatatatatatatatatatatatatatatatatatatatatatatgtatatatatatatgtgtggactctagactcgtcttttaatatttcttttcttttaatttcgaattttctgtaaattgtatttctatatagactttatgctcttcttccaatattatttatttttatttctaaatttttattatttctaattgtatttctatgtggactctaaactcatctttcaatattctttaattattaatttcgaatttctgttacttctaaattgtattcctatattgactttaaacttttcttcccatgtttttttaaaattttaaattttagttatttgtaaattgtattctatatggactctaaactctacttttaattttattatatttattttaaattttagttagttttaaattcctatatggactctatactctacttctaatattccttattttttaattccgaatttctattattttcttaattgtatttttatatgaactctatactctacttctaatattccttatttttaattccgaatttcagttatttcctaattgtatttctatatggactctgccttttctttttcttcgattaatgtgaaaatttctaaaccatgagagtgaacgtggaggctcatttttctatttctttaataatataaagatttttaaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagc

SEQ ID NO: 19116 - DNA, 1501 bp, Oryza sativa
caagtgcagcacttcgcgcaaatcccaaggtccttggagcaagctgcattgagcatatgcaacagagaaatcagtaacaacatcaacaccatcatagcaaaagacgacatggtggagtagccgaaattcacccgtgcagacgttgtgatacgcctgtcggacgttccgtttcccacacttctgactgcaaaaaccaaacgagaactatcagcatccatcactgcccactcctccatagttccatcaatcgagtgagtgcgataattacgaaaaagggcaagagaaggtaccattttgccggctcaacgataggcttgtacttcccgtatctgccaagaagagacaaacagatcggaccgagaggccaagaagctaaaattacgagctaagattaacgacgactacagaaggggactcccgaccttctcttccagtcgatttggtccttgcagcgctggcagacgccggtgatctccgacaaaggacggaacctgccgccgggctcctgcagcggcgaggattccagccgtgagactcaggccttgaaaaaaagaggataaagaaggagagggaggcggctcgaggactcacggtctcgttgatcttctgcccgaggttgggcttccacgcgtagcggttctgatgcttcgggggaccctgccgcttcgacatcgctctcctccccccgcgagactcgcgcgccgccgggaaggtttccgtcgtcctcctcgagctgagcccccctccgccgcggcgccgcctacccttaaaaccttctcgctgcgtcggctacgcaatcgcgacagcagcagccgttcgatcgagaaatcaacggcctacgtgcggggaaagcggtcgtggacgtttgatgggccgcggcccaagcagtaggcccagcgattcccccttccgtgtccttcccgaagccggaagttgagaaattggagctgatcaaccggagagcgcaaagccaccggccgcgccgccgcgaaagcccgaggcggaggagacggcggcggagcgaagagtaggcggcggggagctaggcgggaatggcgacggggaggaggttcctgcagttccagtcgctcctcgcgcagcaagccctacgcctccgcgccgccccgagacctaaaccccaaccaaaccccccccaccgattcctccacgccccatccagtcccgcggccgcctcgccctcccgcctccccctatggcgcagcactggctcgctcctgccggtgagcgcggcggcggccgcggcggcggcggcagccgcccgggccgccgcggcgcggtggctgatggccgcgcgcgaggcgggctcgctcgagctcttctcgctgcagcggcgcaggtcctcggggtggttcccctcctcgtccatgttccttagcggcgtgtcctggtgaggtttcggttcgtatggtttgaaatgggggattttcgtggtggtttagtgatttttttttgggttggttttgatgttcaatgaaggacg

SEQ ID NO: 19117 - DNA, 1501 bp, Oryza sativa
cagagattaacacactgttctctatttctctacttattctagccgtgttgttctacccttatattctttatctctctacttattttccttttatgtcatttgcgctgatgtacaaaatcctcgatttgcaagtcttgcgtgtattcctgaataaaaagaacttttgggagtaaggccgtgtttagttcctttccaatttttttttaagtatacggacacacatttgaagtcttaaacatagactagtaacaaacaaattacagattccgcatgtaaaccgcgagatgaatctattaagcttaattaatccgtcattagcaaatgtttactgtagcaccatattgtcaaattatggtgtaattaggctcaaaagattcgtctcgcaattttccgtcacatcaaatggcgcttagcaaatgcggcggtgccagaattgcctcttcctagcttggttccacggtcacaaaatctagtcagagattaggccttttgctccattctgtgtcctgtaacccgtcctcttcttttattttttagtttttgggtccgttgtacataaactttattcctattaataaaaaatgcgctgcttgcgtattaaaaaaaatctctactaataacctggtcatcacattgacaaaatgacaagtacaaaagcggaataaaatcgagtaaactattcaagcaagccagagaatgaagaaggccttagaaagttcactgttcctccctcaactatagcctcagtttgtttgtcatccctatatcacaatgattttcggcccttaccgttcacaaaaacctcatacgagatgtcatcctgtactgtccatgtttgacttctgaacttctgattgacaaaccaaaggaagaagttgcaagtgagatcgtacggttctcttatggttgctctggtccatgaactcaacaatgtaattagtcaaaaaaaaaaaagaactcaacaatgtccatatccattgctctgcatttgcaattggtttccaaaaaaatacttatttcatttaattgtttaggattcctacaggcactactatagtactacggagtaggagatagacaaaccaatcaaattaattagttttttctcaacagtttgctttaacctattagtagtaggcaacacataaagccttttttattccttcagtatcagggcaggactgtatagcacaatcttggaatatccaaatatctttctctctctctccaagcaaaatcgttgacgtgataaaatctaaaaacattaaataaaacaaccacaaaaaaaaatattttttccttctcatcgaaattatcgccacacacgagaggctttttgtctgtgccatccacgagtcgcacactcgtaagccacgtcgccaccgccgatcaggagtcaacaccccaccaacggccctgatcaggacacgtgtcctgaaaggctaaaaccaacctgcaaaatacccccttcctatataaactcataaaaaacgcttggaca

SEQ ID NO: 19118 - DNA, 1501 bp, Oryza sativa
tctataaatctgtttaatcaccgattgtttttttccttttatttttgttttttatgtagaatgagaaaagaagataaaacctttgatggattgtaaataacattgatagaataaataataagaattaaccatgtataagatgtaatagttactttctaacatgtaataaattacttttaaattaaataaaatgagaatatattcaatatgaatatcgttttgtcacatattttgagtggagtacaatgatgcaaatatatcttaaaaacaatatgtgatttaaaagacataagttattaaaaagattaaaaaagatacatactattggagtacaaaccagcagtcacgtccaatgaaaaaaggtatgcattaaagttacttttctttttgttataagttacttctataatatatgtaaattacttttaagctttatttaatttacttttacatgtcgaagaagtaatttagtgaaatctaaaagtaatttagatatattataaaagtaatttataatttttcatcaaaatataatcatgtgagatcttgttataaagatttagttgttacgaacacaacggtgtaatcagatcgtagatcggatgagtagtttaagagaaaattttatttgaagtataggtggatagagtctctcatagatggagtggtagctggtttagacaaaccagctatcactagctgtgtagtcacgtccttaaaaaaaagtactccctccgatttatattgtaagtcgtttgacttttattctagtcaaacatctttaaattgactaaatttatagaaaaatacactgatactttcaatataaaacaaatatattatcaaaatatatttaatgttgaatttaataaacttatttagtgttttaaatattgccattgtttctataaacttagtcaaatctaaaaaacattgactaagaaaaaagtcaaacgaaacagaagcaatatatttttgttttctcattttactaaaccatcgttgaagggttcgaggtgtatggtagaacagtttattcttcccttatgcttcactattctctctcaatggggcggagacaggagtaggacggctagggctgcagctctattactgagtctaaatatccattagaattgtactttaaaactttaaaaagtagaatattaaaggaaaagctatgtaaattatattagctgagctctagatttagaagaatcctatttccgctgccgactctcattgatctgcacggtaatatacatgacatggttagaattgaacaaccaaaattgagagcactagctagtactaggagtacacgttttgagtgcgtgttatatcaatgtaaatataacattttagttaaagaaagtgtaaatataacattatgaataattgtttatatatcggatcaaggacgattaattgtaaactggttgagctaggaagaaatgcattaatattgagcaggtttttcaaacaatatatgcattccttg

SEQ ID NO: 19119 - DNA, 1501 bp, Oryza sativa
gcaggaggttgtacggtcgctgtgacttcaactaccgagggttgctttgcaattgcaggcagcccttttccttctgacctctgcaagtaaacaaagcaatgagcaaccaaatcctgtcatgctaactccgcagttatagtcagaaaagcagcgaacttgtatgggccagctgaaatccttacctttagatttggcaatgttttactggtactgtacatggtcaatgctttgggatggagatggaggtaaatctttgcatatgcaggcttgatttcttctctcttgcattcagctcaagcttctctgataaaaaccgacactgatgacagacacatccaacaatctcaatattactagtagtttagtaccaccacttggcggccctctttgatcgccgtactcatatactatatatattatactaaattggagcacgctgatcacgttctgcatcaaccgtaccaattaccaactccttaattggactttaaagcttgctactcagctgctctaagctcacaccgatccagtaatcgagctccagacatccatcaatggccatggagctctctaacctgacgaggtgccatctgccactgctcctgctcttcctgctggcaggatcctcctccatggctttgccagtgcatcctgcaatggacagggtgagatggcaggtcgacaaggtcaaccggcggggccattccatcgggctcgtcatgtcgtacatcgatgaggccactgctcttgaatcctccggctacttcagaccttggcatgtcctccccttcgttgacctctacggtaactctgggccttccatttccaacccacatgcttgaatggataagtcttggcgtctttcattggcatttccaacatccaataactactgctaaaactgctaagtgaaccaaaataccaaaaacagaacaaatgcacatatggatacataatgctactattgaagtcagtggtagtttcagcattttttttcccgaaggacagtagtttcaacatttaaggacatcgaatacaagttttagatatacctgaatttgtcatatgtgatgaagccagcttgctctgcaaatttaaatgatctgcgctcaatcaagacctgaagaattcaacatgtgatggtttagcctgtcaattagcaatttcataatgtggtttggcacatcgtcccatttacttattgttggatgaacacatcaaagaacggggtacagctgtacaggaactgtaaagccgtaaaccaagatttcacatcatgttgatagatgcactataaaatagaaaactttgccataaggagaacacaaaaggaaaaaatacaataatataccacattttcattgtatcaaatattcattttacaggtttaatgaaattttatattccgctgatatattatattcccattcaatttcgattcagaacatctcatgtagtccttaattcttttacatcttataatggactctcaagaataaaa

SEQ ID NO: 19120 - DNA, 305 bp, Oryza sativa
ccccccccccccccccccgaaattttttatttttgttttatttgtttgatatttttttcacgcttagggacacacaagaaccaaccatagaaaaattgaactcaaatgaacgtaatatgtgacatatagaatttttcctctcctctcctctctccgaactagtgcagaggagagagatgtgcaacttttttatttttattttatttttttgatatttttttcacacttaggaactcacaggaaccaaccacgtaaaaaataaactcaaacggacgaaatatgtggcatgtggaattttccaaagc

SEQ ID NO: 19121 - DNA, 1501 bp, Oryza sativa
aatcggagggagtacttttttttaaggacgtgactacacagctagtgatagctggtttgtctaaaccagctaccactccatctatgagagactctatccacctatacttcaaataaaattttctcttaaactactcatccgatctacgatctgattacaccgttgtgttcgtaacaactaaatctttataacaagatctcacatgattatattttgatgaaaaattataaattacttttataatatatctaaattacttttagatttcactaaattacttcttcgacatgtaaaagtaaattaaataaagcttaaaagtaatttacatatattatagaagtaacttataacaaaaagaaaagtaactttaatgcataccttttttcattggacgtgactgctggtttgtactccaatagtatgtatcttttttaatctttttaataacttatgtcttttaaatcacatattgtttttaagatatatttgcatcattgtactccactcaaaatatgtgacaaaacgatattcatattgaatatattctcattttatttaatttaaaagtaatttattacatgttagaaagtaactattacatcttatacatggttaattcttattatttattctatcaatgttatttacaatccatcaaaggttttatcttcttttctcattctacataaaaaacaaaaataaaaggaaaaaaacaatcggtgattaaacagatttatagagttacttctgaaccatgcaaaagttacttccaattaatattgaagttacttttaaaaattgttaaacttacgtgtgttgatctgtgctgactaaatttaatgtctagataaagtcatatttttatccctactatgaatttacttctaatgtcgtgacaaagttacttccgttttgttttaagatacttttataatatatgtaaattacttttagacttcattgaatttacttttattgtctaagaagtaacttagtcaaatctaaaagtaacttatatatatgataaaagtaatttacgtatataataaaagtaatttacaaatataaatattttttcatcgtcatataatcatataagatcttgttgtgaagatttaattataacgaatgcaatggtgtaatcgaattgtagatcggataaataatttgagagaaaactttatgagaaggaagaaaaagacatgcatgtctaagagtaaaaatagcatgtacgtcagcacctgtaacagtacctcttctcacaattggttcgtcgctggttaacactaaatagagaggcttctcggtttagattttgcctttttttaagtatgttttgctcaattcattttacaacaaatcaaatcttttttctaatttttgtccaagtgagaaatagctactactcctataagagatagtaacaaagaaagaaacaaaaagggcgcgcgtagcgagtgccagtggcggttgcatgtagagccgcagaccgcagtcgaga

SEQ ID NO: 19122 - DNA, 1501 bp, Oryza sativa
actaacatgcttatataagcattgctagtttaattttctctagtcagaactaaatttattaatagattagctgaatgttcattcatttgctaaagattaaaaatgagccactcatgtcctaacattatgcagcaaatggaatttttttttattgaacacatcaaagcagtcagtagaagatgtagtagagagaaggctgggtggtagactcaccaaagcattcttttaaaagtacagtagtgtatatattttgacacgatgtaactaatttaatgattcaaagcaactataatactggatttacagataatcatattccattcttttaaggggaataatcagattccagttgctttgaatctttacttctttgaggttggaaacggaatcagatcacagttggagggtaccttccatgtccaagcacttgtataagcaacaaatttggggacactgacatcgccaaatgacattgaatcattagaacttcctgctgtgccataatgaacaatgccagacacagtaaagacgtcgatgagagtctgtacagtcacagccgcatttaactggaagaacaaaggcatagtaacaatgcataagcatagcgcagtttgtattaaaatcctgcatgtaaatagcatctcacagcagtttcttttggcattacttgtgatatatgaaaatggttttctccatgtatcacaaggcagataatgtaaacgcaaataacttatgaatttaataccctgcgttgtcctgtcagtgcatatataacattgacacctctaatactcccgatgtgataccttcgtcctgaaatttgaagagttcagcattttattcttgagagtccattataagatgtaaaagaattaaggactacatgagatgttctgaatcgaaattgaatgggaatataatatatcagcggaatataaaatttcattaaacctgtaaaatgaatatttgatacaatgaaaatgtggtatattattgtattttttccttttgtgttctccttatggcaaagttttctattttatagtgcatctatcaacatgatgtgaaatcttggtttacggctttacagttcctgtacagctgtaccccgttctttgatgtgttcatccaacaataagtaaatgggacgatgtgccaaaccacattatgaaattgctaattgacaggctaaaccatcacatgttgaattcttcaggtcttgattgagcgcagatcatttaaatttgcagagcaagctggcttcatcacatatgacaaattcaggtatatctaaaacttgtattcgatgtccttaaatgttgaaactactgtccttcgggaaaaaaaatgctgaaactaccactgacttcaatagtagcattatgtatccatatgtgcatttgttctgtttttggtattttggttcacttagcagttttagcagtagttattggatgttggaaatgccaatgaaagacgccaagacttatccattcaagca

SEQ ID NO: 19123 - DNA, 364 bp, Oryza sativa
agttgaacgatctagatatttacgtatacatgttcctacacatgtagaagaacaaataaataaggaaaataatattgttaaatcctaactaaaatatttttacattatacatgacatcgacttataattgttgaaacattacaaaacatttgttgaaatatcccaagaataccatgtgcaacatttcaaatgaataagtgaaacataagaaaatagttattaaaccatccaaacaacaccatgtgcaacattaaaattaaataaatatcgcaacaaagaaaacttaaaatctgcaacaaactcgaatttcatgtgaaacatttgcttccctcgcatgaaacatcaaatttcactagttggaaca

SEQ ID NO: 19124 - DNA, 1501 bp, Oryza sativa
gtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccatagggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcga

SEQ ID NO: 19125 - DNA, 1501 bp, Oryza sativa
cgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataacc

SEQ ID NO: 19126 - DNA, 1501 bp, Oryza sativa
acaagtgcagcacttcgcgcaaatcccaaggtccttggagcaagctgcattgagcatatgcaacagagaaatcagtaacaacatcaacaccatcatagcaaaagacgacatggtggagtagccgaaattcacccgtgcagacgttgtgatacgcctgtcggacgttccgtttcccacacttctgactgcaaaaaccaaacgagaactatcagcatccatcactgcccactcctccatagttccatcaatcgagtgagtgcgataattacgaaaaagggcaagagaaggtaccattttgccggctcaacgataggcttgtacttcccgtatctgccaagaagagacaaacagatcggaccgagaggccaagaagctaaaattacgagctaagattaacgacgactacagaaggggactcccgaccttctcttccagtcgatttggtccttgcagcgctggcagacgccggtgatctccgacaaaggacggaacctgccgccgggctcctgcagcggcgaggattccagccgtgagactcaggccttgaaaaaaagaggataaagaaggagagggaggcggctcgaggactcacggtctcgttgatcttctgcccgaggttgggcttccacgcgtagcggttctgatgcttcggggaccctgccgcttcgacatcgctctcctccccccgcgagactcgcgcgccgccgggaaggtttccgtcgtcctcctcgagctgagcccccctccgccgcggcgccgcctacccttaaaaccttctcgctgcgtcggctacgcaatcgcgacagcagcagccgttcgatcgagaaatcaacggcctacgtgcggggaaagcggtcgtggacgtttgatgggccgcggcccaagcagtaggcccagcgattcccccttccgtgtccttcccgaagccggaagttgagaaattggagctgatcaaccggagagcgcaaagccaccggccgcgccgccgcgaaagcccgaggcggaggagacggcggcggagcgaagagtaggcggcggggagctaggcgggaatggcgacggggaggaggttcctgcagttccagtcgctcctcgcgcagcaagccctacgcctccgcgccgccccgagacctaaaccccaaccaaaccccccccaccgattcctccacgccccatccagtcccgcggccgcctcgccctcccgcctccccttatggcgcagcactggctcgctcctgccggtgagcgcggcggcggccgcggcggcggcggcagccgcccgggccgccgcggcgcggtggctgatggccgcgcgcgaggcgggctcgctcgagctcttctcgctgcagcggcgcaggtcctcggggtggttcccctcctcgtccatgttccttagcggcgtgtcctggtgaggtttcggttcgtatggtttgaaatgggggattttcgtggtggtttagtgatttttttttgggttggttttgatgttcaatgaaggacg

SEQ ID NO: 19127 - DNA, 1501 bp, Oryza sativa
gtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccataaggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcga

SEQ ID NO: 19128 - DNA, 1501 bp, Oryza sativa
aaatattttgctataacgtataaaacaacggttttgaatatattgaaacatgaaacaaatccgaatacatcgaggaaaagaatgaaacaccatcaaattaaaaatatttcagtgctgaaaattgtgaaacacaatcaaatcacacaatgaaacatttttctacaacgtataaaacaacggttccgaatgtaccgaaacatgaaacaaatccaagtacatccaaaaaaagatgaaacaccatcgaaaaacccactgcaacgtttcaaatttaactgataaaacatcacggtacatggattgaaacataacaaattcaagaggaaaacctagatctacctcttccaccactcttatggttagcaaccacatctgcgtccatgccatgctgagctccaccacatccatatagccgccgtcgtcgacgccgcggagcttcgtcagaccgtcgccgacgtcggtggcaggggcgtcgcgctgcgagggtggctgtggcctctgccacggtggccgcttgctcggggaggtggcggcattcggcggcgtcgccgtcgcagaggaggagcaattggcggcggctgccggcttggggaggtggcggcgttcggcggcgtcgccggaggaggcacgggggccggccacagggtgctgtcgcatctcctcaaggcgatgctgctcgccatgctcaagcggttcgagcactgcgacgagagaaacgagagatagaagagagagcgagagaaacgagagagagtcacggaaatgggtgggggtagttggaagagcgcccgatattttcctaatccgtcgggcactcgaccgataggatttttggattaattatgacatgtacagagccttatggtaaaacagttggctgaaaggttgaagtatttgaccctttaaatggcattgatttcctgtaaatcgataattaagctaaataacaaaaagaaactcctttgaaagtacaactacaattagacagagatcaagtggtttatctctataccaaactacaaatatgtatgatccaacatgtactagtgagtggttgctttaatttaatttataagtacttgcctagctaccaccatacaggcgaggccagagtgtgttttaaataacatatactccctccatttcataatgtaagactttctaacattgtccacattcatatagatattaatgagtctaggcagacatatatgtttagatttattaacatctatatgaatatggacaatgctagaataatttacattatgaaacggaggaagtacatacaagattaaatttgctcagttcactccttgcctgttgtctgctgataattccatacacaaaagtaaacagttcactacttggtttcgacgtgatctaaatatatatactgcaaataattttttttcgaacggtcaggccattgctgacgttttatattaagaagaaggtattccattttaaaaagaaaacatgactaaaccttatagtgcctagt

SEQ ID NO: 19129 - DNA, 1501 bp, Oryza sativa
gaaaaaaaatccgattcccacctaaaacagaataaaaaaaagtccgtttccttgaaaaaaacaaaaaaagaaacgtagatccgattcccacaatgaaaaaaaagtccgattcctatagagcgaaaaacaaaaacaaaatccgtaaaaaaataaaaaaaaccaaaaaaaatctagaaagatctgactctataagaaagtggcgaaaaaaaccgttcataaaaaaaacgcacgagaaaaaaaaaataaaaagggcagaaaaaagcgcggcaaaaaaagtctaatttctatttgttgttttagtagtccgtacatatctcttctctatctctaatctaatctaatctacctatttaaaatgagaaatttccatcgtatattaaaaagaaaaaatgcacgggaaaataaaaacggtttaaaaaaacgcgcgaggaaaaaatatcaaaaaaagcgcaaaagaaaacgcgctggaaaaaaaggtttccgtagtccgtataaaaatcatgcgagaaaaaatatttctattgttatttagagaagagtgcatagtgactctattttgtatagacttgaacatgcgaggcggtgtaggatttgattggttgcaagaatgagattaaaagaatattttagattatatgcatgttgtcatatgaataatccaattattttaggtaaagcaaacatcggtaaggttgtcatcattgaggttgggccattaagatgttccaattttctgattttctgattgtcatcgatatggttatgcatgaaagccgtatattatcattatgtttttttcacccgttgcaatgcacgggcttgtttgctagtataataaaaaaatacgttacagaagaaaaagagttgtatattaaatatcatcattcttttaatatctgttatatacataatataattacgtatgtgagttaggaatctaagagttaattgtatagcaagtccggtactattagataaagataggatggaatggagttagaataaaaatataaagaatgcaattgttaaagtagtgggtagctcacgtttcttggagaggagaatatatatttaaagagcttaactagccaggtttccgagttgccgacggacatcatatcatcgttgttttgctagctcatacagtatcttcaacacgtgaaagctaccagcttttttggtttcaatctttggtatttattccttaatctcttttttcttttattttatttccttttcttttttttttcttttcttttccaaagattggtcggaatttattccttaatctctttttccttttattttatttccttttcctttttttttcttttattttccaaagattggtcgtcggaatcctattcatgtcctccttattagctgggtgaacgtgcgcgacgttatatatgtgcgtctcttttttgctttactacttctgttcatcattattaaagtgaacgagtttcacatgcaggggccgttgtatacgcacctagat

SEQ ID NO: 19130 - DNA, 1501 bp, Oryza sativa
gattttacatgcataattaattaatagacagagagagcagcagataaataattaaagagacactagtagaattgcaggcagcagagcagcaggtaatagcaatcgctagactgtttccggcccagctgcgacgcaatcggctgtattattatgattgaatgatacggtagggcgtttgaacaagtcgaggccgaggtagcaggagacggcgatgtggtaggacctggtgcaggccttcccgatgaggaatcggacggtggccgtcacctgcgcggtgatcgggatgtcgttgcctctcatcatgttttggacccagtagtcgccgctgacgaacacccgcaccgggatggccgtcgtgttccgcggcggctgcacgaacggcgtccgcaccgacgaggcgtcgtcttcgttgagcagcgtgggctcgccgtcgaacggcgtgtaatgcagcttcacgtcgaacccgcggtactccacggcggcgcgccacccggggttggcggcggcgactgtgaggttcagctccacacctccatccagaggcaggatcatgcgcgaggccttggtgacggagaagtcgatctccccggggctcagcagcgcggagatgccgatcacaatgacggtcgccgcgagggttccaacgacagcgacgaggatgtactgcttcgtgctccaatatgatttgtgtgtgtttggtgatgatgaagccacctgcagcttcttcgtcgtcgtcgtcgccgccgccgccattgctgccatgcctgcttaattatctagctacctacgtgtacctccttactagttagctagctagctagtgatgcgtgtgtgatcgacttgtttaattaattgaagaaagctactctctccatcatatcgaagcatttccaaatggtttaagtagagattaaggtttataaagaatatactttcgtgccgatgaggacggatgcaagggtagcttgagatagaagacagcataagaaattcaaatgagagataattgataggagtacttctatatagtacttcatctgtttcacgatataaatcattctatcattgtctatattcatctagatatataacatctatatgaatgtgtgtaatgatagaatgacttgtagtgtgaaacggaggaagtatatatgaatggagctgaatttttgactggaggcttcctctcgtttgtgcatgttataaaaaacattgttattatttaagaaaattggtgaaaataaattaatatgtaatacgttatttcacgaacatgcaatctcgaaattgtttctagctagttgtataaattgaatttgaacacaaatacttatggaataatatatgacattttaatctatctcgtttgtttttcatattgaaccagatagctcgtgtgcgaattcgaataaagtatttgtttttctctagaaaaagaattcgaataaagtagaaataattaattcttggctatcttgcatgcgccaattcgaataaagtg

SEQ ID NO: 19131 - DNA, 1501 bp, Oryza sativa
ttacgcttttgtacttgcttcaaacaaaaagtttaaacttggtatcgatcggtaaaagttggtcaagcgctatatcctgtttgcaagctgctgcctagctgcttcgctgcctctggcttgctggcctgctactgctgcatgcatgcggctgattgatctgctagttagctgccactgctggccaagcacacgcatgggccaacggcccaaagccagtttgctgctgcttactgagcccaaagcaaatcaaaggcagccactagctagcttttttttttacttcctccatccaaaaataagttaatcaagtacggaatgtagcatttatccttagtgctcgtcatagattaacttattttaacaaaaggagtaattattttgggcgtcgctgttcgggcacttcactctagaaggaaaaaaaatagcatcatcccctccaaaaccccaactgcagttgaggtgatgataagtattctcgctagatccttcacaccacgtatactcttaacaccattcacaatgcgtctatatggcatacgtcccaaaccagcctcgtagaagattccccacatatgcaagttccatgcacacacaaagtgttggtgctaattatcttgctaagtgcgaaccatgactgggttggcgagccactctggatggagaacttctctgatgaagccagctttgagaagtctgtcaagctcttctcttatagcttgtttccgatcaggtgttaatctccgcagtttttgcttaactggcttggcgtcgggtcgcaccatgagtttgtactcaatcatctccctggggacccccggcatgtcggacggttgccaagcaaacacgtctgcattgtcgcggaggaaggtgatgagctcgatttcctatttgctggtcagtgtcgccccgatcttgacagtcttgtcggggttagtgctggtcagcgggacgattttgatcgccccgtcgggtcttgacgtcttgttgggcttgctcactttcgtaggtggcacagctgtggtgggtaggttgggagtttgctcgaccatgtcaaggctccgcttgtcgcattgtgctgctagctttgcatttctttgaatagtgattttcccttttggtcctagcatcttgagcaattgatacgcgtagtgggatgccgccatgaacttcgtgagcgcagtccttcctaagatggcgttgtacgccgtgtcgaactcggcgacatcgaaggtgacctgctatgtttggaagttatcggcctgtccgaaagtgacaggtagcgtgattttgcccagtggcttggacgatgattctggagtgatcccgtggaaaggttgacctgatagtgtgtcacgcccagaaatttagcccaaatttccatactattttgtgtattaaatccctatccaggaccagccagggtacacaaaacgacaagtaatatacagttccaaacgtaaataaagcgtaaaatacttacagaagaggctcttagtcctcg

SEQ ID NO: 19132 - DNA, 1501 bp, Oryza sativa
cttacatccgcccataaccgcgggcacggctgttcgaatagtttaataacctttgcagagggggcacactttacccacacgacattactaacccggatcacccagcccgtgcagaacagccacgtctggtgaccttgaggctttcatgacaaggcatttcgagagccgacacaggtttaccatatgccgacgagaggggtcccagaccaacaacaggttaggtcccagaccatcctgtgccagaaagcccaggggtcctccccgacaccaccccagcaaatccacatgtctctcgacatcaaggctcccctgattagctaattactcagccaggggtgtcccattccacccatggtcgtacttgttatatgttcggatgaaattccaaaggaaacggtccttaagtgcaagagcgggaaaccgtgctcctggcatgtccctcggtctgcgattttggaaattcatttagttcgcaagcaccgacccaggcgtcgggttttccaagtcttttgtaaaacccaagttttacccatcgttggatattttaaatttgaggggaggcctccgatgtgcatgcccgaaggcccgtacatcgaagtaccacatttgacaaaggagttttaagtattcgatcattaaggagggtgattgcaacaattaggattggggggggcaggctaccttgcaagccgtagccgaattactcgtgttaatcctaatcatgcaatatttgcggaaaagaaatacttagatttaaattataggtgcaagatgatcaaaggtgacttgccttgctcgagatcttgagcttgatcatcgaaatcctcgcactgcgggtcttcgggctccgaagctatacgcgaacgagacgactcaacaaacggtgaaaataaggccctattattgacctctaagtgtgccattagatagaactcgggatttgagaaattttggaagttgaacggagtcaaacggatgtacggttgggaagatatggaatttctaagattgaaggatttattgaaataaaggaaaaggatttattaaaatactttttgaattagaaactaaagagggaggggatttagacttcgcgggcggcttgagcgcggcccgagaggggttggcgtggctcggccatgctattgggccggccggccttgagaggcggcccaagggggctcgcggggagggtgaggggagagagaggttctagatggacgcggtccatcgtgcggggtccggggcgggcccacgagtcagggactcggtgcacgagggagggggttcacgtggcgcggtgctaaggtttcaggagggggaggtgtggcgcacgcagggttcgcggaggacggaggtgcggcgggcccacgcgcagcctcttggctctccgtgggttgcgcgcacgagcggggcaacggagggaggcggctaaccgaggtcagcccgactcggtccgaggccgagctggcaccaatgtggcgccttcgtggctgccacg

SEQ ID NO: 19133 - DNA, 1501 bp, Oryza sativa
caatgtgcatacttggtatatccacttaaagaattggaaaaactgtgacccatcagaaaaattggagagcctgtgacacgctggtatcttggccatcaatgcaaacacaagccgaacagcagcataaccaccaagaacaagaacgtaaatccggaaataaattgaatcagagcttcttgcatttttctcatccaagactttcctgtttgacattcagcattcaagtgaggtgacttgctgtacattaaaaaaacatgaacaaaatactgaatactcacaaataaagataggttacaaatgttgagactgcagtcaaccaaatgaaccggatgactaatcttgatagggcaaaacctctagctgtcttatatgctccaaacatgagcagcacatccaagcagcctagagaagaacaaaaccaccaaagtcagcttaggaagtatcctttgattctagtccacataacaattagaaaagggattctctttatgtcactaagctgtacattcatcttggtttaacattttgactgttaaggctacatgtcagatgaacccagtggcaaaaaatgagatgcatgaaaagcttcgtgatgaaacaaagtatatccgccaaaaattgtaactagcaaaagtgaaaccatgaacaaagaaatagagagcgtacactcaatgaagttcagtatgaaaaatgctggtccagcactaactaatattttaatggtaccaatgtctatcttcccatgatgaaaagctataatagttaggcactgcatcagaaaagagcacttttagcatcataaactgtattcagaaatgatacttggatttaagctatacatgtgtacaagtacgatatcaaaccactgacctggaacattaatattagaaaaatccaaaggcgatgaaaactacggtacaagtgcagaaaagtgcgatgctcaacaaagtttgtctttccagtctgtaaatataaaattaaaagcaaagttaagtgcacataaataaccataatgcaaacaagatatgtacaaattttcagtaaaataaatgtgtccatttccttctagtcattgccccagccttagtcatcggtaagacccaatattttacataactaagtttaatgcccgtaagtttgctatgggttaaaaatcctacttccatagcacagcaagcccttgtcacaaatcccaacacatgccacaccatatgttcttctatggtgactgaacgagctccgctttgacctctgttatgcctctacggccttgcactacctacatcttgccctcttttacaccgcgcacaacccactttggatccactgttagtggacagtgggagtgtagagcacaccatgttaccatcacaatcaccaagtgcatcttttaagtaataggcataaggataggttaggatgaagattgaacactgcatgtttacttaacagaatacatattcttttaatactctccttttcagtcaatagatacatacaa

SEQ ID NO: 19134 - DNA, 1501 bp, Oryza sativa; identical to SEQ ID NO: 19125

SEQ ID NO: 19135 - DNA, 1501 bp, Oryza sativa
gccaaacaagtgctcaactctcagcgcgccgtcgaatcccgcggcgccgatgagcgacgaggacctgccgaacggcgccgcgccggacgcctcctcctgctgccgcctccccgccacgccgtcgacgccggcctctgctacctccatctctctgctcagcccttcgccagttcaccctctctacacgcgagcgtaggatgctagctaggacggacaggcaggcaggcagcaacggagtgggcactgctcggtcgctactaggccaagtagtgaatagtagtgatggtgatgatggaagctgaaaatggcatgtgcagacgcgcgggaaagaggttcgcccgtcccggtgacaagaaggaaccagggaggaagacgacacggggggctgcgcctgtgcgcgccaggcggtctcgtgacaccctccgtggcgcggcgcggcgccgagcgccaacccggcgtgcgtgctcgaatctatcaagcggggcgcggtggcagcagcgagcgacgcgtagcgaagcaaccgagctggacagaggcgacaccgcggctagtccgaggaacgtgggggcgcgagaggtggtggaggtgagtgagactcgaacgcttggacggcgccacgctgcgcctgtgcgcgggcggggtcacgggggggcgtgtactgccgtcctgccggtgccacagggatcacagcctcagtcgcaggtggtctcggacagacagattctctcttccgcgagaattttggttaaagctcgccgtcgattgtacgaccccgatgtaagttaaggaatccgatgtttgtttactgctcgtttagtttctacagtattatgcagagttacaggggagcttgcagcagtgctggtttgtcattatcgtacagattccagttacgtagcgctcgtagtataaataaaggaaaaaaaaatggatttaatagaaagaaatgttcacacatatcacgcgtaaaatctcaacgttagctaatcaaatcataagttgaatacgagttttataagttatatcgtatttacaatacaattgcaatgtagttatactttaattatattgtagttatatttttttaacgaatcggtaagctgccaatttcattgaatagaggaggagtaaactttataagtgtgaagcaaaaaacaaagctcaggaccttcggttcgagcaattaaaaagaaagtcaacacatttgaatgtttttactaaaaaagttgtgacggtttagttttttaatatactccaaaaaagatacaaactgaaacatctgtgtgtcactagtcagtcactataaacctagcgaaatctgaagctgtatcccagcgtgaacttccccggtctcccggacaggcaggcggtacagtaatactcgtagaatggaaattaatcagaatatctgcagaaggcaaggggcaatctgcaaatctgccaaccgatggtgctttcgtggacgaggagccttccactcgcatccgctgcagcagacgaa

SEQ ID NO: 19136 - DNA, 1501 bp, Oryza sativa
ctcacattttgcacatacagttaaatattcattggtttctccaggcctgaagaaagcgaatcacgacggcaagagttaaggctgcttgtgctccattttcgcctcaaattactgccccaagacgcgagatacggaactcttgatgttgttcagaaacttttccctgcagaaaaacaactgggctagtaaagaaagtgcaacaaaagaaactcttcaactatggtgctcagaacgataatacagatgtcccgagctgcattataaagtgtcagtacggtgccagttcaatatatatccagtattctcaatgatgcaggtatgcaggcatagtgcagcaaaccaaaaagaaattgacgttatgttgtgtgtaaatgtgaaagttccataaaacttcatcgtaaagtatatcaaactatcagtatcttctcatcaatgattcaaaaaaagtaagatctctaagggcttgttaatgatacaaagcaagttagatctttcaagcttggaagcatctgctatgtaaatatacagaaatggagccatttctcaaacagatccatgtaaacttttgcaagtgtgatatatggcgattacaaagttacctgtctggcttgaatagtaggttttgatatatgaacaactgcaaagagttcaacagtgaagattcataagattagaaaatataattcataaaggagaatagtcgctgcctaaaacttacccatgcaaccaatatgccaattaattcaaagagtagagggagaacaggaagcttgtcgatgacctgaagttgatttattgtattatcatgaaaacgctcttattccaacaatcgaaaaactgcacatttgaagctagatcatctggaagttacctctacaagatttatagaagcccataatgcggcaatccctgcaaatcctataccagctagagcaaagaggtcttcaggactgctgaactgtttcagttttttttcaggaaacaaaagtatgatgagaacctccatacataatcaggtgcctcaaacacaattcagaacaatttatggtatcaagttgtcttcagtgcataattactccaggtaaagtagcagactgtgaaagctgatcagaagcgtaagtgcgtacaacgaagctttctgaacttgcgtcagaaaaaaaaattgccaatgtcatcagggttcctgaacttactatctacctcaaagctcaaattgattagtagagataaaaaaaactcaccgaactctggacatacttcacaacgctcccggatgacggttctgaactgtcctgcgcagcctttgcagcgacgacattgcgactcctcatcctccctgcatacgagcacattagagcacatgatactcaatggctcgtttgcaaagaaacaacaatataaaaagaagtgcaagagaaggttgagattgattgggacccttggaggaaattaaaaagaaaaacacctgaaacaaatctggtgcttggcactgcaggcagca

SEQ ID NO: 19137 - DNA, 1501 bp, Oryza sativa
ttaccacagttatagttttgttttccgtataataatagcatttgcatgttatcccgagttatgtgttaagctttctctcttgatatttgtggtagattgactgtttgtttattttcatgatgttgtttgtctttagggagagaacgttcggtggcaactacagactctgaaagcccaacaacggatgcaaagagttcattctctttcagagcagaggtattctctttaagagcaaagagctccttttttttttcaaattaaaaaatatgtttttaaacattatttactttaccaaatcaaaacgctggcgaatagtttcatactagccagttagcgtgctaccctttttgtgacaatttagcataacaagatgcccgtttgcaggacgttcccattgttctagctgaacacaggaagaaggcaaatcatggcagcaatatcttgtcatttatcaggaaaggtagacggcatgcgtaagagccaaaagcgccaccggaatagctcgagactggatatatgcacgcatactttaatgaattcagtattgattggcaacaatgtacaacctaatatcactgaatccccaatttctgtcaaaccagtgtccattgaccatcatgtatgtttagctttgcatttgtgccagcagtaaattcggcccgatcatcctgaacatgtaacaaacttgaaggatcgagcagtaatatctgcttggaaagctagtttttcttcccctctacaaactctcaatatcatgtaacaaactttaatctgtctccttattatcaatgacaaagattcaggtgaggaatctctcccctccgatgacttcgtaaaaaggaaacctgaacacgaattcagcaaattctgcatcatcaaggaaaaatacatgtacgttcagtacttcagggcatcttttcctttgtgcttgagaaatcaactcccgaatcccgatatatcatatatatacatgcagtaattctcataacggtgtgaatcaactctcgtactgtactgtggcgtgctactactagtagtagtataaaggaatttcgctttttacgcgacattcttgagggtagctggcccatcataggactaattaaaagcactcgcataactactaattaagtagtaagctcctgccacaagctatgccaattcgatgagcccgctcaacatcatatcgatcgaccggctcacgcatttcattcaagaagcaccgtccggttgcatgaacgccccgcgccgcgcgtacgtagataactaccattcaaatccctaactgcctgtctgccatttctctccatctcggtctgtaaaatgccatgtatctagtaccagtagaacagttgtactacctcctgatggtctcacgtaacttctttgttccctttctcttcaattacgccattgccgtcttgcccggtcgatcaaccctagctttctaagccctacaaaagacagcatccatctgctagtgttagcttagccttcagag

SEQ ID NO: 19138 - DNA, 1501 bp, Oryza sativa
ctaggtgcataggaatatctgaacttgcacattttgagggctttttacagcacgtttaaattacttgatgctgtgagtgtacagcacatgaatggaatttttgtagactctctattgtaccacatactcatagaaaagagtctaatactggttgacaaataaccctactattggatctagattgactaaaatcacaaacactaaatagaaatagacttgccgtttgtgtagcgatgtatgtactctctccgcacctaaaagatttgtttcacagagactattttctaagtagatgtccattagatctttaatagtattttttttcgttttaaccttcaaacccagttgtactcccttctcttcctcatctttgattatcttaaacaatatcaataatattcttttatgaatagtgtgagtttaaaataaagtataccttttcctttaaaaattactagtttttaagttttttacttacagtatatattttttattaagatacatattttacctatgtttttttaacatgtttttaaaacagcttaacgatgtgtttcttaaaaacattttatgtataaaaattgctttaaaatataaaataaaaatactttcaagtttataataatataaactcatatgttaatagtttttgtattttacgtgtgtgctgacatcatcttcgtagcctcaaacacactctaatttatatttcacatgtattttactcatactatttcccaaaggcacgagagaggacggcaacaacaaaaagatcctcgcctccccacacctgaccctacccatcaaaatcctcctagacaactcactaaattatataccaccagtatgaaaaagaaactaaaaaaccatttttaaaaggtcccagatgaagaattcttttccaactcgatcccaacagaagaaaaggaaaaagaaatgaatagcaccgaggagaggacagacagaacaaatccatcggtctcctcctccctccgatttccccccttcgtcctcgtcgtcttcctcccatttttttttcctcctcctcctcctctcatccctcgccgcgagccaaagcccctggtttcctcgcaactgcctccccgcgattccgtttgacccccactgttcttctcccctaccaccaccaggtcgcagtcgcttccaatttccaaataattccctccactccggccgctcgcgaggaaagaaaaggatttctttttctctctctctctctctccccctctctccgagatccgtttcccaaacaggcggggggtcgaaagtgtttggtactttggtttggggagcttgtttgccgacgcggatctgcgtggagacgagcagaggggggagcgccggaattgggtggtttggcccgggaggcgccggaaagtgggggagcctttggattccccgaacccgccatggtgatccggcacgagtagtagtggtggtggtggtattagtagcagtgagatgccggcgcgtagcgcgg

SEQ ID NO: 19139 - DNA, 316 bp, Oryza sativa
acatatatcactctaaagttagtagctactaagttacatatatcattcactgtattgtagagttttccatcctttccccgttcaatctttttaattttcttcttacttctaattcacgagcaaatcgtccttgccttttctttgtagtaaaattatttttagagtatttgctggattctatttttattcttagtaaaattatgtagtaaaatcagttgtcacccgaacttcatcaatcttccttagttcctaacaaattatgctttattgcatcaaagttttaattgttctattgtacttaactgacttctaaatt

SEQ ID NO: 19140 - DNA, 1501 bp, Oryza sativa
agatgatgtcagcacacacgtaaaatacaaaaactattaacatatgagtttatattattataaacttgaaagtatttttattttatattttaaagcaatttttatacataaaatgtttttaagaaacacatcgttaagctgttttaaaaacatgttaaaaaaacataggtaaaatatgtatcttaataaaaaatatatactgtaagtaaaaaacttaaaaactagtaatttttaaaggaaaaggtatactttattttaaactcacactattcataaaagaatattattgatattgtttaagataatcaaagatgaggaagagaagggagtacaactgggtttgaaggttaaaacgaaaaaaaatactattaaagatctaatggacatctacttagaaaatagtctctgtgaaacaaatcttttaggtgcggagagagtacatacatcgctacacaaacggcaagtctatttctatttagtgtttgtgattttagtcaatctagatccaatagtagggttatttgtcaaccagtattagactcttttctatgagtatgtggtacaatagagagtctacaaaaattccattcatgtgctgtacactcacagcatcaagtaatttaaacgtgctgtaaaaagccctcaaaatgtgcaagttcagatattcctatgcacctagtattagatattttattgagcgaaaatagcttaaatttttccagtagcactactgttcagatcagtcagcatccaacacatctccttcatttctttttgccatacacatcacctcaccccccggtcaccccaccgggagtctgtacccttccttgccgtgcactgcggccgtccacatctctctctctctctctctatctctctctcgtctcgccgctatgccgtggcatcgcctctcttcacacgcctttcctgtggcgttccaccatacctctgggagctaatgatgttgggctgatccattgatcgaacaccacaaaactgactagagatctaaggcattcaccgctactagcctgcaccaccttgtctcggcattaccggtcattttcgtcgaattaaacacgatcttgttgttgaaagatcacgaacatgaggtgaccctaacaaattactagtaacacatccgttataataaaaaaaaagtacagtgtacggacggttcttgtaaggtgtgtcatccagattcttaagctctcaagatatatattcaagttccagaaattgtcctagtgtgtcatctagatctcaaatcgccacaccctcttcaagatcctacgtgacgttgatgtggcatgccacacaaatatgacgtggtgttattttgactgacaaatgggacacatttattttttttttctttttctttttttcttctctttttcccctttattctcctttctctgtgacccgagcagaagaaagtaaaaaaagaagaatgagaagaaaacggaaaagaaaaagaaaaataaaagaaggaaaa

SEQ ID NO: 19141 - DNA, 1501 bp, Oryza sativa
gctccccttcctcttcccttgcgccactatgctggctccactccagcgaatccattttgcccatctctccttcctttcccctttgtatcaagccaccaccccccctctctttaccaccgaagataaactcttctactcgccgttccggccacatccctcttcctctcttcgatacaccaccctccccgggtgcgcgtcgctcgggaacacaacccaccgccaacgtcgcagcctcccagccaccggagcaccgccgccccactcggcctctcctctctcttctctcggctcactgtgagacagagaggaaaacgaaaggaggaagaagaagaagaaatggaaaaagaaaggctgacaggtgggcccccgtacagtaccactttatattttctagatttaattcaaatcctattctttagaagcccatatctcctaaaccgtagatccgattccagtaaaacttggacctaaattcatctaaattcaaaatctacattttgatgccaaatttgctattttaagattttatttgaatttccttaatttattcaaataccatttgaataaatatttgatttaaacttataattgaaacttatatttaactttcaaatatttccttttattttaaaaataccctttagccactaaaagccactggttagaactttaccccttccatggggacgttcgcggtctattgactccgacgtcgaaccgttggttgttaagtccggcaaaaccaaacttaaggtcgaaatgctgctcctggcaccttacgccttaatgcgtacaatggtcggagcttcactattccctcgacctccactacacaccgcatagttagctcttaagctctgtgtgatcctaaccgctccgttgctactcacggttgtcggagtaacacttcctacacaaacttcctattcctctagtcgttatgctgtatgatgacactggctagagaagatatcaaatttagtcattatgctgtccaactctagcaacgactagcaaccaaaccctaaccaataccttcctagttaattcccgtcatcacccaaattccatacccacctatccaccatactctcagccacctactctccacctaccaaaacctatacatatagagcctagccgatatgctgtcctactccacaatcaactcccatataactaaaccctacctattatactacctaaacctaccaccagcaaatactagccatatacccacttaaccagtccaattatccaactacttcctatccttccaccaaccaaaacctgcacataaaatacaagcgacaatagttacttaatcctctctaccctaacctccaacccttaggaacctatacatgatatattagcccaataatccccataccctaccaaaggaatagattataccctaaaccctagccttcctaagtcgtttatcgttcttttgatatttcatagatttttattgaatttggctcttcctcttcttcag

SEQ ID NO: 19142 - DNA, 1501 bp, Oryza sativa
atatgacatctagtgacataataatccattacaagattattaaaatattaaataattatgcatccgttccgaaaccaaactttcttcatggtcataacaaaactttgaatcgcaattctttgtgtttgttctagtgcagttcattttaggccatttgtatattgatgcacgtgaatggtgtttttctctacaaattattttttcatacactgattcgtttattctataacatctatttcccctttttttatttgaataaatattaaactccacaagttgtgtgttttgagcaccattcctgtctggcatgtgacatttttacataatcaataaaatcttgaatctcaaaggaaaaaaaattacatgtaagatgatatcagatgttcatattggtaccatgtcaacatagatactgtaatattgtaatttttcgtttttctggttacgacttatcagggttgtatcaatatgaacttcgcactatgttacgtgagtcgttaaaaaaaacttagatgttgtacacttaacaatcgaaaattcaacatggtgttttagtgaagggtatttcaactagtttgagagttttttttttggttaagagtgttctagacttacgggttacggttttttttgttagagtggcttatctaaccatcactgttttctcttatgactgtggattacgacgtgcacgttttccaaacctctaaatgggaagagtatcactttctatatataaatgttttacaataccttttttaaaacaacatttaacttgctatattcaattcattcttttgtaccattgaatatgaacaaaacaaaagttgaagaccaagaagtggtcatattcattttcaaataaatgaaaatgtcacagaaaaggtggaaaaccacaaattcctttaatgcttgtactattgtctttcatattttaaaacagtactatctccaaaattacaaaacttcaatggactcaaaagaccccccaagtcaacaataagtaatttagacaaaacacaaggtctagaccagaaatttcctcgaaaaaggcaaaagccaaatatttgaaataaaaatgcaaagtagtagttggggatttaatagtggcttacaataataattaatctctcgtcttctctctccgcctcccccgcctcgaaaccctcccctcctcctccgcctgtcgccggccacctcgccggctccggccgccgtgattcggcggggcctgcgccttgcctaggcctccacgttcccctccggtgccacctcacccgctggggtatggctcattgacgtggcggcccgggggacgtgacgcgacccagttggaattcgaaatcaccgccggagatgatgatgagctcgtcgacctcgaggagggaggcggcggcgaagagctccgagctggggcgcgccggcggcgtggatcccccgaggccctccgcggcggcgatggcgcggagcggggagctccccaaggtctcggcggcggcga

SEQ ID NO: 19143 - DNA, 1501 bp, Oryza sativa
tagctaagggatttctacaactcaaggggaggacataaaagcagctgcataggaaaaatgctaccaaaacgataataagacaacctactatagttaaaaaaggaaaaagaacgaaaaatagtcgaaggagcaaaataagctttgtcagtcatctagcaagatgcaaatgcaaaatgacacgaaactagaacatatgccatgcatgcagcacaagcataaggatggtgtcgaaggtacaatatttttattttgtgattgctagcagaggaggaaatactaaactaaggtatggcacacaaaaaagatgacacaagcaaaattttccagcataaaaaagacggtaccaagattttagagggcatggaccaaaaacaccccagaacatgacaactgttaacactatttctcaaaacataatcaggagttagggcaataaaggtcaaaatcagctagggcttaggtgatctggaaaagcgtacaatattactgcaaaaagcaacagtataatagggctaaaggcacaagcaacagacatatgcttatgacattgtgcccacagaggtttgtagcatcaaggatggatggaatgcaatacacagatttaactaacataatccaggtacaaaatttttagttggggttatggtcacatgtaaattggcagtatcactcatctgactaactcattgaataagctctgatcgacaaattcttaggcagcctcacacacttataattactggaatgagggtaggttcactacttgagcaataagcatcaacaacattagagctcaaatactattttgagtgtctcaacccttttaagaaagctaccagatcagctctattccagcataatatgcaatcaatctaggcaagcttaattcaaataagcattcaacacagagtcaatgagattagaggggatacttgctgccgtacgatggtgcgtcgacatggaactgcgacgagccagcaccaccaagggacagaccgtgggttttagcacccacagtgagtgacgggagaggcgcatcggtgtcgtgagtcgcggtcgtgacattggacagctggggctgcgactggggcgcaggggcagcggtcttggattccacaggctttcttgaacggttgcggccacggtgcatgtggcgctcgcagtacttggagtcggggtgcgcctccttggagcaccgccacttcttgccgtcggtgcggcggcaacgccacggctcagggtcaagcttcttgccatagtaggcataatagctcactgcagtgacatgagcacaggcacattgaatccatatcagcattcatcattgttcatattaaaactagatcaaaatgcaccacttcaacatttcatcaacccaatgcaaagttggtaatggtaataactactatatgcttaatttgcttaggatataagagtgagcaaagaatcaatcgaacagcttaaacggacatactataagcaaagatccgtgtacgttcat

SEQ ID NO: 19144 - DNA, 1501 bp, Oryza sativa
aaaaagttatatagaaaaatgaccaaaataaaagttatagatcttgatgagttatacaactttgttgttgatgactttttttagttgaaatcatttagtatttaaaaatgttgttttgaagttgtcatattttcaaattcaaattcaaactgttcaaaaaaaagttatatagaaaaatgactaaaataaaagttgtaaacattgataagttatacaactttgttgttgacaatttttccatttgaaatcatttactatccgaaaaattattttgactaataaaatgaattattatactacagttaattattttgttacaggtcaactcacaaatataaatatttcatatgaaaaataaaaaaacactaagtcatctcaatcgggcattttagtatagagcctgtcacggatgagtcatctgtgacggacctagttgttatcgattgagatatggtcgcacccgtgacgggcaccaacttggggcccgattgagatatggaatgttatctcaatcgggcctaaactacggcccgtcactgataagtgtcatccgtgacgggcatgagttttatgcccatctaacatgtttgtgcgaccatatctcaatcgggcgttttttcagcccgattgagatgacttccttgtgacggcccgctaattctagtcatgttaaaggccgtcacggatgaaaggatactagtgaaataaaatcacatacacagtgtgcacgatatttacccttgctcgataaatataataagagagaatccactcagtgccactgagtttttcccacttctacaatctaccactgactttgtcaagttgaacaatatgccatcgtgttttcccaaacatctactaagtgccatcgccatccacaagccgttaggatgcatccgtttagtgtattgattttttttcttaatgactaaaatacccttaccttagcactttgactgaagaccctagccgtgcaatccccatttgatctgcccagtgtgtggcagcgccgactcccatcgatggaaggccagccgcccgagactccgaatggtggcgtgatttttcgggttggaatggattcaatccatgggttaaggtctggatcgatccataaatcacgaccaacccactcgctcaggtcatgtgctactagctgtgctctcctcttgcaggtcatgtgcttgctttctgcctcccccattatccatggcggcatggcatctctgctgctggcagctgccacgccggcggcagcggctatgcctactccacggaaacgagacgaggtgcccggtgccccaagggaagcccggactgctgcgtcgtcggcaagcgctacccgcggttcatgtggctcacagccggtatcggacatgcgccggcgatcccgacgctgcatatgtgcttccgccggaacatggagctggtcgtcgagctgtactccgggtctgggtggctgtgcctcgacgacggcggtggtggcgcacgctgccgc

SEQ ID NO: 19145 - DNA, 1501 bp, Oryza sativa
agaatataatggactaaatatcaaagcactcaaatgagaggggaattaacaatataattcctcaatatatatatttggaggaaaatggttggaggtaaacataaaaaggatttgaatcctaaatttgatagcaggaatatttgaagaattatttgtggctaatagggaatcaatttggaagaggaggataaaataaaaatctattcttctcagcacaagagcaatcattcacaatatttgtaatattgctattcttctgccaaataggaaatccaaccatagagattaacgatggctagatcaaagggaggaatttggatatttaaaatttggaaagggaactaagtataggtttggaatcaaagcataggtttaagatcaaaggatgggttaacaattaattccaatggaatcggaattacggttgtttaggttcaagggcaatatggaaaggatttttggaccataattcataacaaaaaaaaagggttttcgaactaaatttaaagaaattatggtcggaggaaagtattgaatcaaatcaagaaataacccaagatggttttaaatagaaaccgcaaaaggaaattaaataaaaggagaggttttgagttagttttaggaagtctctctaattataatattctaggtttaagaagttattaaaaacataagaatcggcgtggtgcataattagaaaattgttaattttcaggatgttacagtactggattgacgtcaagtatcgcagacgacggcgagaatcgacgcacggctcacaacttgcaggccgtccacggacagcaattcctctcgcagagcgcgacagattatttaacggtgtaaaccttttagagtagtggtttctttttaaatttggacctctccgctctccggcccaacgaaagcgacgacgaataaagtcattattatatattagcagtgcgtataatttctgttaggaccatgaggtagagtaatgaacaatactctgatcctaagctgagaaatcaatgtatgtgagcagaatatgttcttgcatgcagctgcagctgcagaaacagctcgtgattagcagattgcatttagtgggtgggctgtcaaatcgatcacagtcacagaaaccacatgtgagcagaacaagttcttaacataggagagatgacatagcaatggaaatggcgaattcgtgatgcacatatataaagctagcaacaggtataggcgatgtgtgtgcttgacagtgtacagtgcagaccatgggtggcgacggcaagcacaccaagttaccatggctgggcgtggcgaggtacgcggtgaccgcggtgctcgcggcgacggtggcggcgacggtggtgctggccatcaggatggtgctccggccggtggagctggacctgtcggtggccaacggcgcggtgtccgtggagcggccggagtcgccgtcggcggcgtcgctggtcaagtacaaggtgacgctccgcgcctacaacccgagcgg

SEQ ID NO: 19146 - DNA, 509 bp, Oryza sativa
gtgataaggagtgagaatgcacatcgttttccgcgcgcacgcttcccaaactactaaacagtgtgttttttgcaaaaaatttctatatgaaagttgctttaaaaaatcatattaatctatttttaaaatttaaaatagttaatactcaattaattatgagttaatggcttatctcgttttatatatcttttcaattttctcaatccccttcttctcaaacacaatcttagtggagcttatacggagaagttgcaactgaagctcccataaacatttcggcatgctatttctgctgcgctgctaaccccgttcggtggtgggccccttctgtcagtcaccttccaattccccttgggcacttccccagtggcagttaccctattcattttttttcctcttcccggtcacaactccaattttgaactccaccgccgccatcgaggtcgtccgcggtccgcaccgagctccgtggattcctccgccgtcgccgagcctatctgagcgcgcga

SEQ ID NO: 19147 - DNA, 1501 bp, Oryza sativa
ggctccccccgaggggggtcgagcccggggtggcgcggcggctaccccctcccagctagagggaggaggccgccctcaaactcacgtggctctccccgaggggggtcgagcccggggtgttgcggcggctgccccctcccagcttggggttgggccacctccaaacccacgtggcttcccccgaggggggtcgagcccggggtggcgtggcggctgccacctccaagctagagggaggaggccgccctcgcttggggtcgagctgccccgaccccctccacatatcagcccacgtgtacagggttaggtgggcgcgcctaacgcccacctaactgcatttaaagcggtctatgcaaccgtgccatgccacatgtaatgcaacgtgctgcgcatctgaccggtctgtgaccggttgaatgaccgatgtgacggcgactgtgtacccctgccctgccagtgtgtcaggcgatgagcggcgtgctccgtcccgtcccatcataatgatgaggggcttcacagcctcttaccccgatcagagctggtccaaccactctgaactgacccgggttcccgttttctggtgtgaacgagaacccggaagtcctcatccattaaatggcgaatgacaagggcgccctgcatgatttgatgggccccgcgcagcaaccgacgtgcagatagattctgggctaaggcacaagacatgtaattaatttagagaatattttcccttctccctaggtagcactcgcagcacatgtggtatccccttagagtataaaaggaggacaatgcctagcaaggaagggggatcggactgaggatccctgagccaaagcttgtctaaccctagcttacataccagggattcatggactttctaagcacagaagaatcatacacacaggagtagggtattatgcttcatagcggcccgaacctgtataaacctcttttgtctcatcgtcttggaggagcctccgagatcaagatcacacacagtttcgctcaccaaatcctcgaatctcacccgctgcccccggccgaactctcaaaggggggcctcacagcctcccgctagagagggtcacccctcgacagttgcctatctgatatatcgatcctatttttaactgtaccgttgtttagagtcgtattggcttagttagatctttctcagttaggtccgatattctaattaagttaatatttctccaatcacattgttgttttagattgattcaatatatccatcacggttttgtagatctatcggctaaatagggttttcttattatcttcaatcttatactgtttcggtcagctccgatctattagattattgctagtaagtctgattctagtaaaccgataggtttttatgcaacgtttcatcggagttctaggtgatgagttatcttgctactatttctaagtgatgtattggcttatactcaaactcgtatactcactagttaaatctctctttattaacttcaat

SEQ ID NO: 19148 - DNA, 1501 bp, Oryza sativa
aatctgttgcctatggcgactgcgagtcaagcggggcacgaggcagggcaggcaggctgacgaggcaaccatttttcagaagcggaaaactacaaacatcccctgtacttggaccagactgtcaggtggtggtgtgggtatctaattgggcattcgtcccgtccgttaaatcggaaaccagcaacatgttccgaccgctacctgcactactcgcaatgcaaaacccgcaatggtcttctggtggttctggtgagtctttgccatttgcctttgccgcctcaatgatcacgaaaggatgttgcccttggtccgaaggactctgtcatgtcacatcgggtttacggtacggtagaaaacgttcactgtagtgtgtaatcagcgtccaagtaagggcccgtttaagttggtgaaacggaaagtgtcacattaaacatttgaccggatgttggaaggggttttaggttacgaaagaaaaaactaatttcataactcgtctggaaaccgcgagacgaatcttctgagtctaattaatacgtcattagcacatgcaggttactgtagcacttatggctaatcagggactcattaggctcaaaagattcgtctcgcgatttaaatgcaaattgtgcaattagtttttatttttatctatatttaatacttcatacatgtattcaaaaatttaatatgatgtttgtgggaaagttttttttaactaaacaggtcaagtgggtggagatgaacatatttttggacttctactaaaaaatcaggtgaaagaaagatgttccagatttgcaatttgtcctaggattattagagtaagaaagtgtagcatcttcggtaaactaaaacaaaacgaagaaacagcagcgtgttttactcgcaggattaggaaaaaaaaaaaagaacggctagtcgtagggagtagttaatgcacgaaggggaaactggtgagtggcggaggggcaattcggtcacaccaaaaaagccaacggccagttcagtttcccggaaggagggaagaagcactcgaaacacggataaaagggggaaaaaatggagaagcaaaagggagagaagaagaaagcaccacgacgacaaacggccccagtgagcgagtgtgaggaccaaggctgacgaacgagtgtgagagtgaacagtagccgcgccggcgagagtgcgaatttgctctttgcgctgcctccctctctcacgcagacgagccatcctctctcgcggctttttctccaacagatttcgtcctgatctccccccctgcggaagggggacgctgccgtgtgccgtgccggagcgcgtacgctgaataagcccccacctggctggctccagaagccttctcgagagagaggccaaggagagagcacgcagcggcgcctacataagcgaggaacccgtgtgttttcctgttcccgtgtgttttcattgctcggcggcgggatcctgacgggcaaagaagagggtggtggtgcggcgacga

SEQ ID NO: 19149 - DNA, 1501 bp, Oryza sativa
tgttctgtccctattaactcataaataaatgagttcctcttgaaaatatgtccccttaaaatgagtggatactagcaaatgtttgttccaactttttatggcgtgatttgattaatagcggaaagagattccacattccagcatattttaaatttttttatcggatccctggaaaaggttcccggcccaataccaacccgtttacactcctaagtcctactaagtcctaataaccgagtggtttcagatctcgtttacatggaaagttggttcctcctccagccaccagctcgatcctttcttcctcgttctcgcgatctgacctccccatctctcctcactcgatttcccggcggctagcgacgcgggaggaggcgcccggccggccggcgagcacgtgctgatagcggccgaggaggcgttgcggctggacgaagagcgccgcgtgcagcgaagcggcagtccggcgagcaggaggtggatctggacggcgtcgtcttcgcctgagccagcctcaccacgcgtcggcctcccgaggcggggagttcatccgcgcgaacggccccggtagcggggcgaggcgttccgaatctggcggcatcctcggaggcacacggcaacatctcggtctgcttgttcttcacgctgcgccacaagctcaactgcaatggccgccgccgcggcgtcaagctcgtcgccggagttctcgtagtagccgaggtgccttgctccttccatttcctccatctccgtcctgtcgttctccactgctctagctactagctagcaggatatactccacgaatcgcagaaatggtattcaatgccttgtaatcgttcagaaaactaaaaaaatattccgcaatcgcccacttcaaccccaaatcccctgttttccaatccccttcaccttttcgcttacaatccctataccgaactccatgctattttctgctccacccatgttgattggcacggtaaagcgcacagctcatatcaactttttttttttgttttctttcttgccggcatctcagatcaacatatcaacgtcctgaactgttctatttgtctgcaagtacctgccgagatgttatggttatttttccttggacagtatgatgcgcttttcaatttctcattcagtttttcttttcctgtttctccgattttcactcttcctgattttctatttaaacggtaggaaggtagctgtccttgcctgaaatagaaatgtttagtactgctcaccttttggcagtttctgcatcatgaaggtcattgaaatctggcatttaagttgtaatgctcatgcgtcgtgttgatcagtaaaaagtgttgctattctcaaagttctagtttgagtttatgaaaatttattctagaagttcaaattatggagggaatcttttgtttcttctgcagatactgattttcacggggatgcattaagctacggtctaacttgtgggagctggatactgctgaaaaggggaccaaa

SEQ ID NO: 19150 - DNA, 409 bp, Oryza sativa
  unsure (1)..(409): unsure at all n locations
aacgttatgcacccacaactccttcacaataattcctttggtgcttccccaaatttgatatccttaacttaagccaagtaatcgagcgtctaatatcaaatcttaccaataattttggagtaaatttaaaaaatttttttaaaccccccaaaaaaggtttttttttcccnccccttttttttctttctatttcttttggttcattttcacttcgattttcaatgaaatataactcatttgtgcacgacaaaattactttgttctactgcttaatcggcgtggcagcaccaagtgcacaaatgaaggcagaagcagtcttaccattcagtgttcgatcctagcctgccctacaccatatcttcaaacaagaacacaggattgcattgacagactcgagcacacattttta

SEQ ID NO: 19151 - DNA, 270 bp, Oryza sativa
ggccaattcgagctcggtacccattttgcttcttgcagacccatttgcttaatatgagtagaaaattgaacgcgaagcgctccttgctttcttttgttggtgtcattatcaatactattgagttattatcaggtatttttcttaataatacaatgtgttcgctaacacaataaaatgttaaacatccagtatgttaaagttgcagtctgacgcctattttgttttgctgcagctctttcaatacttcagaattcttctgttgtttccagc

SEQ ID NO: 19152 - DNA, 271 bp, Oryza sativa
tcaacttttggtgtaccttgcctcctgggagaaggattaatgcacgcacgcaaggaacgcccgttgggttatttccggtcgtgacaagttggtatcagagcccccttgaccctaggacgagccgttagatcccgagccttagcaatattttcaaaataaaaatcccttcttatttgtgaaaatcctctattctctctctgtcttgctgcttcatttattgccaaaatctgacctttaaaatgttgcttttctttttgtttttgtttgtaga

SEQ ID NO: 19153 - DNA, 685 bp, Oryza sativa
ccttccgggacgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaaaaaggacctagatgcggtggaggcgcagctgcatcaactcaagatcgcccagggagaggtctgccgccccaagcgtcgccgcgtctgccgcagccagaagatcaccgcccgcaagagcacctccaggcccgagcttgttcgtcagtccctggcgtggacttgcttcgtggagacccctcgtgccgagcccacgcccgtggttccccagaagggggaagcctccggcgttggtagcacggaggatgcgctgttgctcaccttccgtcctggcccgtcgcagcagtagacgagcagttagtaggcttgcacgtgtgttctttctcgtttgtcttcttgttgggttgtgtggggcatggttatgccggtgtgtggcataactgtgtcggagcctgtctttattttatttgtttaagcaacttgaactttaatgaaccaatttaatagcagtaataaattcaagaattatggtagtcgtgggtggttagctttaattgtcagctctctctgtttgctggttct

SEQ ID NO: 19154 - DNA, 463 bp, Oryza sativa
cagcatttagcaaacatttcagaatttaataaaacagttaagtaataattaaacaatattaatccaacactatacaacataccctgttgtataggcccaaccattctatacaaccataccggctgcacagttctatctccaaaccaggaatataccattccaaaccaggagctaatcaaattattaccaattatagcatcattcactaaggcgagaagtgtgaaactaatcacgaaagacactgttagacccgcccataactgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccgttcctggatcataatcacccccttataaacaaggca

SEQ ID NO: 19155 - DNA, 679 bp, Oryza sativa
gacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcagg

SEQ ID NO: 19156 - DNA, 176 bp, Oryza sativa
aactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagg

SEQ ID NO: 19157 - DNA, 783 bp, Oryza sativa
tctcgggctccattgatgcgccggcgaactttacgggaataatccgagcgaatccgatggaaagagagagggaaaagagggggaaagagggagggaatcacggggagtgatttccccctctttatggcgcgcggggacggcgggatgcggcggattcggcggcggcggcggcgctagggcacgggcgggcggcgggcgcggcgcgaggtaggcgatgacaggtgggccccacccgtcagcgagggtggcgggcgggcccgcctgtcggcggcgcgcgcgcggggaggaggccgatgggccgcgggggagaggagagagagggagggagttgggccgagccggcccaagagggaaagggggggggaaagaagacttttagggattttctttttataaaacctttttaactttgtttatttcttctcaattattatttgctctgaaaattccactaaaatttatttacgcattttaggcttttaggaaatatacaaaaatcctccaagccttatttgacttttaaatttgcacattttaattgttgaaggctttcacatgaattttaattattctcagcacgatttcgaggatgtattttagagtcgatttgggacgcgacaattatcttttcggtactcgtacagaggtgtataccaatcacaagagtttaaagtatatctttactcagccagatctggacatgagacaaaggagatggttggaattaattaaggattatgacatgggaattcattatcacccgggaaaggctaatgttgtagc

SEQ ID NO: 19158 - DNA, 719 bp, Oryza sativa
atctttttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgc

SEQ ID NO: 19159 - DNA, 337 bp, Oryza sativa
ttgggccttcgctgcccatgtaataagttaactattacgctccgccttgttaaactctgaattgtatcactttttggtgtaccttgcctcctggggcaaggattaatgcacgcacgtcaggaacgcccgttgggttattccgggtcgtgacaagttggtatcagagccacccttgaccttaggacgagccgtagatcccaagccttagcaatattttcaaaaataaaaatcctttgttatttgtgaaaactgtctagtctatctctgtcttgctgcttcatttatcgccaaaatctgacctttaaaatgttgttttctttttgtttttgtttgtaga

SEQ ID NO: 19160 - DNA, 1501 bp, Oryza sativa
gttggatgacttgcttgaattgaatggatgaattgcatgattgatgaaatatatgaggtgatgaatttgcactgtttgtggatgaaatatatgcactgtttttagtctttttgtattagatgattttaggattaattttggccttggtatatggaatatatagccagggttaattttggccttgattaattttggccctggtgattaattttgtggatgaaatatatgctactgctgttatatggccctgctactgctctgctgtttatgtttctgttgtttctgtttatgtttctgttgttgtttatggccctgctactgctgttatatggccctgctactgctctgatgtttaattttggccctggtgattaattttgtggatgaaatatatgctactgctgttatatggccctgctacagtgctactgctctgctgtttattaattttgtggattaaaaataatgactctgctgttatatggccctgctactgctcttattgcgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagacca

SEQ ID NO: 19161 - DNA, 1501 bp, Oryza sativa
tcgcattgccatctcgtcgcccctagctgagaccgttggataatgcgatgtttcttccccagctagtactccctcttctgaaaccctatcggctatcgcataggcaatcatgcccgatcgatgcattgaacccgaatcataggtggaggaaagcttagccgcgtcaacctccctaaacctaggccgtagacagccatcgagcgcgcctgtcgtcgaccttatcctccatgccattatggcttatccccaagccaaacccccataaaaaaaaacccatccctctctaccttcttcctcaaatacatttcatcgaacaccttaggtgcatgcgtagccgaagccggcgtagctgaccgcgggaaccgtggctcgggccgcctctgttgctgctgatgccttcgatcaacgccgggtgccgctggagcccgaggacctgctgtcgaacgcctgtgcgctcgccgccgtcggcatcctctgcttccttaccgcctccccaccgcgacgccgcgtttcgccgactcgccatcccaccttagcgtcctctaccctaatattagcacccatggccgtgccggcccggctgctgttccgccgccggcgatgtccccgtggacatgctatcccggaggcttccccttccatcttgttagaaaaacggaaccaccatacactgtagaagcttgcgcacccatctatttggttggaacctagccctaccgccctgtccccttgcaccccggagctcggccatggcggccatgccgcgccgctcgcccccgcgccgtactgcaccgttgttgccggcgggaggtcgctggagattcgcctcatcctccccggctgctgctgtgccggcctcgcaccgtcccggcatgcgcgctaggcgcatggcgcggctgcctctgcctggcgagaggtagaagacgacgggaaaaagaaagggacgagagagagaaaccgtgtggggcccacatctagtttgcgcacagtaatcctccacctaatggtgattaacccactcaatgacatgtggggtccctattattaaaatctaagtaaacttaattatagattttgttacaatgacaggcgggacccaccggagattatatggccggcttaaccacagtcaaaaaggggccggacccacctgtcaatagcacatctcatttcctttgaaagaataagataaagaaaaggaaataagaatggacccacctgtcagtcactaccacatacggttaatgctggaataaaaataaatcaattatgaatagtaacatttcacaattattggaattaattcaaatttgaatctttaaacttgcataactcactcattttaactcggattcgaatgaaacttgaacctaaatttatctaaaatcaagatctaactgttggtaccactttctcgatttaatttgtaatttttgaatttttggtgattttatttgaattctaattgaattcaaatcaaatctttcgcacgtaaatttag

SEQ ID NO: 19162 - DNA, 1501 bp, Oryza sativa
cttgttatatgccatacctttgatattgattatccatataatctttgtaatccatgatatcgtgtgtctttagtcaatatttgacaaatgcttagcccatgctaattttgatccatgcatattcatatttgtcaaaatgctttatgcttgggcaattatcttagggaaggtaattgacatacagcatgtggagacatgagcgccacattgccatgataatgatgagatgatatgtgaaagaaaattaaactgaacaaatgttttcgactagggcggctggagggcttgggtggtgtccagtaaaggctagtgccgtccctgatcagttaaggatcgagccatgaagttaagcatgaaacgaccccagtacaaccgtacttctcgaatgggtatagacctagcggagtagataggcgagcggaggcagtatccctacatagtggtttcacttaggtgtgtggacgaacaagcagtttgctggctgatacccgatacggatggccaaatggcggatacctgatatggatggccagagactgacttgtcaagattacaagactacaaggagatacccaaaagaggacagcatggattgggttcaactacaggatgcaatgttaggcttgcgtgagtttccccctcgggagtgccagaactcctctctgtgctagaaacttatgacgcttagagtgcatgaggatgtaagttcatggagcgggtactgccaatgtaaggtgtcacgcccggaatttctatccaaaattccaaacgcttacatatgtgtgaaccctcgtccaggaatcagccgaggcacacaataacaaattgataataggatacaattattactctaattaataagcgaagaaaatgtcattacagaggtagatagttcctctcaaacaataaagatctaagcagcggaaaaaaaagataaacggcgcagacggctccactccacagggagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaagtaataattaaacaatattaatccaacgctatacaacataccctgttgtataggcccatccattctgaacaaccatcccggctgcacagttctatctccaaaccaggaatataccattccaaaccaggagctaatcaaattattaccagttatagcatcttctattatggtgagaagggtgagactaatcacgaaagacattgttcaacccgcccataaccgcgggcacggctattcgaatagttttactctgatcagaggtgtaccactgtacccacaagacacaaccccacatcatgtcaccatgtgcctcaataccaccacg

SEQ ID NO: 19163 - DNA, 1501 bp, Oryza sativa
tggatagaaattccgggcgtgacagctaggaggcgacgacgaaggcccatggcggccggcgacgagatggaaagctcgagctcgaagagagaaaaaccgatccaattcgaactcgaatccaccgatttccaaaccgatttagccgatgtttccaaaggagaaaaggtagaggagatcccgaagatcatttcccctctatcaattcggccggagaaggaaatgggcggccggatttggaaaggaacggcagcggcgcgaaactagggtttcgggcggcggcggcgcgacgaagacaacgaccctgacaggtggggcccacctgtcagcgggagagagagagaggagagcggcggctcggactgggccggctgggccgaggagagagagaagggttttgggccaactttcggcccaaagccaaaagaggacttttaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaaggcttttaaaatcatttctaaaaattccaattaaacaacaatttatatatttaggatttttagggtgtgacataaggttattgaaaggctttgccgtgacgcgtctcctgtgttgggacgaggctcatgtgttgggcagtcatggatgtcacatcctgattttcgcctcaggatttataaattatttaataaattaataatagaatttatattaaatgttcatcaatttacaagtgaagttaaatgcgggaaataaaatttcctaaataaaaagcatggatggatttaattcttattaaattctccatggttaattatactctctggaatattctcggatttttcggagctcaattattaattttaatcatacaaagagaagttcagcaattatttaaatattaaattaatcatataatgatctaattataattgttaagtgcttttcctgtttaaaatccttaaattataaattgttgtttaaaaggaattaatagaaatgattttaaaagtttaaaagagaagatcttttcttttaatttgctaaagttcaatataaaattgggttagataaaattttattaaacactttgcttgttcctctattttctagatttttctgggaattatttgagcaagggaagtatttttaataaatgaaacaacatttcacgaattattttaattgaaaaagttttaaaaatcctctcttaggccgttgggccgatttcggcccaactctctctttcctctctctccccgcgcgcggcccacgccggcccaagccgccgcccgcccctctctcccagccgctgacatgtggggcccacatgtcagggccgtcttcctcctccggccgccgccgcgcaagagcccgaaccctagc

SEQ ID NO: 19164 - DNA, 1501 bp, Oryza sativa
cataactaaataaccgtagatccgttttaggtggttcaagttgctaaatttttctaaaataaagatctacatattaaaattgtccataaattgaattaaatttgtttaattctttttaattgggctttaattagatttaatcttgtaaaattcataataaattcatttgaagtcggagtaaggccgttcaagtctcataattcatctaaaattatgatctacatgtttgtttactttttatgtactgtttatttggtttttattagtctttttcttcgttttacgtgttagtttgtcgtttccgtcgttgcgaaggttcgtgagtgcgtcggaagtgatcaggaagattaattgaagactgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccttattccttgataccttgggtaataaattgattagcttgaaccttatgtattggtttggttcagctaaatgttagatataattgcttagcaaagcttagaaacattagttcactaatgggatgaattatatatactacattattatttgtggtcatatttaatggtagctcacgatggttaatcgtgtgatgataattaattgataattaaaacctggttaaggtgggttgtgagcatatggttttgatggttgtgctcatgacaattaaggaccggtttgcgagctactgttgtgaaacatttaccgtaccaaccacaagccagcgtgggcaacggctttatcttttgtatagcatgattcattatagtgtgccagactgtgaagtggcgagaagtccatgggggtcgctggggagtccatgcctctggttgtagagggggtgattatgatccaggaatggtgcactgtggtgagttgtgttatgtagggggtaatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatttgtacagccgggtacggttgttcaggatggttgggcctgtgcagcatgggtgtgctgttcagtgttgattaaaatttctgattaattactctactgttttacttctcttaaatgttttgctaaatgctgcttttgcaaatgagcctatattttgccatccattggaatccttgtgcacttgcatatttgctgtgtggcttgttgagtatgtcatatgctcattcttgcaataataaatcaacctca

SEQ ID NO: 19165 - DNA, 1501 bp, Oryza sativa
ctaggtcttaagcttgtgaaaagaattgcaaaattgactttatgcaaataaaccattagcctttcattgaatatcctctatcatatgcatcgttgttgtgggggcttgctgagtacggttggtactcactcttgctatttacaaatttcatcagaagccggtgatgaagtctcggatgacccacatgcttactaccaggagggtgaagaagatggcggcgcttaataggtcttagttatggtcgttgcctgtggcaatggcgtcgccgctgccttgattccgatgcttatctatttctgcttttggtatgtattccggaccgtttggtcctatgttctaagactccctgcgggtctatgatgtaataaatcgcgctagacaatctatgtatgcgcaattgatattccagcaatgtaatcgtgaataccagactacttgatccagggaaatggtactattaacacgagagattcctgttataaaaacaggggtctacactcgtgcaagcgggggcagctccggtggcggctagcgcaggtgatggctcagcgacggaggagggggatcatgaaggtggtggcaactacccgggaaggcgacgacaaggagaacagcttcaccgccgggccactgggggcacggatcggccaccaccgggctcctcctcccttgtcccaggtctagtaagcagtggtgttaacaataaaatttggtaagccccgaagagaattctcacatcgccaatagtcgaattcatgctatattcggttaaggaaattaatctattaaaggaatcttatccagaagtgattgacttcaaggaggatgtggtatgcaagttatctattaattaggaatagtttgttagtttccttttatctttagggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataagctttcgatctccggcgaaggggtaagtcctacgttccaccggccctggcaactatattggcttcatcggcgtcgttcaaggctgcctcagtacgttcgatctcttggattgctctggttcggtcgatatatttacctacttatttatcatatgtctctattaatctagtcttagcatatcaatttagctctatcggccgcttctcgctttagggtttccgctggtatcggctaaatcgtgttgctagattagattagcttagacatccaccaccctgaaaatcagttaacggcttgattgtctagatattatgtttatttttatacttagtgctgcatcagttaagtttgatctactaagtcgtgtttagaaccataatctctagc

SEQ ID NO: 19166 - DNA, 1501 bp, Oryza sativa
tgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggccgtccaggggtccgcccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccg

SEQ ID NO: 19167 - DNA, 1501 bp, Oryza sativa
ggagttccttgaagatgaaggctttggtgtctagttcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagcccccttgaccctaggacgagccgtagaccccaagccttagcagtattttcgaaataaaaatcccttgttatttgtgaaaatcctctagtctctctctgtcttgctgcttcatttatcgccaaaatctgatctctaaaatgttgtttttctgtttgtttttgtttgtagatggccggcagcgtcacccgtcgtggtttggacatgactggcttcgtcttggagctgcggggtatgtgcgtggtcttggggtatccacatggagtggactaccaggccaggccgcttccagagcaggagggtgaggatgcagagccccacgctggttgggaggttactgcagtgatcctctctggctctcccgagcggacttcgctggcagtcaccgcgggcggagattccttccccgccgcttgccaaaacgccgctcttctcgccatcggcactcttcaccagcgctacccggacgagttgcagcactcgccctaccgctaccaccctcgtagcggaggagcccgcgactacgccaccttccgagatgctggctcggaggatgacgctcccatcgtgcacctggcgcgcatggtgaaggcgtacgacgcggctcgtatcgatttccatcagatggtgcgtcgtgggatggtcgagaacaacatgaagatcctggagctgcgtcaggagaacctgcagctcaagaaggacctagacgcagtggaggcgcagctgcatcagctcaagatcgcccagggagaggactgccgccccaagcgtcgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggagggtgcgttgttgctcaccttccgtcctggcccgtcgcagcagtagacgagcagttagtaggtttgcgcgtgtgttctttcttgtttgtctttttttgagtcgtgtggggcatggttatgccggtgtgtggtataactgtgtcggagcctgtcttattttatttgcctaagcaacttgaacattaatgaaccaatttaatagcagtaataaattcaagaattatggtagtcgtgggtggttagttttaattgttagctctttctctgtttgctggttctgtgtggggttttcaga

SEQ ID NO: 19168 - DNA, 1501 bp, Oryza sativa
gcctgcgcgcgccatccggtcctcgaatccggcggggagccacccgggatcgaatccgtccttggggtcgaaccccaccggcggccggacggcccagacgaacggccgcccgctcgcctccagccccagcgccagctccgccatctgacggatgctgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggccgtccaggggtccgcccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatgga

SEQ ID NO: 19169 - DNA, 1501 bp, Oryza sativa
aggcttggggtctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacggcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattataatataaagggttagggttgcagtaaacagcatttaaagacatttagttgctccaaagctattttgtaaacacgattctagaactatacaatgttattaatcacggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggcagaggtgctactgtcaaaaccatgcacccctagcccagcccaaaaccattttagggattttgaatagaaggagcggtgtgaagccggttccacgataaccagaccattccaaagtatccaggtgacttgaatatttcccaaagtctaaagttgtaaaaccacctaatgttacctaattaacttgcgaagcatctacctaaaattaaactagtggtgccatgagtagagtgtccactagttggggttttgtttattctagggtgaacaaggtaatattaacaataacaataataaggtcataacaaaggaaaataggcatggctaaataaaacagtgataacgcggg

SEQ ID NO: 19170 - DNA, 1501 bp, Oryza sativa
gggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctacttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactatacaatcttatatgctaagtctaattacaagtctaatattatttgagtgcattacaaatataacaatcatttatattattacgtcacttgcctgcacgaattccttctagggctagctcttccactccggcttgagggatcactccgacaacacgtcttttctgcaagatacaaaaaatatgtattaggataaatgcgaagtaacatatatatattgcatttcacattcacgttcgttcacgttcgttcgctcgttcacgttccctagctcgttcacgttcgttcgctcgttctcattcacgttcgttctcgttcacgttcgttgtcgttctcgttcacgttaattcgttcgatcgttcttgtcacgtcctgataaattcatcccgaaataaaaatcattctctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtcttttccccccttttttcccctcttgggccggctcggcccatccctttctctctctctcctcttccccgcggcccatccggcctcctccccgcgcgcgtgccgctgacgggtgggcccgcccgccaccctcgttgacgggtggggcccacctgtcatccctgtcctcccgccgctcccgccgcctcgcccatgccctagcgccgccgccgccgcgaatcccgccgcctcccgccgtccacgcgc

SEQ ID NO: 19171 - DNA, 176 bp, Oryza sativa
ttatgccggtgtgtggcataactgtgtcggagcctgtctttattttatttgcttaagcaacttgaactttaatgaaccaatttaatagcagtaataaattcaagaattatagtagtcgtgggtggttagttttaattgttagctctctctgtttgctggttccgtgtggggttttc

SEQ ID NO: 19172 - DNA, 559 bp, Oryza sativa
atagatctccatgtttctgctctgatagcctctctgatctcgatcttcagttagccaagccccctgccctgcatcatgatttatcgactactgagatatactatactatactatactatacatgtgtatgagagattcaaacatgcatgacagacacaatctatcgatgtatgcagtacacacaaatcaaacaagcagatgatcgatatatttttagataatgaaaatgatttacatctacggcctcggcacacaaccaacgagttttagcacctaaagaaatcaagccataaggtgatgagacaaattaaacccccaactcggtctagacaagttcaactcaaaaaaaggttataaaatcacatcacttttgttcgcacagcactggatgcatggatgaattgaaatgaacatggcagatgattaactttggttgatttggagtatgtatggatcgccccctcgcactggagcacacacgcgccggacgaaacgaacgaacggaaaatctatcgatcgagtagttggtggcctggcctcaactaggatcagctagcaa

SEQ ID NO: 19173 - DNA, 1501 bp, Oryza sativa
cacgatgtgatggaaacatgatgccagggcaggacctctacaatacggatggccaagttatttctgcctagcgcatcctcgtttcttcgccgcacgtccttgagcgcgagcgaggaactcgtcccccatcgaaggcccgagcggctcagttgggacgcacatggtgccgacgtgtcaatgaatcttcccgctagcgcaacgaagcaacgctccacgtaggagcacagcctcagtgaacatttgacctttcaataaatcggcttagattggacatcagaccatagtcatgtcgacgataaataaaaaaaataatggggtatgaccgtatggggttcagctgaaccccagtttctctattgcaactacgctgaaaatatgaaatttcaaaaataaaaatgtagcctgatgttagataaatggaatggagaaaaagcaagatagtaaactgtaaataaagctcatcagtacgtactgaggaggaccaaacaaggggtatggggattcagctgaagccctatttttttttttttttggaaatcaagtcgcaatttataccgcacatgctaaattcctgatatttcacaatatggaatgagtaattatgattttcctgagcagttgagcacatgcatgacacaaatagtaatgatcaattgatgccatggtcgcgtatctcatagctcttacgtgacaatttgcatctcaaaacatgttttgcaaagatattttatagaaatcttacaaggtattcttcaaaataattggaggtaccagttcggtgttcattagcactatccacaacatttaaaggtgaaattaagtaaactgaacaacaaaaacagctgtttactcacaggctaaattgctatgaacctagaatatacagcattatcaaattattaataaaactcagccactatagtttggaataaaagaaaaaaaatcatatataaacctaatatgaatggaaaaacaacgcacaaatcttttcctctgtgcaccaaaggacagtccaataactattagagatcatcttcagcagcactcgcagcacttaaatccacactgagatcaaccgtctggataaaatggcatgtcgattagcataagcaactaggaaatcactatcgagacaaaggaaatttaaaacattaaacacacgtttttttaggttgatacaagatcatgaaaaatgcaatattagttcaattatcactttgcgatcctggaatgtaagttactctgattgatacagtctgaatatgatgctaagagttatatactgatattcttacaaggttgctactcaactagctgcctttttataaagcactgtatctgtggaattgaaaagcccatttccttctcatgatagaatagattgattatagttgccacgtggaatacaagattagaatagcacaagtgcaaacaatgttgaactcatagtgctggtaaggttcaattagtgctggtaaggttcaattcagaaggttggggt

SEQ ID NO: 19174 - DNA, 1501 bp, Oryza sativa
gtacagttgcttacttgatcaaatatgaccatttactaaatccaaaacattgtgaacattaaaaaggatgggaaagttatgatggaatataaggagagttcaactattgtgtatgcattttgctttatgttgatatgtcatataacgaaatgattctaccatacccatagttcaccctttttatttcatgcatgactccaaagagtgctatggttgtgactcaccttaggaaaaagacggcatacttctggaataacttccacaagaaggtctgcaccctttcgatacactaatctacttatcacaacaataacaatttcatcacagctcaagcgatctggagagggagtaaacattgcagtatcaactgcattaggaaccatgaaaaccttctctggagatatccctgatctcaagacagtattctctttgcttgtgtgagagacacatatggcctgatcaatatctgcaagagtaaactgcagcaccttattcatgtgaatgcttccagcatcagcaaaaccgtaaagcgagtgatctgtgaagacaactttgtaccccatcgtcctagcatgcatcagtgcttcatggcacaatgttgagaaagcctgatgtccatgcaccacagagatcttctcacgaataagaatggtcctcacaatcggaaatgtcaagaataatgtaggcaatgtattctgcatcaggaatggcttccatggaacataataaaccttcaagccacctgtaacatatcgtactccagaacgattcccatatgcatgcgtcatgacaatcacctgggaatcaaacaaaaaagttgtctaaacattcgcaacaaaatcagtagcactaatttagtccgttgtgtggctctgcctatcatttaacgattggataagatatgtaacaaaaatcctctaaccattattggcatcaactcattatagcagaaagatattaaatccaatatttaaactacatataacaagtgagctggggcagaatcaaaagcatatccatgagttgatctagaccctaatatagtccctaaaattatgcatgaaaagaacaaggcagtaaatagaccattcaggagattagggaccttatggccaagcttaaggagacactgcgacagataatagatgtggctttccacgccgccaaagtttggaaagaagaaatctgacaccatcaaaatcctgtgctttctccctcgcccatccatttgtagctgtgtttgaaatctgaaagaaaaaagaggaaaatcaatcggtttgctacacaacattcgactgaaaaaaaatggtggcaaaatcttaataatcgctaacctctctatctgatccgagattccttctccagtaacattctccatctccagcgagtgtagcgaacttaggcggaggaggcggcggctccggcgcttactagttaggtttcgtggtggggatccagggttagacggaagcggccggggcggcggaggccccgcggtggg

SEQ ID NO: 19175 - DNA, 165 bp, Oryza sativa
tacaacttttgcaacttgaaccacattaaactgagttacaatgaattagttatgaatttttaaagattaaaccggattaaagcatttatatagattttaattgaattatgacgcaataatgaattatttttgaaaagcaaaagggatttattgcgtcatcaaaga

SEQ ID NO: 19176 - DNA, 1501 bp, Oryza sativa
ccgtcagcctaaaaacagcacgatagaggttcggtaaaaacacgctttctcttaaaccaaccgttggattgagttgcaaactttacagaataaactagacaaaccaaggaacaactccaccacagggatttgcaaattacaaaacggtttaagagaaaacaccatcgattagggctggacgaaaagctcgtgtctcattgactcactcagctcttatctagcttggctcatttggatttattaacaacccaagccagggttttagctcgtttgttataacgagccagatcaagctggcccgtgagctgttcgcgagccaaacgagccaagcacaacagctcaagtacctagttggccagcagcaatatgaagcgaccaagctggcccatcaagaaaaagcccatgaaggaaagaaaaatactaaccctagatggagagacacgtacatgacctgtctctcgcactttgaattcccgatcccctttctactctagcatcgctcgctctccacttctcacgcaccgacgaggtcgcgccgtcgattgctcgtaggcggtagtggcaccctcgccttggtaggccctcgcctcagtcggccccgaccgccggccctcgcggcatcacctttgtcggccccgctgccggcccttgcctctgtggcttcgtcggcaccagtgcatctacaccatcgatgaagaaggagctaggaaggtgaacgagtcaatgagaccagccaaaccaacatttgtacatctcttccaagatgattatctcttgcatgttttattgatggcaaaatttgctaggacatccaaagactgtgctctttgctagaggacactgaaagaatacgtttttgttagatgacactggtaattagctgctggacacctacggtattattttattatatctagagaaatatttattaaagacaagtttacccataggcccacttgtcaatcacacatatctagctttctctgttcatgttcttcttcctgctgctaccttctctctcatgcgtgtgcacagcagcggcaatggagagcatgtgcagttgctggctggggcagagcatgcggcagctggttggaggaggtaggcctggagcttggccacccgtcagcggcgccacgagagagccgcacagctagggtgtcggtgcgggagactgggttgcaaaggggaaatatagcgcagcttcaatttgaccaagcagtaagtacgacggggtgtctaggaactttgggaagtcgatttccaacgattgcaggacaaagcaatgtcggggttgtgtgcccatgatgagcttgacggcagcccaattgagtttggactggcaaggcatcttcgtctaatttttaaaattgattgggtgcagtgcctctatgggtagggaaaaaatttaggatgtaatggattgccggaaattggcgtgatggcgaatgatggcaacgacatcgtgctcgccatcaacgagctcctcggcagcttcagg

SEQ ID NO: 19177 - DNA, 463 bp, Oryza sativa
gcggcggtggcgctagggcacgggcgaggcggcgggagcggcgggaggaaggggatgacgtgtgggccccacccgtcagcgagggaggcgggcgggcccgcccgtcagcggcgcgcgcgcggggagaggccggatgggccacggggagaggagagggagggggagggagctgggccggaccggcccaagagggagagggggagggaaagggaactttttagggtttttcttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgaca

SEQ ID NO: 19178 - DNA, 1501 bp, Oryza sativa
gcagaactcctgccatctgggtttataaagagaaccatggacagaaaatggtatagcgtgtgcagacgtgcagtgatataaaggcactacatttctagtgtcatctgtgtgaaatgtcatggtgtaataaacgactagttcgattgaagacgtatataactatatatatggcataatgaacaaaatcgagtcccatgagagcatagtgtactatatgatagggtgggctgaaaacaccattgttctgctaattttaggcttgaaggtgactgggaatctagttaattgcaactgctgcaacataagctacatcagtcaacagattagcattgcaagtaggatgcaactacattgtgaccctttctttgcagaaatagatgataaggcacgtcgatatcaggctttgccgtttgggtagatcgctgctcaccaagattccatttggctgctcattaattatctgaaattttggttggcgtaggctcagagagatctaagtgggagctggttgtgatgttcagtattgtctacacttacgaaggtattgctcaccatgtccacaaggcttcagctacgggactagagaaagaaacaaactagccctacaagtgaactttacactcctctctagtcaagtttcactgtcgtgtgattcgaacatatgctgataggtatacttctctaatacttcgagaaataacatattgcaaacaaactaactaaatgaggttgttaattaacaaatgtttacaacatgttctagtcgacaagccttttcatgttcatagcccaaaagttacttgaagagctgaaggtacgtagcacaaggtccatcctaacgtacttgcagttcctttatgctaagaaggtatcttgcgaaggactgaaaaatactcaaatgataacactttcttcgttttgcctattcgcggaataagcgaaacatcatatttgcaaacgaaaagtaatttgtgaaaaaaacttttatatactttgttaaatcaaagtgtgtttgattgttattctatgatgaataattggcatatgagattattggttttggtatttagagattattggcgaagtgggtttagagatgattggatttgcagatgataaacagggactactggataattggaccgtttagaccggtcaaggtttgccggtcacaccagaggtatacgtgtggtcagaccaaccagcccgcggtctgaccattcgactatgtgtcggttttagtttcgggttatttcattggatatttgtggataatttgtgtttatgacttctagatggatactatgtgtacgtaatactgttgtttgctaacaatgagtcaagttggagatagcttgtgctcgagatatggtttcttgtttgattcatgtgtaggtgatcttgacgcctcgagatagtatagcggattgggagtcaacttggagataaggagacgtccggacggtcagatattatgtgggatacttaggctaaagatcaa

SEQ ID NO: 19179 - DNA, 247 bp, Oryza sativa
ttgagtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccatttta

SEQ ID NO: 19180 - DNA, 1501 bp, Oryza sativa
tcttggggtggtcggcttccgagaactcgatcttgtgctgcgaccacttcatcttggtggtagtcgcctgtgaagtggagcaaacttcgcgttccgctttcttgtactccctcttagaggtgtacaaagtggatccaccgaagatgtgggaaacatgcaaatcatactccgggaaggcggagttagagttgtcggtggtggcttcttttgcagtctccgtactcgctttcctctttcgattgctagttgtttcgtgagctcctttttgatgacgtagcaatcttccaaggcgtgattgcttgtcatgtggattgggcaccatggcttgcgagagtcgtcgccctgagggttggagcgcctggacggttctacttgctctgcggcaaggacctctccagaagacttgcgcttcccgcttttgcgacttctcttcttgcttgactctggtgcgtctttatcagtcgacttcttcttctcgtctcccgctttgctctttccctccttgcgtctcagagtgtcgtctgcgtggatgtgatccggcgcgttgccaactcttgggtggtgtaccgatctcggacgccagacttgaatgctcgaatgacagaagcgtcggtgatctcgaggatcgtatttctgcactcattgaagcgcagaatatagtcccgcaatgattcgcctgggttctgggttagtgcatgtaggtcgtcctcgatcgcgtggcgcttgtaagtcccttggaagttggcgacgaattgctgccataaatcttcccatgaacagattgagtttggcgggagatggacgaaccatgtaatgccctgattttcgttcgggattaaaaatcatttaataatgcttttctagaaattaaataaaagttaaagcaatttaatcaagtgaaattattgagggaattaaaaatttcctttaaaaatcatggccgggaatattttgtaatattctttgcgccctaaaatattctctgaaattttcccgtgaattttcggagctcaagaagtaattataataatacaaagttcattaaaccaattaaataaaaaagaaaacgaattaaaatcctcattctttgctttgggccgtttccggcccaagtttcctccccctcaggccggcctccctcctctctcctcccttcttggcccccaaggcccgtccccttgcaaagttcacttcgcctccctcaaccatcacctcctccctccctcgccgacaggtgggcctggcgaccccacctgtcagctcctccttctatcttcggcgtccagaaccaaagccgccatgacgcgcctttgtactcccgctcgcgtcctcgcgcccaaactgcatgaaattggttcccctccacctcctctgcactctccccacatttcccccaaaaatcgtgtcgggttcgagctccacttcgcccatgatgtcgcccatgtcgccggccgttgccacccgattccgccctctcggccacaatttccctcccccacgc

SEQ ID NO: 19181 - DNA, 1501 bp, Oryza sativa
tgggccagcttggtcgcttcatattgctgctggccaactaggtacttgagctgttgtgcttggctcgtttggctcgcgaacagctcacgggccagcttgatctggctcgttataacaaacgagctaaaaccctggcttgggttgttaataaatccaaatgagccaagctagataagagctgagtgagtcaatgagacacgagcttttcgtccagccctaatcgatggtgttttctcttaaaccgttttgtaatttgcaaatccctgtggtggagttgttccttggtttgtctagtttattctgtaaagtttgcaactcaatccaacggttggtttaagagaaagcgtgtttttaccgaacctctatcgtgctgtttttaggctgacggtcagatcgcgagaggacctgcggtcaaaccggccaggctttggttagacctaccatagtaggtcggatagaccaccgaatgtatattccattggtttttaatgttggggtgtgttttgatctatcaagattcgattatttgactttcgctggcgtaatctaccactcacccttttctagtagacttggttacttatgtttgatcctatataagaggaccttgcttcatcttgttttgagtttgcaacataagagtgtgtggacgtacctgcactcacccaccaaatgtaatcttggtgagcagcgatctgctcatgctcgactaagaatctcatattttcgcttatgcttatacttttcaactaaaatttgatttttcaacattaaatttgaagttgattttaaggtttttttatcgaagtttatttttcagtttttttcttttaaatcgctaagaacacgtatataaaaattttatccataaattaattacttttcattagaataagcgaaatgatggggccgtttcgcttaccattgcaattttggatacttcggcaaatataagttcatcgtcactctttagttgcatccgatactactttgtaataaaaaaaaaagttgaggttaaggtagataatgttcgatatggtggaagcgcgcagaataaactagattccccgttcctctcaggcctacaattggcgggtctttcttgcagttattggcgaagccaaacgttgacatgtaaaaatgtaccctgtgtcttctgctccatatatatgtgctctagcctcccactttgctccatatatcttcagctccataatagtaagaatgtctccagttggacctttcttttagtgttcctaactcatggaattccatttctgtcattacatgtcacataatgtaattctcttatgagtaaattgaaacactgataaaagaacttggaatgtgggtgcggtttaatacagcaacttgaaaagttcctctcagttaatgaactcatgatgatcgatgacattacttggtatgtctcaaacgagaaatcccactcaataaaatattgcgagctttgcaattgttgttaaattcagttttcaaagca

SEQ ID NO: 19182 - DNA, 1501 bp, Oryza sativa
tattaccgagattactttgtcatgggagttttcaagttgcatcgactcattgcaattgcagcaaaacaaactagagtttgttgttagcctattaccaatcggtagcaatacatttttacctttgtcatatgataggtgataacctattttctttaaagaaatattgcatggaaggcactcagacagattattttgttgggaaaaaaatcgcattagctgcagcctattactaatgtattattgattgtttttgtgttgctctgagaaaaaaaccaattccatatccataagggacgatgctcttggtattggagcttttcttgcaatcagcagacatatggaagttacaaataaaccaaagttaaattcataattttgttgagcaaatgtccaagaaagaaaatcactttaggtttctatattattacaagaaatttctaaattttgaggcactgtgaataatatcaagtttttagttatgtgtacgttgtatttgtcaccgtaggaatatttgaggggcaatatatttgtcaagcttaaatattgaatttcaatccatgtgcactggcttcaaggtaaacatgatttaagttatacaatacaactctgttaattagtgtgaaatcacatcactcatgttcttttgggattattgggatcaattgtttccagtgtgcaaggcctgcaagctatggtgctttagggtgctgagatattgcacaccccatgataattttccttctttcacaccccatgttattatgcctggacttgcatgaacactggaaggctgtcgtgtaaggccatgttggtgctctggatttttacaatttagtctttttgaaaaacttatcctaaaatgatcctttttgggcgccagagtcgctggcgccgtcgtccaacggaatggtggtgctgaggtggcagggggagcgcgccaatgtggctagcgccccccacattttttcctctcctctctagtgtagaggagagagagaggtgcaactttttgtttttttttacttttttatattttttcacacttatgagcataaaagaaccaaccatagaaaaaaaactcaaatggacgaaacacaatcttgcacgcggaatttagagattctaattttgtcgaacccagtaaagccaaggagaattgaatgtaacttttttcgtagatgtccgtagatatattatttgtctgattccgagtccgtatgagaaagttacgcctgttttaagaaatgacacccgcatgtaaaaaaacatgaaccctaactttttttatagggatgtaaaagatattaaaaaaaagctaagagtgttcgaaatataatctactttcttttggggggactataggaaaaaccaaaaccaaaacagggagagaacgccatttgagtttagtttttctacggttggttcttatgtgctcctaagtgtaaaaagaatataaaaaataaaaaaataagttccacatttctctctcctctatactaga

SEQ ID NO: 19183 - DNA, 425 bp, Oryza sativa
atcccagtttataaattatgtggatttaaattaggcattatcgcttcatttaaattcccgggttacccctgttttattaagccatgcctattttcctttgttatgcccaaaataatagttgtattgttattattaataccttgttcaccctagaataaacaaaaccccaactagtggacactctactcatggcaccactagtttaattttaggtagatgcttcgcaatttaattaggtaacattaggtggttttacaactttagactttgggaaatattcatatcacctggatcctttagaatggtttggttcttgtggaattggcttcacaccgctccttctattcaaaatccccaaaatggttttaggctgggctcggggtgcatggttttgatagtagcacctctgccatataaggaccggt

SEQ ID NO: 19184 - DNA, 1301 bp, Oryza sativa
ttacaagcaaaacacccaaaagacagtggtccaaaatatattttggcaattagcacagtacgagatatagttataaagttgagaaattttagagcccttgagaggtacccaaatttttagtgtaaatttggtacctctcagtagtactggaggtagtaagaggtatcaaattttatattagaaaatatatgacacctcctaatacctcctcaacctcatgtactgtaaaatcgctctataaagtttacacaaccactgagatgtgtccgcaaaatattggttttacgggattcaatacacaaataaggcagtacattttcattttagataggaatcaagctttgttataatttccattcaagttgaaaataaaaataaataccacacttcagagcatgtaatcggggtacaatagtgcacatggaatccatgttggcaagaaataaatcattgcaatggagaagaaacaaagcctcattttttttatcggaattaaattccctgagtagaatgacaacaatatatttacaatagatgaataatatatttgctttgttcttaatgaaaatacgtcaatatatattgttgtaacacctggtaggttcaataaataaattaacttaggatcttgtatcatgtgtcactgctatttagcataaaatataacaactgccatttaattcatctattcttcacttgaaggttgatgatgagagaaaatagctatatgcgaaatgatttgtcacactggtggagaaaccatctttggtcggtcggccgaaatccacaatagtcccagttccactaaaaaccgggactaaagatattctttagtcccggttggtaacatcaactgagactaaagatcatttttagtcccggttcaaaagacggcaggtggtgtcagacccctcttttatctttattcccggttggtgacaccaaccgggactaaagatctatttttagtcccggttggtgttatcaaccgggaaaaaagatcgacatgcgccacgcgagatcgagagaactgaggcgcacgggtggatcagttaataagttctgatctttatctcctcctctcctcactcaccccatctcttcctcttcctcctcccatctcttcctctacctcctctggatctgcccccttccctctcctccccacttctcaacctcctttggatctgccccctcccctctcctccccacttcttaggcggcggcggccgggcggcgcggaggcgccctcacgcggcggccgggcggcggcggaggcggcctagcgcgccctcacgcga

SEQ ID NO: 19185 - DNA, 297 bp, Oryza sativa
gggcgggctattggaatagattttcctctgatcagaggtgtacatctttacccccaagacacatcttcctcacgtgcaaccacgtgccacataccaccacggtatacagacggaagacgtgacatagtttccaacccatcctagccatagacaagagtaccgacccaatcccgcctacgcccggaacccccgggacaggcaggcaggactgagcccctagcagcaggacaccggccctgtgccatgacatctcgactaccgggccgcagctcgtgtagccttcatttgccctggaga

SEQ ID NO: 19186 - DNA, 1501 bp, Oryza sativa
ggcccctgttccataaactctagtccccatgcgctctgaacgtaacgttatcagcagcgagaggagttctggtgttcccgaggtttttagagagaactagttgagagaccccacgtcatctcaaccaggtttccataaaatcacacacacagcgatcgtaatataatcaagatatttatctgcgcctcggtaaatatcacatttgcccttcgcggcataagtttgcctccttcgcgaggacttagataagaaccactgtacagagataccacattgttaattaacctaataactaggtctatccccattctagaagctgcggtcgtactcgttcgtttgacataagtattcggtggcaattatatcgatcgagacagtactagccacccggaaatcaaccaaatcttacgtactgtcccaatcgaagttcattaaattttatgcatattctaactaagcatggctaagcaaaatctagcatatatctggtttgctatatgttcaggttatgcattcaaaatcatgaatggctaatgcatagaataaagctatagagtataggataattatactcaaaggagaggaataataacttgccttgctccaacgcaaataaatccaagataggcaacctgattatccgatgctcgaaataccacaggttgccatccagaataaaatagactctattaaagaagaggaataaccaaattcaataaaagccataaaatagcaagaaaatgatgaaaggcgagaaaagctaggtttggggtataactatctctttaatgggttattgagatagtattttatgcgtaggctctagttggttggaggctaggttgaagagggaatcaagattaggctttggtggaatagtggctagggtttagttgttctcgagtcgatgctgaaataggatagcatatcggctcgtatttcatgtttaagctatgggtagttggaggataaatggctggtatggagtttgaatagcaggctggatggctagggtttcatttgattaagccgatatcgaggtaggataaacatcggcaagggttttgggtatttgctagtcgtcattagaattgggtagtatgacgactaagtttggtatcttctctagccgatatcgttggacaatatatcagctagagaaataggaggtgggtgcaggtttagtggggcggaagtgttactccggcaaccgtgggtagcgacggagcggctaggattacacagagcttaaaagctaactgtgtggtgtacagttgaggtcgactgaatagtgaagctctgaacgttatacgcattgaggcgtaaggtgttaggagcaacacttcgactttagatttgggttttgtctgactttacaaccaacggttcgacatcggggggtcagtagaccgtacgaacgtccccatggaaggtgtaaagtttcaaacggtggttgtttagtggcaaagggtaatttgagctaaaagaagatatttgaaaa

SEQ ID NO: 19187 - DNA, 673 bp, Oryza sativa
tggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccatattattattgttattgttattattattaccttgttcaccctagattaaacaaaacctcaactagtggacactctactcatggcaccactagtttaattttaggtagatgcttcgcaatttaattaggtaacattaggtggtttttcaactatagactttgggaaatattcatatcacctggatcctttagaatggtttggttcttgtggaattggcttcacaccgctccttctattcaaaatccccaaaatggttttaggctgggctcggggtgcatggttttgatagtagcacctcggccatataaggaccggt

SEQ ID NO: 19188 - DNA, 910 bp, Oryza sativa
taaaagctgcttttgcaaatgaaaccctattatgccatcctttgttatcctgtgcacttgcatatttgctgcgtggcttgctgagtatgtcatatactcaccttgcaattattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacaagttggtatcagagctcccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttccagcaaaaattttacaatgttgtttcatttaatcttgctgcaataaaataaatttaacaagttgattttataactttcttttatttcttttggaacctgttattcaaaagtataaaacttgtaacctggtttccaactgtttcaacttatcttgcaaacttggtttactttgtttacttaccttttactttgaatttctaaaactttattcaaattaatccaaaaacttgtgatattaattggatagatgtcttaactccctcctttcacttgtgtttaga

SEQ ID NO: 19189 - DNA, 440 bp, Oryza sativa
tttttgaacataaaaaaatgttaaacattatgaggactggcttcagtcttggtgtatgatgctttcacagaaacaacatgatactatatgcaatgatgctacacgctcggcattgatagccaatgaacttttatttctatttggatagcatagtgcctataaaattttgtaatagaatctatgtgattttgaaaatgttattttggtagattattttattgacagaagttgggggtttgtcccatcacgcctttttttaattcctttttttttacttccgatactttttgatgtgtgcttacgggcagagatcggatatgttatccatttacattatctaaaaaaggtaaatatataagttcacattcgatttacacgactggttaggagaaaaacaaatttaattgtaaatagtatgcgctaactattcacagttaatt

SEQ ID NO: 19190 - DNA, 238 bp, Oryza sativa
ggctctgcaactatactcctatacactttgcccgctgcttcttctttttattgtcattgagattttaaaaattgaatatgattatcaatggggtttattttttgtctttctagaagtcccggaggctctgcaactatactcctatacactttgcccgctacttcttctttttattgtcattgagattttaaaaattgattatgattatcaatggggtttatttttttgtctttctaga

SEQ ID NO: 19191 - DNA, 1501 bp, Oryza sativa
gtgaaacccgcgcgcaagtttaaggaccggccatgtattttactgaaaggaaatattacaacccgtgctctccctcgtgcctgcccctcgtgcgtgtttcttcgtgggccaagatgtagcccacgaaggccacaactggcaggatcgttcctgggccaaggtgtagcccacgaaggccataactggtaggattgtcgtagctaccgtaatgccatgaacgtaacacagaaaaagttcatgacaaaaagacgaggaacaagagggatgataaaaggaggaacaagatccaacggagaaagagtgagaaaaacaaatctggagaggatcaagcatcaaaccaccaaagatatcatgtaaatttacatctcccacaaagatcacatatctgaattgatgtttcatataaaaaaagagcagattcaatcacaattcacataaagttatttccaaggacccaataaaatcatttttactttcaacatgtttcatcttcttcttcctgatgctgtatcaaaagaataaaaagagaaaaaaaatatcagtaccgttaacttgcatctgagatgcgtgtatcaaaatgttacgtctggatcataaaaagttatttcttgcagttgtatttaccgagcttcatctcattattttctaataatacaccaaaagagtaaaaagagaggaaaaaaaacatcagttgtgccaagaaaagttacatccaagatgcatttgtctcaaaagttacttatatgtcatctaaaatttacttccaggaagagttaaagttacttcctatgtaaatatgaaatacatttgccttaacaaaaaattaaagacacttattattttgatggtgtgaattttaaagttacttcttatataattttctcttaaattaatcatccgatttacgatccgattacaccattggattcgaaacaattaaatttttataacaagatctcacatgattatatcttttatgaaaaaaataaaaattacttttagatttcattaaattacttcttagttataaaagtaaattcaataaagcatgaaagtaatttacatgtattatagaagtaacttaaaacaaaagtaaagtaacttgttacgataataaaagtaaatctattatgggggtaaaaacataagtctatctagtaattagatttaatctacatatcatagttacacacacaacggatttacttataatatcgtgacaagtatgtaaattacttttaggttctattgaatttacttttatatgtctgtaggatcaaggaggccgactagaggggggtgaataggcggttttaaaacttttggctaaaaccaagttttgtatgcggaagcgtaaatcaaaacggttttgcacaattcaaaacctaaatcaactagtctcaagtaagtgcacaaagaagctagcctatgttaaggtttgcaagcctagggtgataatagcacaaataagctctagtatgtaaacttgctcaaatgtaaa

SEQ ID NO: 19192 - DNA, 151 bp, Oryza sativa
cgagctcgggaccccttcaattggtataatagtagagatgaagatatatcacttcacaaatatataagttttaatgcaaattttataagttgtagaaaattacaaattaaattctaacttgtgtacaccgttatctatacgatggggagaa

SEQ ID NO: 19193 - DNA, 1501 bp, Oryza sativa
aataagcattattagtttttaagtaattaaaaccgatggaaagggtttgaacacaaataaaaattttgtatttaggtccctttccgccctttgggagttaaaaatcgccctcctaaagggcggcaagcgattagatttgtaaattttcgaaaaaaaattatttttgtaaatattttaataaaaaatgtataaataaaaaaaattctactagggcagcccggactctgcggcctaggcaaaaacggccgaacggcggcgctcgacgcgcagaggaagaagggggacttcttgctaggccgtgttggcggctctggtcgacttggcttgctaggccgggccgggcaagcgggctgccgggtgggctaggctgggaggaagaaaaggaaggggatatgtgaaaacttgagggatcaaaattagactttccagagagcaagttagggtggaaatggcccgagctaggcttcctaggcatgcaatctggacttttaagaaaagcctttgaattagatccttagcttcacaaggaggtttttagaaaataaaaatattaaatcccttttttttgcaaaacatttccttggaggaagaaatcctaaaaagaggtttgaggaaaataattattatttgcttacaaaataattaagggatcaaaccttagaagggatttttagaaactaattaacacttaaattcattcgtaaaataactcacaaaagggatattaatacataaaagagtttttaagaaagataaatagtatttactttcattcgagaataattccttaattaattttattttataatcatggttctttaataaatattattctaaattaataattgaatttagaatttgcaaataatccttcaaattaatttaattaaggcactagcacaacagggaaggaaaataaaatctaataaagaccagcatgggaaaagtttgaaaaaggtttttgattattccaacttttgtttccggattttaaaactcgaaattttcagggtaagttggaataatcaaaaggacgcgactacaccgcgcatggtagcgtaatagcgctaatgcgcgacgtagattttccaaaagtgttttccccgccgaacgcgcgatattccgaaaaaggaaatatgagtaaaatacatggccggtccttaaacttgcgcgcgggtttcacttaggtccataatcttgcaaattgcacagtcaaagccaccaacttgttttaatgattcagggcaggtccaaaccccacttgaccggctctgaccgccaacgtggcacgccacgcaagcaccaattttgcaaagaagcccctccgcaaacagtagcaccatggcggacacaaaaatccccaaatccttcgcaaccatcccattctagggttagcggctagccaggctgttgaggcgaggagggataggtgtgcggcggcgacggagggcggcgtgcggcggcgacagggggcggtgtgcggcggtcggaggcggcgagg

SEQ ID NO: 19194 - DNA, 1501 bp, Oryza sativa
tttagcactccattgcattatcttgaacccttgcaagagctctcacacccttgtgcacttagtttatctagtgaggtgttggagagtgagttaagccaatccaagtgcattgcttcattgttagagctagtgtggtacttgatcatcctcggcaagcatcctagacttgttactcttggaggttgccgcctcctagacagcttgtggaggtgttgcccggtgacctctccgaggagattgtggaggaggcccggcgccggttgtaagtggtttggagttcaccaccttcggagtgaaggaacaactaccctagtgatcgaggcttgggtagtcctctccgtgggccggctcctaccttgcccaccccttgacgaagggggcgtgcggtggcttcgtggttgagcggtggagttgggctcgcctcaacggggattaggaaaccggcaagtttccgaacctcggtgaaaaattccttgtctcttcatttatttgttgcatttacatttgagcaagtttacatactagagcttatttgtgctattatcaccctaggcttgcaaaccttaacataggctagcttctttgtgcacttacttgagactagttgatttaggttttgaattgtgcaaaaccgttttgatttacgcttccgcatacaaaacttggttttagccaaaagttttaaaaccgcctattcacccccctctagtcggcctccttgatcctacagacatataaaagtaaattcaatagaacctaaaagtaatttacatacttgtcacgatattataagtaaatccgttgtgtgtgtaactatgatatgtagattaaatctaattactagatagacttatgtttttacccccataatagatttacttttattatcgtaacaagttactttacttttgttttaagttacttctataatacatgtaaattactttcatgctttattgaatttacttttataactaagaagtaatttaatgaaatctaaaagtaatttttatttttttcataaaagatataatcatgtgagatcttgttataaaaatttaattgtttcgaatccaatggtgtaatcggatcgtaaatcggatgattaatttaagagaaaattatataagaagtaactttaaaattcacaccatcaaaataataagtgtctttaattttttgttaaggcaaatgtatttcatatttacataggaagtaactttaactcttcctggaagtaaattttagatgacatataagtaacttttgagacaaatgcatcttggatgtaacttttcttggcacaactgatgttttttttcctctctttttactcttttggtgtattattagaaaataatgagatgaagctcggtaaatacaactgcaagaaataactttttatgatccagacgtaacattttgatacacgcatctcagatgcaagttaacggtactgatattttttttctctttttattcttttgatacagcatcagga

SEQ ID NO: 19195 - DNA, 1501 bp, Oryza sativa
cctgtggggcagcaacgtcgatgaggccaaattctcgatgggtggcgatggcgacagtggagcaacggtgggcgtcaatgattgtggggtaggcgtggatcgcagatgatttgggggagatctgcaaagagggcgacgtacaatcgcggacatagttactgatgaggagaagggggagccaaatgttctgagtcgttggatgtaacacaaatgaatacatgccggtggatttgatgaatgaagtatgacggatgtaggactgtgttgatgaactatagggtagaatagtgacatatttcaacgtatgtcttcattgtgtttcaaaaaattcatgcaactaactgcacatattctctgtcctctctctctactctatcaatgcaatgcatgcatgcatgcacttagtgattttcaaaatattttttctcctaaattacttgtccgatttatgattcgatcacaccgttatattcattgtaactaaatatattttacaacaagatattgcatgattatattttgatgagaaaaaaaacatatgtttcaatccgttccattgatgttttatacgtgatagcggatcacaaaattttaaatgtttcgttgactaaatgggttgttatagccgatactgatcaaccaacaatcaacaccataactgataaaacgtacgtagtacctgaaactgaaggagacatagaggtaatatagtgatcaaagacacttatttactgatagacctcatttgaatgcaagacaatggtaggcaggcaaccaccatcaattagtagagcgaacaactgcataagagcacatttttggctcctagcttggtgcttccagtatggaaaaaaaaagaaagctaatcacaaacaaataaaccgtcgaaactaaaactgtaatacccgtgtagaattggtagtggtttgccattacaaaatgttggagcagcctgaatcaactgagaaggaaagacgatgagcagtccatgcacggccaattttaacaataacattcaccataaaaatgctataagtatgtttgtttatgttgcaacgaaaaacaaaatggaccttgggccaaggctatggatctacctacagaggaagctgacaagccacaatcactagtaaatacgcattgacgatgctagacggttgtggcgttacgtcatggcgatcgactatgctacttgaaagttgtttttgatagcaacacggtttccaaaacataactttaacttcttatttctataaaaatatttattgaaaagtgatatgcataattttatgaaagtatttttcaagacaaatttattcatataatttttatatttttaaactcaacaactcgagagttattaatgatttatatttctaagatataacttaacattgttataaacgactttctttacgaatatgaagttagtatatataagtagtactagtatgttggctccccgaccccgagacggacgaccgcatggatgagatgcaga

SEQ ID NO: 19196 - DNA, 874 bp, Oryza sativa
atgctaaaagtttttacattgtgaaacggaggaaatagcttggaatttaggcttttaattagctgttactgtattttgaaagttcggtgaatatactttagcaaatctgaaaaaaaaaacacacatgtgtgcatgcgagggcagggagcaagaatccaaatggtttaattgatagaagagcatatcttcacacacatttttttttaaaaaaaagagaataaaaatcccagcctctacatcataaatgtgatgcaatgctatgccttgctacttattatagcattgtacttcccccgtttcacaatgtaagtcattctagcatttctcatatttatattgatgttaattaatgaatctagatagatgtatttttcacgttcatattgattttatatctatctagattaattaatatcaatattaatgtggaaaatgctaaaatgatttacattgtgaaacggagggagtagtatacttgtagtttaccgcacatataataaagcagtaaatgatcatacgaagaacttcacacacagtaaaagaccaaattagcttcagagaccgcactactagaataccatgccacccacaagatgagcccaaggctgatattgattgtggagattatgggtaccccatacccatatggcgtgattatccgactggttataagggataacttatatctatgaaatatgtaacggatcatgacttgggtattacgtttccctatatattatggaacggcctaaagtcctggtttgataagattctaaagtagatttaggaaaccgataccgtattggttaaggtttctatcttgtaatcctgcccccatcctatataaggtgggcaggagaccctttagggggca

SEQ ID NO: 19197 - DNA, 1153 bp, Oryza sativa
cacccaaaaattcatccgctcaaggcccattttgtgactaattgttgattttaaaacgtttatgagacacttactaatataatgatctaattttgttaattttatacttgtactgtatatttgtaatatatttgtaatgttacatttatgatattgaaaagtttatataaaattggaccacccatacctaaaatcctagatacgccgttgccaacatgtaggtccaccaatgccgccacgcaccagctgcatcgggggttcgatagcaaaggtacagaggcgctgcatggctggaggagttgagcaagggatggagagggagataggggatggagggtggccaggtacgcagacggggacgacgattggccatacacgggcgtagatcgatgggcgacagcgaactactccgtcattgctattgattgggaacagagcaaaagaagggaatgaccgaatagtgaacaaatgaacaagtagaggaatcggacctctatctcccagtgtcacaccgtgattttcttttatggatttaaaaatcatttactattattaataaaattcatattaaaaagtaaaccaatttacaagtgaagttaatgtgggcaataaagtttgtttaataaatcatggctaggaatatttgtcttgtattctccatgtcctaaggtactccctggaatttttagaacttaatgtctaattttaatagcacacagttcatttcagtaattatttgattctttttggtgaagcacttatttaaactaggtgaaaccacgcgcgttgctttgggagtttactatgaaaacaataactaaaaataatatgtaagatagcttaaacaacatatgcttacataaatatgagcttacataaattgatgtatgttgggggaaggattccaacccttatgttaccctcccccccctcccacccccgctcgcggtcacccgaggggactagggcctccgcttcggaggctccagccacaggcttgcagagtctgcctccgcatgtaaggccatcatcagaagcccaacagagttggttcgcatggatacggcaactggcgctggaggtctcggagccaactcaagggctccggagctctcaccagggctccaaagccaaagcctaggatgaatcccaa

SEQ ID NO: 19198 - DNA, 1201 bp, Oryza sativa
catttttttataaaatagctaaataccaagttcaatcattttgttttttcaggtgggaatgaagggagaagacatgcttgattcttccaatattttggcacatttgagtggaatgaacccttacggctataagtacaacagcactgtggaatcctggatataattctcataaacacacaaattaaagtgtgttttcctttcaattgtgcaagcattaaacacagttttcccttgctcccagtaaataagactgatgctttagaagctctattcgcaagagaagtgcttaggtcaagttattgtttctgcacactactgatttgtaaatagaattgtttccttgtcataatagagataacaagtttcaagatttgtctcgcaatttttcgatgttacaaattcagacatggtccactagaagtattcatgggaaagtaacacaaaacacaatggtcacaaaccagtaatatcagcataatctcatagcacgattaaacccagctaattcttatcatccttgtgggaagaagacccacaaatccgaagccagcagaagaatgagtaattggaaagtggattgcagttcataacatctgccgtttctactcaagttcataaacatctgtcgtttctacttacacagtatgagtgtacccatattgaagagaaaaggagcagaacttgagctgggcactattgtagtgatacaagcgcacgaccatacggggatagagaaaaaaaaactacaccataagtacgctatctaattaatgacagcactactcgatttaacaaagataactggtccaacgtcaatttcaacactaggaagaaataatctgaataataaaagaaacaggtattgagaacattttggcctctatccaagtaatacagggcatattctacaagcataaaatgaaaaacaatactttcaaaatgtttatgcatggaatcgtggatgaagatcaaaaacaaaaatcagtgacacttgagttacaaaactcaaatgccgaaaaatgcgcattattctattccagactgataattcaaccttttacaggacagatttagtaatgttaaatacttgtaaatactggccactaaaaaggtagacatcttgtttaattaattcttgcttccattttagttatcaaagcataaactagaaatagaaatacaccgttgctttagggtggaa

SEQ ID NO: 19199 - DNA, 1501 bp, Oryza sativa
ttattaatatatatttcgatctaagtgatttatactatcccggcatgacgaccgatctatcccaatcacttgatttaagtatatatcgatataagcagtatatattgttaatatctacagctgatcgagtagatttagttccttcttacttattcatgattgttgatcgatacatatatgacatcgactcaaagataaatgatatgtcatcggcacttagccaatctgctatcgttgatgggtttaaccgcggtttctttgtctttgtttcttgttgattacaagatcaaatcaactggcacactagcatacccgaaggcgagttttggacctgccctggagttaagcagatctcccaggcctcgtgttttacgtcaataagagcacgcggcggtggtggcctcgtgcggcaggcggcctgcgcggcgggcggcgaggcggcggcctacacgtatccagacgtgattcggcctgcgtggcagtttctttccttttttatttagaatttgtgatttggatctgagatgtatttgatatgtgtgtgatgtgaatatgtgatgtatttgtgttgaattttgtagaacttgtgatctaatttttttaaagattttgtgatgtatttggagatgatcgatttgaggattgggaggtgataatcgatttgagacgatttggagatgattgatttgggatctggggatggggatagagtgaaatcaatatattgcaaacaatgaagaaaagaaaaaaaaaggagcaaccggacctagcctggctccatcttgttatccccatatctctaccatggaggcaccccctaggcccaaatagaggaacccccctcccctcgtccaaaccaatttagctaggtccagccgtaaaaataagccgagtgcttccccttgaaatcacgtaagaaagccaagcccaaccgttagagcaagtctaataatacagccaattactagcgatagtagtatccaggtcatctaaagcctgcaatagagccatcaaatacaataacttagctatagtaggatggcccaccaaattgtataagagaataactaattgtgacaaaagcacacgaaaccttctctctctaccttatcactttctctgtcgcaccagccaccatgcgccatccattgctttctgatctcttctatgttctctcccatcttcttcctttgttttttgtatgaacacaagcagcagccggcaggccaagcttgctcttgagcttatcgtagaccgcctcccgagttcttgcatgccacgccatcctgcggcacctcctatcaccgccatggcggcatatccttgagctccttcaatcatcatcaccgacaaccttgagctttacgtgacaagctaggaagcagtcgcaagtgagtccgctggttggaggcctagagcaagctaagcaatggtgagacggtagcgagtaagcaaggatatgatgatgaacccacgacaatcttaagctcctctcctcatc

SEQ ID NO: 19200 - DNA, 991 bp, Oryza sativa
ccaccccttgtatacgccagtgcatgttggcgttgttttaatttgtgtctataccttactctccctctattgagaaatataagatgtattttatttcgttagaacaaaaatttaaccaacaattatctatcagaacatacttttttatgataaaaatgattttattatatttgtatttaaaattacttacatgtgattatgcctttatcacataactatttatattaggtggacaattattagtcaaaccttatcctaatgaaataaaatacgcctcataataaaaatggagagagagtattattgatgcttaggataaattttggtcaacgatttaaatttcgaccataaataatttctcaaatgcttagttttttttaaaaaaaaaggtatgcataaattagcctaattaaaaaaactattgtacaatctcataaaaatatatacttactaggttttataaatttctaatatgaaattcatgattggaatcacatgtactaaaattcatgtttctaataatatttgattaaagatttgatcaaatcttatttcaaatgttaatatttatgactgagtatatggatactcatgtgtggatttactttaagattggtttaagctttccagctacttgtgtaacttacctttgcacgtgattgtttttttttttgccttgtcccagctccaagatcacatttttttctggatccactgctgagcaaatctaatagaagggagcagtatgcgtcaaatctggcgagaggttgccgagtcttctttcccctccccttgctacagtagtttcctttctctcctgtttcctggcccctcttcccctgattccggcggttcaccatcggtgagtgttggaggaggggtccggccatctaccctactagtatagtgtagctaggctcgtagtttggttgtcaggtctttcctgtggttcgggtctgtctcgtatgagtgttttgctggtgaggagcca

SEQ ID NO: 19201 - DNA, 1151 bp, Oryza sativa
taatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatgttgcttgaaaaatattatgcattgataggatcgcacttaatctgtttgtcccgtctgcaaggcagattggcggacctacctaatttgttgcatttgatccttcctttgttaattgttataccatgttcccttgtaaccacccagttgtgcctcggaaatcgtgcactctgcacgagtatcgacggccgccttcaaacttaaaatctgaaaaacttcttgggtaaaacttgggttttacaaaagacttggaaaacccgacacctgggtcggtgcttgcgaactaaatgaatttcccaaaaccgcggaccggggaacgtaccgggtgtacggtttcccgctcttgcacttaaggacccctttccttggaatttcatccaaacataagacaagtacgaccacatgggtggaatgggacacccctggctgaataactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctaggtgatccgggttagtaatgtcgtgtgggtaaagtgtgccccctctgcagaggttaacaatctgttcgaacagccgtgcccacggtcatgggcggatgtgaggtgattcctagcgtagttttggttgactactgcttgtgaaattgctgttgtggaaaggggttcgatgtttgaaaaatctgcagctgatgggatcagctaggcccaggtggccgtttgaaagttgttggcccgagtggccgtttgaaaagctgttggccgggtgttgcacatactccgaccggacgagacgcactgtctcatccgcgtcgtttgagaagcactcacttagttgttttt

SEQ ID NO: 19202 - DNA, 1501 bp, Oryza sativa
  unsure (1)..(1501): unsure at all n locations
ttgactgtggtaatccggtgtgaatgtagaggtcggatttcaattattttttaagaaaaaaagaaaatttagaaaaactaaaaccatgagacagaaaaatgccaaagggaacattggtttttagtcagcagaatttccaaaggcgcaacatgcaaaaagaaaagctcctttcttttcctacttggccgccgctcgtgaccaagctctcttgtccctgtccgtccctccactgcggcgagtggccgaagtccgtgccgtaacgttcggccaggagcacgatgatagaaaaaactaaccaattcagcttccgactgaagtggggaataaatctccgcacaaaccctttacaactcgagagaatttagaacctatcctagaagtaatcaaggaaacacacacgcgtgtcaagaactgaacccaaaaaagaattagccgaatccgagttattttagtgaaaaaaccgtttcttggatgcagtagtctagttgcagctagttgtgcgctagtctagtcgtcctcttcacatggcggcctgcgcgtaggaaccgagccttttcttcttcttcttcttcttcttctccactacaatcccgggtaatcttgccattcccctgtctcgtctctgccttttctgcgccaaaagttgtagtaggcttgtgggagtagtagtagcttccctgaattctgcacctgtttccttgtcctcgcgctctgctgctcttcttctcgcaattactccttgccgttcttgatgagccattaatggtggaggggagttataagctgcccagttatggaagttttgctgatctgatgcggtggtggtaggcgtttcgatcctttcgcgagccggttgttccttggcttgcaggcaggcagggatggaaactgtagcctacgcctcacgcgttgccgagagagaggcagctcatttgccgtcgaattgatggaaaagagagcgtgagtagtaaagaggacagctttttccttaacgcctctccgtgtgctcctctccgttctggaaatcgatcaagcggccagccatctccatctccatcgtcttcttcttcttccttctcctggagccctttgggttttggtggtgtctgatcgtctgatactctgattgctagttttgggggattgttactagtgcaaaaagctgactgttttgtctcttcttatccattctagtaagtggtactcttgtgccatcggcttgattcttccttggtccctttgatatcttggtttaggtcctaagtcctcttcacctaatcttgtttttcttttgttccttcggttggtgagtcatanggctattctttcccaagggggggtgttgctcggtcttatataaccttccagtcctcttgctctttaacctgttcttgtacacttcacattagtccattttccttctgtttcccaaggtttttgttgcaagtgcacactcttctcatcaacaagaggtgttctgctctgtgttgggaggtcagga

SEQ ID NO: 19203 - DNA, 1501 bp, Oryza sativa
taggaaactaagatttcaagtcagaccatctcacatacaaccattaaatagccgacgttggagaataattttaaaggctctttcgcttttcttttcttttctttttttcttttctaacttgatcatattctgtctgccgttcgaatgaactaagctttctttgcgcttgctcgcacacaatcccatcttagggggccaacagcacaacgcaagacaagcatgtacacacaggtctacaacatacattaaactatgtttataacttggcaatatattggatataagccaagaacaagaactctgcccttaattgttgggtgaacgatatctcattctatggaaacctccggtttaggtatgaagttattcagaagatgtcccgatggaagtgccctggaatcgagttggcttgctgagcttgcctaagatgcatggacagtgcatagttgtttacctgcacagcaagaaaatgaataaaataaaacatcggtagccagaaccacttatgatgcttcaaaaagggccaataaacaagaatagcgaaaacaactaagattgttatacctccaggcttctaatttgctcttggtactgagcaaccagctgcttgagttgctgaatctcctggtttctcccatcatgctccttttggcgctcgtgctgaattgcaacggctttctttagaatagtattttccctggttattgcttcaaactgttccttatacacagagctttcctgtttgaaagtaagaatatcagagagaagttaatttattttaaaacttaccatcaagtgttctccatagtaaacaatagattataatcagcacaaatctgcagtgcaattcagttcataaccattggaagttaatcctctggaaagcatccaaataaaagatgttaaaagtctacgtggtaatccatcatagatattcatgatgtttgatccctcaaggggatgtcacctcgttgtttgcatcagtcaaataattatgaaaacaaattgagaagatgtattaacatgtgatatactccacaaacatgcaaattcaaattcaacttatacatctcgcaacgaaaaaaaaattaaactacagctagttaacacatattcagtcaaatttgtttttttttctttgcgagatgtagaagttgaatttgaacttgtatgtttgtgaagtgataacatgtcaatacatcttctcaaatttttttcaattttttttataactttttaagtgacatgcaaacaacaataggacatccccttgaggtatcaaaatccactcccaactcatacatccaagtcaatccatgttttggcatccccaaaagttatttaactagcctagtaacaatagttggtatatggctatatgcttgatcaaatgtgtccatattttagaatcggtcctcaagatttgaagttttctgctggccaaagtatcattttgcttctttttttttacatttagtttatccatctatatcatgtcctg

SEQ ID NO: 19204 - DNA, 846 bp, Oryza sativa
cactgtccttcgtcatgccttgcagtgaacgttggggaaatggggagccaactcctcacgttgattcatagtgaaattttgaatctttccatgtcgagattgcattagcacctcctgtttgaaagggaaatgcagtatgcagatgcactgtgacgaagacaaaagatgggcaaaatcaccatggattgtctgggctgtcttctcctcctaacatcacaattcacctcgccccactttggaattttggattggtggtaggcaccttatgcaattgttcttttttttcttgttaagagtattaaagaatcatatccacccgaccaaaatttcaaagtgaaacccatcatcaacagtgttttccccagaaaaaaactgaagaaatgagagattgcacatggtcatgctagtacctctaccgcgccacttgcaagcaacagtctcaaatctgaacagccaaagtgccacaagtcatcaaccagacagggctagttcaaaatcgttgacagtttcccgctgaaccgttcacctgtccaacggactctcttggctcctgcccaacatttcttcaggttcacccaaaaaaaaccctgctgctgaatttttttttaaagaactactctccgtgcataatttttaccgatcacaaggggatagaagaatattagggacagattctgcgagataatccaaggtgtgagactttttactctggattctcctccctgggcgtgtcgccgtgctcagaagatgcagaggaggagagctggaaagacagtagtaccaaaatctgaaagagaacgtaggcgcagcagttggggtgaaaacagttgaacagctacgaggaga

SEQ ID NO: 19205 - DNA, 249 bp, Oryza sativa
cactgctgaaactgaaagcaagtagcctactgaagcattagatgttggattctagcaaaattagtatcagtacttgaaaaacacaagccgtacaggcacgggaaacctgatcaagactgcacgagatgtacataggaaaaaaggcaataccgaaccaaatgaatttacaagtgttgaattatgcttgagaaaccagaaaactgacctctgggatattctcaactctcagtctctctcacttaattcaga

SEQ ID NO: 19206 - DNA, 156 bp, Oryza sativa
aggatcaattggagggattccacccccaaagcccttgtcagtgtgaataccaaaatagtaaattgttctctttgtttttaacttgaacctttgtgaaatacccaatcgcaacaacaaatcattgcacttttgtgtttttgtttgctaccctacaga

SEQ ID NO: 19207 - DNA, 204 bp, Oryza sativa
tttttcggccgattactcacagactttatagttgcagaagaagaaaattgctgtgaaaaagaaaccagcagcaacaattctcaaaccggctccaccagtaagttattttaattcttttattagttgattccagccgattttgtctaacacttgtctcttttacaacctcctccttcttctcctcctgtgcaacaatcatcaagt

SEQ ID NO: 19208 - DNA, 1501 bp, Oryza sativa
gtgacacgaaggaaagatcggggtttggaggaaagagaccgatccgattcgacctcgaatccacgaatttccaaacgattttagccggtgattccaaaagagaaaaggtagaggagatcccgaagattgtttcccctcaatcgatttcaccggatcgggaaaggagcggccagatttggaaggagacgacggcggcgcggcgctagggtttcgagcggcgaccgacgcgaggaagacgacgaacctgacaggtgggacccacctgtcagcgaccgagggcgctcgcgcgggcggctgcgactgcggactgggccgacttgggccgagggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggcccaattttatattgagatttagcaaattaaaattagatcttctcttttaggcttttaagatcatttctaataaatccttttaaccaacaatttataatttaaggatttttaaacaagaaaagctcttaacaattataattagatcattattgatcaaataattactgaactgttctttgtatcatttaggaattgagctctgaaaaatccgagaaattttcagagagttgacttaatcatggagaatttaataaaaattaaatccatccatgctttagatttaggaaattttatttcccacatttaacttcacttgtaaattaaagaacatttaatataaattctattaataatttattaaataatttataaatcctaaaacaaaaatcaggatgtgacaaatctaccccccttacaaagaatctcgtcccgagattcggaacggctagaaagaaaagggaataggtaaactgcagtctatcttattccataactccgataattattctaaggctttaaagaaaactactgccgctttgaaactggtggctgagttgtaacacttgaagacacaactggcaccgcattggctcctgtgacgacaatgttgtagacctgaccttgcggctgctgatgcttcggcttcggacactctcttgcaaagtggcctgccttgtaacaattgaaacatacctgctgctcccttccactactgttattctcctgagactggtcctgctgaactggcaccggctgattagcttgctcgatgttaacttcattgctttcattagtctctgatttgatctcaccaccgatgttcaactgttgcgactgtccttgaccagcggaaaaaggttcactaatttggagtggcttgatacgctgtctctggctactaccttgtgcctcctagaatacagtcattttccttttacggttatccatcctgttcttcttgtcttcaagtcgaattactttgtca

SEQ ID NO: 19209 - DNA, 1501 bp, Oryza sativa
ttagatatgaattttagaagttttgagccattttaataaatttctataattattaccaatttatgacgcaattaataattattttctcaaaggaaaataggtgctcgctgacgtcagcaagaggaggagcgcggaccacgtccacaaagcggggggcccactcgtcagcgggtcaaaggagttgctccaccatggaccgagtccatggtggcggtgcacggccaaaggggacggcggtggctcacggccggacagctaagaggcggcggcgcacagccaccagcaatcgacggcgagcggtggcgcgggaagcgatggaagggatgggaggaggagagggggatgcttaccgagcgacacggcaacggagggagatggccgacggagggaggtggcggtgagctcctcagggtgaggacgatggcggcggtctgacggtgtactgcgggcgtgaggtgacggacagcgaccgggacgacgtcaacagggagaagaaggctggagcggtgattggagccagtggagcggtggtggagctaatggtggtcgtggcatgacttggggtggtcggaagtggcgacgagcggcagctggaggtggcaaatgtgtcacgcccggaaattcactagtaatttccgaacttatctgtgcataaaatcctcgtccaggaatcagccgaggtacacaaactgacaatttaatatacagattcatcaaattaactaaaacaataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaagtgagcatatgacatactcagcaagccacacagcaaatatgcaagtgcacaaggataccaaaggatggcataatataggctcatttgcaaaagcagcttttagcaaaacatttaagagaagtaaaacagtggagtaattaattaggaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataactgcgggcacggctattcgaatagttttactctggccagaggtgtaccactgtacccacaagacacagcctcaacatcatgtctaccatgcgtcgcgatactggaaggtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaa

SEQ ID NO: 19210 - DNA, 318 bp, Oryza sativa
ttcaatgtgacacccaaaaaatttctttttgcgaactaaacacacccttaggcttccatcggatggcctaatcagccaaataaaataccaaattttaaatttgcaaacttaattttgagatattttcaacgtagtttctttttcagtattgacttttaagtcaccaaaaacacatatattaaagttttaactacaattttatttttattctctaatgagcagttttggtttattaggaaaaagcaaaaggatagggcctttattctcaaaccatagcagaaaatggacattatgctattttcaaggtggcgcggggga

SEQ ID NO: 19211 - DNA, 1501 bp, Oryza sativa
tgtcgccggccattgccgcccgattctgccttctcgaccacaattttcctcccccgcacccatataatgcatcgcccagctctcctctaccgtttcccctcctcccccgagcttcccatagcctccctcgctctccccatgccatcccccacttctgccgctttccggcgagctacagccacgtgctaccgccgccatagccgccgtcgcaccatgccaccgccaccactggctccgcagcgccgagccaaagcccggccaccacttcccctccccaaaccgccgcggaaaccccgtcgccaccaccaatccgagccaccgccgcctccaggtgcctcccgccatcgagcgtcgcctcgctcagccatgccgccgccacccacagcgccccgtccaccgctcctcttccccaatgcattgccaaaacgccgccgccacgttcaccatctctctccgccaccattgccgcctccagccgtgccgcgtcgcctctctggtccacctcgcgctgcgcagtcgccttccccagcaccgcagccatcgtgcgcagctcggcatccactccatctccctcctccacccccgaagcactactcctaccgcgaacccaagccgccactgccattttgtcacatcctgatttttgtttcaggatttataaattatttaataaattattaatagaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcgg

SEQ ID NO: 19212 - DNA, 552 bp, Oryza sativa
ctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgttcacgttcattcgcgttcgttaacgtttcgttcacgttcgttaagcgttcattcacgttcgttcacgtttcgttcacgttcgttcacgttcgttcacgttacgttcatgtttcaatcacgttcgttcacgttcggcaatgtcggggcgcgcaacaa

SEQ ID NO: 19213 - DNA, 1501 bp, Oryza sativa
agaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcgtaagtatttatcgttttagttaatttgatgaatctgtatattaaattgtcagtttgtgtacctcggctgattcctggacgaggattttatgcacagataagttcggaaattactagtgaatttccgggcgtgacaagttggtatcagagccatctcgactgtaggataagccaaatggtcaaaccttaaggactaattttccgaaaatatgatttgtgaaaatttctcctttcttccttatctagaattctttgcaaattgtttcgttgtctactcccctctctctttcaacttgagtagttctgagacattgaaacttgaagacgccaatgatgtcaacttatggaggtcagtcaagtggatcgtggaaggaccgaagtgccaagtggtcaagatggaatgaagtttggatcctatcttagaacctatgccaccaaactatcctcgaagaatagttagtagggtagaacgtttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttatctttagtgtaacccctctccttctatcttctctaatatgcaacaga

SEQ ID NO: 19214 - DNA, 210 bp, Oryza sativa
cgggagaggacgaggagcagccgcacccccaccgctaccccgagcgcggaggtttcggcggcggcgagcgcgtgcggcggcggcgccatcgcggcgagccacaggccataggaagaggcaggtgtccagggcgaaaggccacgaaaatgcctatgaaaaaaaaaagaaaaaaaaaacgtagcgaagccgagacgagagagacgaagtgga

SEQ ID NO: 19215 - DNA, 1501 bp, Oryza sativa
tggtggctgtgcgccgccgcctcttagctgtccggccgtgagccaccgccgtcccctttggccgtgcaccgccaccatggactcggtccatggtggagcaactcctttgacccgctgacgagtgggccccccgctttgtggacgtggtccgcgctcctcctcttgctgacgtcagcgagcacctattttcctttgagaaaataattattaattgcgtcataaattggtaataattatagaaatttattaaaatggctcaaaacttctaaaattcatatctaattcatacgaactctaaattgggccattcaagttgcaaaattcatctaaaattgagctctacatgtttgtttactttttatgtactgtttccttggtttttattagggtttttcctcgttttgcatgccaacgtgtagtttccgcagtttcggaagtccgcggtcgcgaggaaaagagttcggaagatcaaagtgaagaagcaaggcaagtcacacattacccttgagcatattgatgctactttataaatgttttgtcgtttgcaaataaatatacatgttttgctaattacatgggatccgggtattacctatgctcgcttgtgccatgtttacttgttacccgacctttgtcaacctcgggtgataatttatctagctcgtgatacttatgttgtcctagctagaattatatatgcttagccatgcttaattaccactagctcacaaaatgggataattacattattagacatctagtattctgacgagctgtgtgctcgatgtcacgcccggaaattcactagtaatttctgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggctagaggtgtaccactgtacccacaagacacaaccccacatcatgtcaccatgtgcctcaataccaccacg

SEQ ID NO: 19216 - DNA, 352 bp, Oryza sativa
gcgatacagaaagaacaccatcggcttcacccaagcagacccctccaactccttctgccccaactcatttttcaagagtaagcagctctctttgatcctttttgtaatcacttcattttttcggccgattactcacagactttatagttgcagaagaagaaaattgctgtgaaaaagaaaccagcagcaacaattctcaaaccggctccaccagtaagttattttaattcttttattagttgattccagccgattttgtctaacacttgtctcttttacaacctcctccttcttctcctcctgtgcaacaatcatcaagtgaccgaactccatcggctgtggggagtcacca

SEQ ID NO: 19217 - DNA, 1501 bp, Oryza sativa
aaattatttctatatgtatattatactattgtgtgctaatgtgcgtcaagttgagtaagaacttatactcagatacggtttcttggttgttcatgtgtataggtgttgcttgaggccttgggaatattgtcagtgatggattgggattagactttggaaaaattgaggtctagacggtaagaagatcacacaagatataaaggctaaagaacaatgcacgtggaagtgaagcttctatatggcacacaaagggaattgcatgcatagattgaagtccaactttcggaggattgaagttaatttggagttataaagggatatgtgtggattatctatgtgattaggattcctagttctagttaaattcatggctgtgggcagtcatattttgggaataaatagaaaaagggctgagactcaaagttcatcgattttctaaaagagaaaagttagggtttgcttttatgtttagattgtaatttgtaaatttagataggagtgctttagatgtactttgtaaacacgtcttgatggaataaagttgatctactttgtagctcttttcagtagtgttttctagttctcgatggtcagactggtggcacgcaggcggttggactggtaacgtcaaggcggtcagatcgcaggacatccaggaggttacaccggagcaactacaacagtcatattgcaactttgtctaggatttattttattccgctaaagattttgatttttagtgttccctacaattcacccttctctgacaggtttcctctctggtaggtttgattattatgttcgatcctacgctaacatttgtaatatatgtttgcttcatataaatagatcaatgcagagtttctatgtagttctcatctgaaccgataacgtctgaggagcaacagtgatgaaggggagttcatctcagtcacaattcaaagacaacgtactgtttgtttgtaaacatacatgcttgtctctctttttatttgaaaagatacatgcttgtctcttgtatttattgcttatgaaacagtaaaagtaaaacaatgtattgcgtaagttattccaatcatcaattttctttatttcttatcatgtggcatcttttagaaatataaaaataagacctctcacggaggcgagttcttaataatctataaaaatatactccctctgttccaaaaaaaatttaatctaggaggggacgtgaccccttctaggacaatgaatttggactaccctttatgttgatttttttttgggacggaggaagtatgtgatatagtaatcccgagctaaaaagaattgtatcccaactaccaaagtgtcggcattaatttaaaacaaaatgttggataaaaattcttacttcttccggagaaaaataaaacctgatcatgatgcacgcttgcatgcagatcatttgagttgaggaaacaaaaataaacaaatatgggtgaatcatttgaacactccaaaagtaagatatgtgcgc

SEQ ID NO: 19218 - DNA, 843 bp, Oryza sativa
attcatgcatggaatgggattaattagctgcccttgctacccattgcccataaccacttgcaattaattcttcatagctacccgatcagattatcttcacaaaactacaaataaatacttgtctagataacatgcatcatgtcatgaaattgcgtttgtcggcaccagctgggtgagaatctttcgaactcactatcttgaaaattgaaaaatacatattttttctcttgagaaaaaagacaaattctagatctttcacgttgttccacggagctcccggtgccgtttgtgcttttgcttcgactacccacaagctcgggattttcagcgagttcaacgggcctctcgtgatgtagaagtcaccggccatctacacatttcttttttgtttttacttcacttttgcttctgattgggagggaggccatgtgatacaccgacatgtgggatatgagcttgacacgaatcacgctggatcccacatgtcagtgacctgtagcatttctctcggcaaaaaaaagagagaaaaaacccaacaatcttttttgtggccgtagtatatacgtaatcgtgtgaacttgatccattttggacggtggcgctgcccccggcgtggcgtacgaccagcgctctgcatgtgacccatcacgagatctgtgaccatgtcctcgtgtcaggacctggcatcttgcagctcacttgagcttgctattttatttccggtccatgtgattaactgacgtgatcgttaattaacggaacttcattcacggagtatttattaattatgtagataagatttgctttggccattttaagcttatgctgattgatgtgtgtttg

SEQ ID NO: 19219 - DNA, 1501 bp, Oryza sativa
ttatgtaaaatgcaatgctaaaagtttgaaaagcgtgctaggaaatcgaggagtagctaagttgcaatactctcttcaggctgataatacttattgttttggataagggtgaggtcaaacatttaaatctttggttatgaataatttctaaaatatttatctttgaaatattgtggtatagattagtcttaaaaaatattttaataaaatcatatatttgttaacatttatatacatattaaaaaataatggtcaaagttgtttttttaaagaccatgtccttattcaaaatgacaagaattatcaacctggagggagtagctaaaaagaacacagccttagttcgctgagatgttggaggcgatggtgaaaaagtaattgactaattgaggtggaagtagtcgtttcttcagtgagacatggctcaagcatacatttttccaccataaatattttttatctgaaattttcaaagaaatatataagtgtaggttgtaccgacttttttttttgggggggggggggggggcgatataagcggctgaccacttgtttcgttattgtgtttagtagtactatttactctgcaaacatctcgatcaactgttgtacatgcctaagctttgctgtgtatttagatgttggcacaaaaccactctatctcatttactgttaagtaaaatcaaaagtgtttttgattattattttgtgatgaacaattggcatcggagattattggttttgatatttagattttattcacaaagtggttttggagatgattggatttcacaggtgaatctacaggtactgctggattggatccggtcagaccgggcatgtgctgccggtcagaccggcgtgtatcgtgtggtcagaccggcgcagcccgcggtctgaccggccgactctgtatcggtttcggttttgggttgtttgtttggatatccgtgattgtttcatgattatggcttcaagatggatactatgcgtatgtaatactgttgtttgctaagaatgagttaagttggagatagcttggtctcggaatatggtttctttgtttatttcatgtgtaggtgactcgatgcctcaggagagtatttgcggtgatggaccgggagtcggcttggggataagacgacatccgtggtggtcagagatcatgcgggatactaaggctagagttcaatacacgtagttggtgaagattccatatggcatacgatggaggtattgtgtacgtatgggatgcggagtcgaatttgtaaggagtccaaatttggtatgattggttgtgtaaagtttgtttcttgtactagagggtttcctaaggtatttaggacttctagtatgagtttggttcgtggctttaggctgcctatctcgggtataaatagagggggagcgtgaggcttcccggtatcgcttttgatagcaattgagttgatagttgagttagggtttcgagtttagtcgagatttttataaggagtgctgt

SEQ ID NO: 19220 - DNA, 1501 bp, Oryza sativa
acgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaggaggaaggagtgggccaggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgtgtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttag

SEQ ID NO: 19221 - DNA, 1501 bp, Oryza sativa
tcaatttagccttatgtattagttcaaaatttcagaattacttactagatgaaacacatcacattgttgcaggaaagttgtatggcaacaaataaaatggggggcgtagtggatttgctttgtagcttagggcctgtttagattccctggcaaaattttccaccctgtcacatcgaatgtttgggcacatgcatagagtattaaatataaacgaatttttaagcctaattgctacatgatttgacaatgtggtggtacagtgaacatttgctaatgatggattaattaggcttaataaattcatctcgcagtttacaagcggaatctgtaattgattttgttattagtctacgtttaatacttcaaatatgtgtctgtatatctgatgtgacacgctaaaacttttcacccctgatctaaacacagccttacaatatccatacaaatattaagataatataggtttgtaggagaagagaaaccacacatagatcaatcacccaaagtctaaaaaaacaattaggtgtgatatggtaaaaagggataaatccattttactctcctcaattcttcactttgcctaaattttaaaacacaaccccaaatttcaaaaccggcggcagctgcgtggggaaggggaagtgcttgtgtgaatccgggcaggcggcggaattgttagcttggaaactaaactaatggccgtaaattaggtctgtgcaggagattatctttcctttgggccactaggcccatgggccaagaatgtacgcactacatctgcctacgcctccatcaggtatacgggctgcggcccatgaacaagaactgtaagtaaacctggtaacactttaacagtagctattatctttttttttccctgaagcttctcattcatttatgtccatttaatcgctaatcgaggcatggggcatttgggtcacagcaaaaaaaaaaaaaagcaaaacggtggaaaaatttggaaataaaaaagaaaatggtcgaaatgacatttgtagcaagatgttttgtttaaaagtggcattctaaccaagccacattccagagatgccaaaatgtcaattttcttgtgtttgagggaagcataaaggaaacgaaaaactcatctttttcgtgttcacatttccccaactattaagcggtgtgtgtttttttaaaaaaaattatttaaaaagatattttagaaaaatcatattaatcatttttgagtttaaaataactaatcatcaattaatcctatgctaacgtcttacgtatcttatctctcgtttcttctctggtcaaacacacatctaatcatacactgtactacctctatcagaaaatactcgtcattttagctagtttagcctatagtattaaggccgtgtttagttttaaacttttttttttcaaactttcaacttttacatcacatcaaaactttttacacacgtaaacttccaactttttcatcacatcattccaattcaaccaaactcca

SEQ ID NO: 19222 - DNA, 255 bp, Oryza sativa
ctcaaagcttttgcttttgcagaaaatgaatgtaactattacattttctatcataagaaaatacatgtactcaaaaacccgaaatgccagtactacattcgtgcagtgcaactccagttcccttactgtttacaaagctattagcgaaagtaagatgaggctctgactgacatacgttcgtatcatatgggaatcatcaggcagcagcagcagctgccctcttgttgatcggtttgcttctccttactccgcagg

SEQ ID NO: 19223 - DNA, 529 bp, Oryza sativa
gcactgtatgggattgaatactgtttaagaattcgacatttcttcctagctatatatgggcttcaaatgatttctaaagcactattcaggctaccaccttttattatattccgagtcactaaaaatcattcatcacttgtatttacaccagtccctttatgtttctatttgcagacattcaaatgcaatgggcacaaagtagtgcacctaaggcccatgaagaggtccaaacatcacagacctaaggctgggacacctcgctgcacgacttgccagtgctggctccacaatgcacccagcctcacctgttcacttagctgcaaggttattttcatcatatatgcacaagtactgttatttatcatgatcatgttgactcaattgattttgtttagtgggcaagctatgtgctatatattgatggataaggttgtttgttgtgctttactagatttcaccctacgtagctagactactagctattgttaactttttttttctaatatctctcttctccaattctgataga

SEQ ID NO: 19224 - DNA, 399 bp, Oryza sativa
gtattgtcggaatcggctgtaccacctgacccagtctgactcggactcttactctgttcccgaatcgatcttcgtcttcgattccaccccgatctaatcttcatccccgatgctgatattgccaaatttggttgttaacacatgccccccaagtccggaatatttggtaatgtttcggatttgccatatatcgatttcgagcaaaattcgctcttgccgtttcctaaccgtaactccagcgctttaaatactaatcgttgcccccgagaaacctcataccgtcttcttgcgttttcaccgccgaagctaactttgtcttctctctcttcgacgatttctccgacgcataaggcgatccctaggcgacttcatctccaattagatctccgcctgcagcga

SEQ ID NO: 19225 - DNA, 432 bp, Oryza sativa
cacgttcatgtttctacctgactaagggcatgtctgagaaacagagaatatgatagtttggatattaatttagagtattaaacatacactaattttaaaatctattccataatcttagactaattcgcgagacgaatcttttgagtctaattacgctatgatttaataatatgaggctacaataaacttttcataattatggattaattaggcttaaaaaattcgtctcgcagattagctcttatttatgaaattagtttttttattagtctatgtttaatactctaaattagcgttcaaacatcagatgtgacatgggctaaaaagttttagccccatctaaacaccccctaatggtcgatagcatttcacacaactggcatgctccctgcccacaccgactcgctatcgatcgcattatgccttgacagc

SEQ ID NO: 19226 - DNA, 1501 bp, Oryza sativa
ttctgatgatgagggtgatcatgggatgtatggtgctgagtggtcatggactaacaaaaataagccttttgtttgttctaatctaatgccgactcctcgtaaagatcggcaaagtgagattaagtatagttttgacgtggccaaatgtgataagattttttattatcttttgcaagaaaaacaaattagattacctaaaggccatgtcataccatctcaagaggaattgaaacgttgagcttattgtaaatggcatgattctcattctcattctactaatgattgcaatgtgtttcgacgacaagttcaatcggccatagatgaaggacgattgaaattcaccgatggttccaagatgaagcttgatagtgatctttttctggtgaacacaattaatttcattgataagaaggtgtagattcggccggagcaagccgaatctactaaagggaaaggagtgatcatttgagagcctaggccaaagatgatggtgccaaagaatccagaggttggtgtttggaaagagaataggagtgaagcttcaagttctaaagctcctaagaagactaaagtaaccatcgatatgtttttgagtaagtatgagaagcaaggtggtgagaaagctcgcaataaaggaaaaagaccaagatcacctcctagaaagcgatttggtcattcaccaagacggtcggaatcacctacatatcatggggttcttatccaatgccgccaccgggttatccttttcctttctacatgccatgggggacaacaccgccaatgttcaatcatatgcctccaatgcaatacaacctaggatggggaggaccaaggaggccagcttgtgagcatttgtcttcaccaaacaatggccagttttatgttaaaaatcgggtcaatgaaggaaagagggaaggaaagcgcgttaaggtggagacgaggactttggaggtgataactattaaagtgggatctcatgatgtgccagtaccatctggagatgaagttggggagtcttcgagtaacaaatccgaagccaggaccagcttgtcgcagtcggccagtctgactaggccctctggccggtcggaccgcagccctacggccggtctcaagcctgtctgaccgggccttctagccggtctgaccgggctccagcgctggtttgatgagaggtttacaaagggtagctcgggggcttcattgtcttcgggtagaatcaacaggggacattatttacctcctggaacggagccgaaaccaaggtggatgcctaagtatttgacgactatccaaaagaggaggttgcaacgtcttcgggcccaagaattaaaacagagagaagccaaagagcggagggatagaaggttcaacgagttgcgaccaccgcctacaaaggtgtggaggcgtaaatccatagagggagaagaatcggttgttgtgcaaaaagagaaggaagaacaatcggttactaaggacgaatcatctccaaaggaagaca

SEQ ID NO: 19227 - DNA, 329 bp, Oryza sativa
cttgttcaacgtgtatgaaaaataaacaaaccaacagttactgcaaattactactcctactagcaaattagtagcagagaaattaagggtctagtacacatactagcttgtacatgaggttcagtttttcatcgatcgatctgaactttgcacatataagtatcttgattccaacaatcgaatcccacgtctcttttcgtatcacgtcaattagtcgatcgatcggatccatttcaattttattagttgctgtcaaggcataatgcgatcgatagcgagtcggtgtgggcagggagcatgccagttgtgtgaaatgctatcgaccatta

SEQ ID NO: 19228 - DNA, 876 bp, Oryza sativa
ttccccctgtactcctctcccttctctcctttcatcataattttaaaaaaaaaaacaaaattagtaaaaaaaatagaaaaaaaataatactctcattcacgtgcatagactttataccgtaaattttgcacgcataaactttatgtatagaatatataaaatatttgaattcgaatttgaatttgaatcgggtatacaaacaggtggataaactttagatgtgtaaactttaggtgcataaacttactagaagaggaaaatataaaatatttgaatcagaatttgaatttgaatcgggtatataaacttttgacctataaacattcgctctacaactttaggtggataaactttagagatataaactttaggtatacaaattttagatgtataaacttactaaaataggaaagtaaagcagtgcaaaaaaagaaaactgcgtgggggaggggatctgatcgccccaggcgatcgattgcccaataggatttccgggtgctaagggcactcatagtgtgtcactaatttttgaggagccaaaacttccatctagactaaaaacttcgtaagcaacaaactccatagtgcatgtggtctacgttttcctttacagtgggtccctcccattctctatcctcactttttatctctcctctctttctctgcctttccccactcgctccccctcctctactgcgccgccggcgcccctctccctctctggatctggcggctggccggcggcgaggcggcgcggaagccggcggcggacgaccccgtggcggtctcggcgggagcgaagtctcggtcggagcggcctaggcgacagcggcggtggcggatggagcggcggtgacaggcggcggaggatggagc

SEQ ID NO: 19229 - DNA, 341 bp, Oryza sativa
atttgaaccaagttcatcagattctgtctaattgcaacacacggacattactaatgatgtgtaaaagcggttaattaaccaatttgtggcttacagtaatgaaatggtagaacactctatcttcctgagaaaatatcagttgatcgtcatgtattcacggtgaaccatgatcaccatggaagagcgatccgaacgaaaagggaagaggtccatgtatgcaactcaaatatctacttatgcttctttttgtgcatacaaattggctatttgcatatttgcatgcaaatgggaaaagaaaaactttttatgaaatacatatcattttaagctacttcctccgt

SEQ ID NO: 19230 - DNA, 1501 bp, Oryza sativa
cactttcgtcaatgcttcatgtaaaagggttaacatgggagtgatatagttggagggaaaatgccttataagttggttccacccgtgctaaactagcaaggtggtactaaacatgcgcatataactcatatgggcgacacatgccggggatcctaatagagtcgatatgcaggcatgctcgggtctgaggcagaccttagtatatttctcttaagatgtagatcttgtatgtctctacgcccctctgaccaagtagcgcaggacttacaagggccaaggtgagcccggaagccaagacaagaccgggtccgaggcagaccttaggttacattcttaagatatagattttataggtctcaacactcctcttcacagagcagtatgtgacctagatgagctaaggtgagcccgagacctagagcaaggtcgagtctgaggcagaccttagtctacattcttatcccgcaaacagataaaggtgtgcccctagccacatcaccctaggggtagctttttatttttagggatggtttaagtatgccatttattttacttctaatcgttttgccgggtgaatgggtaccctggttcccatttcacctacagatgcacaatcccaaacattaaatctataatgaatctaagtaaaagagactcagggcctgtttggtagagctccagctcccagatcatcttaccttgagcttgagcccaaccaaatggtccagattaaaaaaaaatgggagcggtgtggggtagagcgatctgaaaaagtgaattagagtgatggagcggggttagtccagctccactactccactccgaacctaaagatagcgctacacatccattttctcataaattacagcaaattaccatcgaactacccttccatccccccatccaacaccgtttcacatgaacccttccccgaactcgctcgaggagaacaggaggcggagagaggggtgctagggcaggactcaccgacgctggcggaggaaccctccaccccggtttttcccacctatctcggctgtggctgcgcacggcggcagcggagtaggtgccctccctccctgcgtcttcctacccttttcctcccaatcccaatgacccgtggcccaggttgtcatgctgagtgaggagcacacagggcggtggcggcgcttggctgcgaggctggaaatgtttttattttttagacttttttatgttttaattttattaatagaccattcccaaaagtattttcaaactgaaccttttggccacaccagcccgtctggcgtggccaaacaactctatcacgccacacttagctggagtggcagtgctgccctgccacgctagcctcttgtcacaccaccactgctggcttcagttttcggaaatacttttgggaatggtctattaataaaaataaaacataaaaaagtctaaaaaataaaaaaaattcgcgaggatgttcaggacgagcatgacgactaaggttgcgagc

SEQ ID NO: 19231 - DNA, 905 bp, Oryza sativa
tatttaactatttaattaaattctgaaatatttattaaatgttgtttatgcaaatgagacaatattatgccatcctttgttatcctgtgcacttgcatatttgctgcgtggcttgctgagtatgtcatatactcaccttgcaatcatttatcagaggaggagttctacagtgatgccgatggagtggatgattaggcgtagccctggtcaagctgcatgtggagaggagtcgcctgcgttgtttcttttattttccgttgcttagaactttattgattgagaggaactatctacctctgtaatgacattttattctcttattaattagagtaataattgtactctattatcaatttgttattatgtacctcggctgatttctggacaagggtttctatacgtgtaagcgtttagaattttagatagaaattccgggcgtgacaaaataacacttaatatagcatgtggagtgatgagcagctaataggtggacacaatggctattaagtgctcatcatttgagacacaaaagattcacaatatccgtgctgaagtatttgtccaaattggaaagctatttttggttggcatcaactacaagaaaaaaacacacacaaatcgagttggctcgtttgttgtttacttgtttaataaattcctctaacagtttacggatgaaatctttaatttattttattttaatctatatttaatacttcgaatgtgttttcgtttatgtcaaaaaaaaaattttgaaggagaaactaaacacggccctaagttgggttttcaatagttctcccaaatttgggcccgattgcttcagcccaagtaaaaaagacggacttgggcctcgcgaactcaactacaccggtaaatccgttccccacctcgtcgtctgagca

SEQ ID NO: 19232 - DNA, 1501 bp, Oryza sativa
gtctaagtctcttgtgactaacctttatggacccaatgttgttggggaccaaaatgtgctaaagtgagaaataggtacttggagatgcattggaggtttgactcatttgtggaaaattaagttcacacaatacgcaaaattggactcaaatacgagaatagttgttctatataaagaaccaatgtcatctcggtaacaagtatttacatttaaatacttatgtcctaaccttgtgtaggttatgcttgtgcataatgcttttcttaaacatttcttggttgatgcttaagttgaatttgagtaattggttatcacatttaggggaagtgctataacctctcatcattcgcatcctctaaatgtgtttggctcaaattgatgctatgatagtctttaaaatgctatttggtcctattgtatcatcaagtgagttttgccactagaatcatatatcttgatatatattggttcatggaggtacgtcaagcttatacatatgtattgcaatccaaaatcttctcatttgctatttcttgaattttggatgaaggtttttgaatagtgagcttttatgtatctttttgctcaatcttatgagttaacctaaatgttcaactctttgatttcaagtgagagatactttagagtgaaattgtgcaaaccacattcatgtatctcttgctctcaaaacttgaaaaatctcaaaagttgcattcattgttttcaaaagagcatatttagtcaaaagtcaaaaatcgtatgtaaaaggccacaatttgtgaaaatcttttcaaaagtatttcaacatgtgtttgaaatgttttccaaagcttttggagtaaaatttcttattttcaaaagaaaacaactcttttttgtctaaacaggatctttagtgatctttgtttttgttaaaagtgagattttaccccaaatcaaaatctattgagtttttgaaaaagttgccaatacaaaacttttagggttggtaatttcaaacacatttttagttcaaagctttttcaaaagaccaaccattcaaatgttgcagccttgtgaagttcatcaaaaatcttgactttacctcttttggccaaaaattgcatatggtgggttgaactatttgagccaaaattctttgtgaatatgggcatgaattagtatctctaacccatctaaggctttccaaatgtcaaacttcataaaaatcttatttgaatgtgatttgacactttggttgagatatattcatttgaatggcctacaaaactctttttgacatttctcttgatagaaaaatcttttttgagaaattctttttggaaaagtttctattaagtgaaaagatcatttctgcaaggtttcgcatcattccgatttaatttggaaagaatttgactttttctcaccttgctcaagttgctgaaatttttagaaaattcatggtttttgactgatttgtgatttttatatctcaaaataggttgcaaactggaatgag

SEQ ID NO: 19233 - DNA, 560 bp, Oryza sativa
ctccatttcttacatcttgatgtccttgttcttgtgtttctaagtacttcctccgtttcacaatgtaagtcattttagcatttttcacattcatattgatgttaccaatatgaatgtgaaaaatgctagaatgtcttacactagagtgcatagagcatgcttatctggttttcgatgcgtctctagaaattggacgaaaaggctaaccatcagtgaatgtgagaaattgcaacaccgagatgcaaaaatttaatttgtaaacacagacttacatgtaaatgctccttgatggtctagtgcttatctaagcgaaaaaatagtgcttaagcttaacaagcacttcgagcgccccattacactttgatcccatcaatacaacattttggccataagaatacagcatattgcctttgttttttaatgtatgatgtaattgatattttatttctttgactattcatctttctgaaaaatgttttcacaaagaaaaacatataaatagggacaaatctatcatgtaatggtggatgctcgagactccactactggtgcaaggacca

SEQ ID NO: 19234 - DNA, 1501 bp, Oryza sativa
ccgcctattcaccccccctttaggcgacatcaaggtcctttcaattggtatcagagccaagtctctctatttagggctttaccgcttagagagtaaagatatcgactagtggtttggtggatatggttcctttactccttttagatggctcaaattatgattcttggagtactcgcatacttgacatatttaggaccatgggtcctcaaatagagcgagttgtagatgtgagcatttctcctcctaatgataaattgctatcatttgaagaggaagagaaatgcatacatctcaatgctcaagttactaatgttttatttagtgttttgagtgaagatgtatttaaaaccatcatgccgcttgaagatgctcatctcatttggactacactcaaggagagatacggcaagtccaaatgtgatgatgtactctttttggaagaaccatttgagaagtgttcaacttcatcgccaaattgcgaagaacctcaagtaactaccttcgatgatcgtgataatcatcccacgtctaccttatcaacacatgactacattgaaggtaatgaattggtgagtaaggttgacgatcatccaattctcccattggattccaacaacaccgataatgaaattgtcatattgcattgtgttgttgactcatgcatctcacctagccccaagtatatgtgtgaggatgatatggataaatgctctacctcctatagtacatgtggaactaaccttttaaaggaagaagtaaatgagcgctaatggacaagtgaagaatccacctcaccaagatgctcatcttctatttccgaagattatgcttgctttatgggtgtagatggtgactccgagtttgatcacttgagcaagaaggatgtaacaatggtgatcaagttcatggaagccattcaaaagcaacaagcatgcactatcaagaagaatgaagaaatcatgagtctaaccgaagaacacaagaaacttaaggattttcattcttcattgactatgaggtatgaaaaattggaaaatgaatttgcttgtgccactaattctattgcttgtgtagcatctttgaagaagcaaaatcaagagctcaaatttcaacttgatgagatcactaacaagtatgtggatttacaagaaagacatgatgaacttttgtgttctcatgtgaatcttgtggattctcatgctatgctagaggtatctcatgaggtgataattgcaacggtaaaatcctatgagcctcatgttcaagttaatctcacttgtgctaacccttgtttcccccaagcaaacatgtccctgagcactatatgtgacttggattgtgtaggcaaaagggagaagcaaatggatcatggacttgtgtgtattgctcaaaccttctcaagaaaaccgtgagggcctggtgaataagcttgagaaagggatcaaccgtagcgtgcaccaagatccatcaaagggatatcaagtccatcaatgatcatacc

SEQ ID NO: 19235 - DNA, 1501 bp, Oryza sativa
tattattattattattattattattattattattattattattattattattattattattcctccctccatccacaagtttctatttgtagtctttatgcattcaatacttaaataaagagataaattaaatgtttgattagaacctaacgagtcatctaaatactcattagttatatgcatgtattcactacttgattttgtaacattcaagatgatttaatttctcttttatcttggtgacaaaaataataggtgtaaattttgtgaatggagggagtattatttattggtctttgcattagtgatagttgcgtcttatattttgaaatggatggagtactattgctaaatgggaatagaaatcaaggtccataattgcataaactctaatgcaagttgttccaaacatagacaacgtcacacaatagcttagacaaattttaaaatcattaataatattactgctcgattattaattgtgctttggaagccaggtcacatcagcaccctcaacatgtgaaaaaactcagcgctagcagtcctatcttttttttttacttcttgttttagacatcaacataatcttcaattacatctctcatcattgtgttctctaattgtatgtttcaaaaaaaatatattacaaaataaccatatgaagtgtcttcatgacaaatctattaatgtcctttttcacatattaaattctaatattttcaatctactaatgatttaagaaatcgaggtgctatggaacttgatattactgaatttaatcgagtggtacttcacttcattgaactttagcaaagccggagcgacatagttttgccacgcccaatgtaatattacaccgctttactatatttacgagtacaaggaacatacatgtaattaaacaggatataattgtcaataaaactcaatctcagctcaactacaattgtgaaaaaaaaggaatgcgctggtgttcagcttgtggacactgtagccccccggcacagctccggcagcagcttcatacaaagtcttgcctgtctgacacgagggaacggaattgtgctcccacgcaactgcatgttttgctctccttagcaagcaaacaacaactagtagtagtaacagctaattaaaggccataatcaacacacatgacctagttgacgaacaaagagaatctagtcatgcaagtagtagattaaagccgactactgtcactttactttctagctaaggatttttgcagcagtcctattgtttctaattaaggagacaccgagtcctaaaagcaatggctcacatcctttgcccagagaggaataaaattccagaagaatatcaccaccattgatttataatatgatgaagggaatgagtatgatgattaataaggtttgctcattagcgagaccagcacgactactgatttggctcgcttgcaacagcaacagaaacaaaggaagcaaaagaaggcccaactttggcccacatgctgcag

SEQ ID NO: 19236 - DNA, 372 bp, Oryza sativa
caatatatacaacttcttttctaaaaaaaataaagaattactagatacaatttctatttccaaattttggccggatacaattttctttttgaaattctcgcaatatatactatttaaactcagaagatgcatacaccattgtacacgtaacatcacaattacacctcaacctttatgaatacatcgtctaatattatactataagatacggaaactagtgatatatcctgatcttggtaaaatcctattgaaataaaattttgtcgtgtcattgatggatggaccaggctgacagcgggaagctgggagggagcacggacggctcgccgtactaccggtcgtcatcggaagatgaccggaacgccgacgagc

SEQ ID NO: 19237 - DNA, 1501 bp, Oryza sativa
  unsure (1)..(1501): unsure at all n locations
tgaactgtttttcccccctgaaacggacccagcttcagctgattctatattatagcaagaagagcagaaatatcactctgttttcattagttcgtgcatgttgtttccagggactccttgtataccccgaactatcccagttctctcctaatatccataattcataatctttgctgtctgcatagtcgcatagagcatgctttttgaggtgcaaaattacgtgtgaatttaactggaaaacctcctggcatctgaaggttcattccagttggacctttcgtaaatatgggatggccaagggtattgaattatctcattgattctcgtttgcagaagtgcttatttaaccagttttcctttataattttgtactattttgagaagatgtcgacattacagcacgaagagtttaaatgtcattgcaagttgcaactcttagttcaatgactgcattttgccagtgaagctgtactgtacatcttctgatcagttgataagtctattaaatgtctctctggccattttcgagaacagcgaaagcttgccatcagtatcattatgtatgatcctcgagccatctaaacatgtacaagacagtaaaagagattttttttggttaattttttgagaatagcgaaagcttgtcatcagtattaactatctattgatccccaagctatctaaacattcaccaggctcttaggtttgtttgttaattttggctgcaaacgaagaactcacggctaatttggatcatttcacgtgtcatcttgtttctgactttgcagggtccagagagatcatggaactggatgtgacaattagtgaaaaagaaacatcttgttgtcaggaggacgtgaagaaatgtacacagattgctttggcttcagttttccctgcctttatcacggacttcctgggagcttatggcttgcaggaagcctaactcagagatctggtcgacctcgtgtccaatgctttcttgtaatttcttcacatgcatctacttgatcactttgtttcgtgtgtcgccttcagctcggctagcttgtgatcccgagttctagaaaagcatctggaaatgaattgagttctactttcaggaagggataagcttgattctgtgctccgatcgattaggtcactaatgcgaaattgtttcatccatgctgttgaccagtcatgtctaaattctgaattctggccaaattgaaatattcatgactaaaaaaaattccgtacattgcaacaagatctaataacattagataatctaattaagactaaacaatcactctcaaactccaattaacaatgacaggattnnnnnnnnnnnnnnnnnnnnnnnnnnncaacatgttgtgcatgaagcaaatagggatttaaacatagtgctactgctgcatggccggtgccacattggtcaacaaagatggagctcatagaaagagggttgggagaggagaggtgattgatttgtgctttctcacttacttagggg

SEQ ID NO: 19238 - DNA, 200 bp, Oryza sativa
tttttgagccttatggctaatcatgaaataattaggctcaaaagattcgtctcgcgatttccatgaaaattgtgcaataattagtttttgtttttatctatatttaatgctatcagtatgtgtttaaagctttgatgtgatggtttttgaaaaaaaatttgggaaataaaccaggcctataatgtactcccttccacagt

SEQ ID NO: 19239 - DNA, 853 bp, Oryza sativa
ttgcagagttctacattgtagcaatcggagattaagaaaattttgaacttttttttatagaaaatgaactgtttttcccccctgaaacggacccagcttcagctgattctatattatagcaagaagagcagaaatatcactctgttttcattagttcgtgcatgttgtttccagggactccttgtataccccgaactatcccagttctctcctaatatccataattcataatctttgctgtctgcatagtcgcatagagcatgctttttgaggtgcaaaattacgtgtgaatttaactggaaaacctcctggcatctgaaggttcattccagttggacctttcgtaaatatgggatggccaagggtattgaattatctcattgattctcgtttgcagaagtgcttatttaaccagttttcctttataattttgtactattttgagaagatgtcgacattacagcacgaagagtttaaatgtcattgcaagttgcaactcttagttcaatgactgcattttgccagtgaagctgtactgtacatcttctgatcagttgataagtctattaaatgtctctctggccattttcgagaacagcgaaagcttgccatcagtatcattatgtatgatcctcgagccatctaaacatgtacaagacagtaaaagagattttttttggttaattttttgagaatagcgaaagcttgtcatcagtattaactatctattgatccccaagctatctaaacattcaccaggctcttaggtttgtttgttaattttggctgcaaacgaagaactcacggctaatttggatcatttcacgtgtcatcttgtttctgactttgcagg

SEQ ID NO: 19240 - DNA, 281 bp, Oryza sativa
ctaccataatttggcatcacttcaagacaggacaaacaaccatgcatgggcatgtaactaaaagataaagataagtttatgctgcagcatgaatacaatcaataaaaagacaaaaagtggaataaaagaaatgacaatattactcaagcttggagaaacaagacttgattgtacaaactatttgcaccgcatagcagatctgcgtcgtgcagtcttgcttgtatgtgttgcatgtccatctacaaactaaataaagcggcaagagaaccatgtgctcttca

SEQ ID NO: 19241 - DNA, 1501 bp, Oryza sativa
tagttaatctcatccctcgtacaaatcggcatgaactgcctctacgttctacccctcacaaaaaaacaatcctagctacgtatatgtccaagttcatggctagagtttgtcttttttgggacggagtagtacaccaagaggatatgactggaatatcactcaatggactataacctttctcttattccatcagttttaaaatataataacttttagccttctgaatttgtcttaaaatataacagtttctgcatcaacattctcttctcgttcaaacatgattatttattatcaattttttcacctaccttcatttcccattcaatcaagcattccctcatttagttatacctactttcttactaattgtatctcactttatttttttttaaaaaaaatggagatagtacttattatatgctagatgaggaagaatattgacatcactctaaaaatacaaaaaactttcatgctacatgtgactcactatgaatatcgtgcagtggcttatgtttatacttataagctaaaatttgaattttaaaccttaaatttagtttaaatttagagttgatttttaagattttttcatcgtagttattttttagcctttgcttttaaaacacaaataatatgtttataaaagttttatttataaattattttctgtttgtaaatatgttgtttacgatggagtcccagtctcgtggagaaacccaaaaagcgtgcatatgctctcgatgacaaatcaaaacaaagctcattattgagcggtggcatattgctttactttttcttttattttcccatttacttttttggtagcatgcattcactcgatagattgtgattccatgacaaactttcaccaccacggtatgcacgtgatagacaaacctaactgcaaattcatcacgcacatggtaatataacctgtatccctccggcgttgtggcacaggggcttggttttgacattttgaaggtatctctccgacttggctttgacattttgtcgcacagactactcactattttttttgttttatattgctactcactttttcaccacattataaaggacttaataacatttcaatccatccgcgtataattaaactataaaatattagcccacacacagatatgccatgttttctgcccatttaactaagtaataaattcactttagttctctcattttgatgttaaatcgtatccttaaaccgcaataccatatatgcagtaccatgaactattaaaaccatatcaatttatgtccattagtggttttgatggttgtttcatcctaaatggccacctatgtggcatttcagttagaaaaaataaattaagaagtagtggaccccacatgtcagtgacatgtccctctcctctcttctccctcatctttgtttctctgtatccttcatctgctttttcttgatttcactccgacagcagcctgtagtggggcaagcaacggcggaggggccacgcga

SEQ ID NO: 19242 - DNA, 1501 bp, Oryza sativa
ttcacacatgcatgcctgaaggaattaaaaacataatcaaatatacttcacttgctaatcctgctgtactgaaactacgtatatacagttctctcgcccgaagctcatggcggcagtagatggtgcagcggcggccgtggaaatccggaggtggcagcagagaggatttgagatgctccgactagtggcggcggtgacgcagaaccagaggtggctgcaaggattatttggaagtgggaggggtagctcgggcgagcggcgacacggccatgttgctggaagttggctcacggtttgctcccttgtacagtgcttgggaggtacctcagtaacaaatcaacaatccaccgttcattcatatagcatactaatttaggaataggaaataatattaacaagggtagcttagtaattgctacattcctatttgctttacataatattggcatgaccctgaaacctccctttgtgtttaatcctaaccctataccccgagtgaaagaacgaggttggagcaggcacagagcgtgcggcggcggtgacaggcgggagcgatgggcgcatgcggcggctacgaccgcggcgcgcgtgaagggcgcgtgcagcggcggcgccaattagccaagtcagccaagctaacttaatttgattctgggaatggtaatcttgttgaactcatgcatgattaattcttaaaaagtaagtgaattccatattggaccagggtttgctaaactttgtatttcacaccatctaacttgtcaaaaggttgcagtttggactaaggaaatgtttcggctgccagcttgccgctattgttcttcgtcccacctacatgagtgtgagtactcgcacgacagcggcaaatgaagtgctcgacgggtcttgctgtgcagacaatcacgcgagatgctacagtgattctactctgatcctcccaggtcccgtggtatcgtgtaattgtattcccacaaaaaatccattatggtgaactcacgtcgacgcagagcgggaggcacactcgaaatcagcgacggcgacggcgacggcaacggtcggtgacggccgcggtcgtcgatggcacactacgaaggaaggggagcccgtgcgcctccaccacagccaccaccacctccaattccaccttcgcctggaatgggtcggggaggcacgcttgacagtggcagcgaccgccacggccgccgtgagcttgctgtcctgaacgaatcggagaatatagatacaaatattgaaaagatgacgcatttgccattaactgcacaaatcaactatgaaagtcaattaccattttaaccttccacctctcatagttggtccacccttttaatacctttttcctggtacacgttggattattgatgatcaacggttgtaattaattccaagcaccgaataagatctacttgttcagggaggcagtgagggtatcacacacaaggataccgtcccctaacatctctgttaaattaaataaaattat

SEQ ID NO: 19243 - DNA, 257 bp, Oryza sativa
gtcatttttaaggcatgctttgcagctcatcgagtcattttgttgggaacaaaatgcagtgttgtttaatcggtttcgatatttctatatcaagtgatttgcatttttttctgtgatgaatatcttgcatcagtgtacaggtgtaacctggtggccttagcctaatctttgtgataacatttttcacttgataattggtaataatattttcccccttttcagcttccctgctttctaagtatcagttggagctacca

SEQ ID NO: 19244 - DNA, 1501 bp, Oryza sativa
aaaaaaaacaccacttctagtagtaataggataaattagtagtgtgctgaaataagatagattttctagtagtacgggatgtgacaactataaattttggatacaaggtttgttaagattcgtaatattagtatatgttatatctcatactagatttgtttttttattgaacagatagaatacttcaattaaatgcgtattgggagcagtataatttacttcagaaacaaactttttactagacaaatggatgatgctagtacaagatggaggcagtaactccaaagaggagaggaggggaggcttaggtctcaagcaagtacaataagccactgacaaatcgatggatccaagaacccaacacccaacatcgatccccttcacgcagagcaaccgttgccgtcggcaggtccccgcagctgcagacgaccgcagccgctgcagctgtgacgctcacgcaacgcaacggctgtactcctatactactgcaactgcagttgagacttgagactagactcgatttcgggaaaaaaagaagaagaaaagatcgatctttttttttttgcacgattaggccatttttaagttaatgagatgtctatagcattaaataagctgtcatctaaaataaaagatgatgtcgtaagtgaataaatgagaaaagggaaggaaaccagatcttgcttgagacatggtttccacacaacattcaaaacatcatgtatgataagtatcattaaatttaatttaagtaaaaaaaagtggtgtttgcattgaaagagtggtgtctattactagtttcttgatagtgtgactttataaaaactatatcttagtgttttgggttgggactagtcttatatttctaaaaaaaaaaagtttctttgtgtaatatctgaaaaaaagattgtttttttttgtgtatagtagtgtgctcgtctcttgcacagttccaccagactccatcgccatcgccatcgccaatcacactctctgttagctctaataaacccctactgctactactagtccatcgccccgaacaattgaccgccatttttatagccctcagaaccttctctttcttgttcttctcttcttccccctaaacccccccacaaatcacagagagagaaagagagaaagggaccaaaagcagagctcaagtagtagtagtagagagagaaaattcagttgatctctctctctctctatctctctctttctctcactagatctgtgtggcttgctttgctgttgccgttgttttgctttgccttgccttgcttgccgttgctggctgtgtcagtgtgccacccactcgctcacttgctcgctgtcttgctcttcgtctttcctcctctcgctgtagcagctagcaatgccacggcgtcgcgcggaggcggaggcattgcaatgcggccgccggtgaagaagaagcttagcgccgcacaggcgagcgagctgtgccttcttcttggttgagactgattggtcggga

SEQ ID NO: 19245 - DNA, 1501 bp, Oryza sativa
attttaatatataacactgttgactttttgaccaacgtttgaccattcgtattattaaaaaaaattatgtaattattatttattgtattgtgatttgatttatcatcaaatgttctttaagcatgacataaatatttttatatttacacaaaaaatttaaataagatgaatggtcaaatgttgatctaaaagtcaacggcgtcatacattaaaatacggagggattatctattaagtttatttctcaaaatatttaacctattcttatctgtagcaatgattcgatcaataatctatctgaaacgggggtaggtgattcatcaggttgatattgcgttcagtccgaggagatctcacatgccattttaagccatgtcctaatggatcaaaatgcttaacatgggagaagaaaaatcttggcattgttggaagcactgtacgtgccaaggcatccaagaaatcctgctcttttctttctctcttgtcatgtcttctaagctcagactcatacacaacctcacctctgcctttattaacaccacaaactactactgtacactttcagaggaaaactgtacactatacattgtgagtttgtgacttggttgtgacttgtgagtggttctatctatacttctattcatacacagtttcacttgcattgaaagctatatcaatttgagcttatgaagcattgctttattcagtacttagcttcagtctgcagatcttcttttggttaaccttcttggccttacatgctaacctattgagcctgtgaaaaaaaaatctgctcatcagacttcttcagtagttcaactacctacgcacctttccaactggaagcattgaaaatatagtagaacagatgttttcaccaatggcaagttattacagttattactggcccatctcattctgcattgtttctctgacaggatgagctgaaaagtgaaaaccattgataataaacaagttcaggtcacgcaagtacatctgcatatgagcatatcagcaaagaaatccccaacctctccttttctttctgcttggaaccatgcaaggctccaacagcaagcttctgatgcatgacagcatgagtgttttcctaccttgaaggcaagctagctaacagcctaacagttctgtgtaaagtagaatatatacattttttaaagaaaatgctctgccaattcattttattctttctgttgcaatgcaggccaaggccggtggttcatgcttcacacttgctaccagattagctttggctaaccttgattttaacatcttactggtaagttataggtgccgcatcatattatcacaaagtacatccatggcactttccaacaagagggaaaattcagaaaaaaaaagtgcatgtgaaggaaaagggagagaaaccaccctatcaaagtatatatcagaccaaccaaccaatgctagatctctatgtgagatgatcagcgatgaaagcaacaataacatgtcaccttct

SEQ ID NO: 19246 - DNA, 443 bp, Oryza sativa
ctcacaataccatgtcaactttagtctatcagcattatagtggttggttttggctgacgtgatgagtgtggtgttggtatttcttaaggtcaattctccttcacattagtctgtaattcctcccaacttctggacgctcgtggaatatgctagaaatgaatcatatcactatgttagatgtttcattatttgagttttatgtagatattggcggtacaaatttggctcttaacagccgccaacatgagccccacgtgggaccacctgtcagcgtctccctcctccccctcttccctccccctcccaagatatatttaactatttgccacttttacaaagtgacaattaatgatttgttactagacccatatgttatagacacacgaggacctacatatcatagagtgtgggtgataaattcttaattgtcacatcttaaaagt

SEQ ID NO: 19247 - DNA, 1501 bp, Oryza sativa
cgcactgaaagcgcgcagcggcgcgagatttcagtctcgttgaagcaatgcgcgataccgtgccatgccgatttcattagcgattaattaattattgattaataattatttaatcattaatcaggataattaatcactaattattattagttaattgttaattgagtaattaatcactaatcaaaaggagctgtcagacagtgtcgctcgttgctttagcgagaccgttcggtctcgctattccgttacgcgataccgcccacgacgtcattcccacatcatttttgcgcaacagttgtgcgagaccgacggtatatttctgtaaaaaattttgcatcccgaatatttttgagaaaaaaatgaatgaacagtatattttaaaatttaattcgtgaacgactcggttctttgcgctgtagtcaattgatgaaaatttagactgaggtcattaaatatttttgcatcacacgttttcttttatgaaacttctactgccttagtttcataaaaattgaatttctacctttaaatctttgtcccataaaaattttatgtctactaatgtgggacctaacaaaacaaattgattacatcaaaatttgtttccttgtaatctcctttctttccatttcatctcttaacctcttgtctcaaccttatttttaatcaagtttatatataatgtgtgtgcgtgtactgtgttcattaaataattaaggttaatgtgatcatttgtttatctttataatttgtccttaatttcatagaaatttttttttatggaggtagtatagtgttttcaaaaatggatgacttttttttgcccgtgcattgtataatcacacaatacaatagtgcaacgttttctccagttagtttgcacacgtttgccacgttgagttggccggctgggccagatcagcacgagcagccggtcaagacttatctctctctttctcgctctctcatcgattcttgttcaatctctctcctagctcgtctctcgtcagtgtcaagagaaagaaagggagaaggtgaacgtacccgcatgataattaaacctaaatcgagaaggtgagtagccggtggctgcgggttcgccacctccttctcctcctcccgtcctccgcctcgaccctcccatctccactcaaggtctgtggaggcctacagcggaggacggctaacaaggcggagatagacaatgggcgaagagcggcgagcaggactgaggtcggtgactaacccatcttctgtggatctgggtataggcgacagtggagagagggtgcaattagtgacggcatggccacggaatcaaatggtcccttaaagcgggaccagacccccatcgatcaatcctaagcctgaaggaggtcaagatggagtcgtatatcccatgggcatgttcgactgccattcctacgacagtgctacggctgcagcgcttgtgttgtgcagctgcagctagccttcgtgcagctgtaaaaaatgccagtcg

SEQ ID NO: 19248 - DNA, 426 bp, Oryza sativa
ggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaggaggaccttgcccactgagaaggggaggggacttttccagat

SEQ ID NO: 19249 - DNA, 577 bp, Oryza sativa
taatccaatctaggatgataaattttttggatcggtcgacgctgactaagtctaaatagtcctccctccgtccctaaatatttaaccttgttaatatttttaaacatatttgaccatttccaaaactttggtgaatattattaaaaacttgagtagtagtactttatttaacaatgaatcaaatgagtagaaaaaaattaataattactttatttttttaataagacgaacggtcaaacatatttaaaaaagtcaacggcgtcaaatatttagggacagagagagtacatatatacgcgcgcactaattacagtttgcctataaatatgaatggtcaaattttgctacatgacactgcttttgtgttgttttagccctaagacactgcccaaactcacttttgggggaaaacactccataaacatggtaatttgccagtggacaccgcaccgattaaaataataatttccggttgaaggggagagaaaaatcacgtgaaatgtcaaaaatacccttgggcccacatgtcagttctgtctcctatctctcttctcctctatattctctcggaggcaca

SEQ ID NO: 19250 - DNA, 1501 bp, Oryza sativa
aaaaatgactaactttaatctctgacggtatttctccttttcctctctctatatatgtcatattttgcaatagaattttggtaagatgatagaggcattgcaacttacatctcgaaattttcttaatttttgaagttgtttacattgcttcgaagcacctaagattgattgaaaccatctagattttaaagaaagcaaacattaataaaaaattaagaatatttttgaacatccatgatggtgtcaactatagcgataaaataatttcagcttaaaatataacttgtataaagtggaaaacaagataaatattattaactgaactatgtttaataggttagtgtaaaatgagccaaataatttgctgagggtaagggatccaaagaaaaagtttaggggagtaaacataatttaagtatccacaaatataactggacactatgggccctgtccatgggtccgtttgatttgtaaacaaatataggaattttggaggatttcaatcctataagaaattccatatgaagatatttgaaataaatgatttaattcgatcatatcctttaaaattcatatgaaataaacagtactatagagattttggagaaaacatagtaatagttctaacctcttgaaaaatttcctgagttctaacctcttgaaaaatttccttcgagactacctctcttatttgattagcgtgttttttctgtggtccaagcaaatgattattcctatgttttacgattatttgttttgcacttggatttcagtcaaaatcttttttttttgagaaaaactaacccaaaggattccgttgccgcgagataaattaatccccactcccatactcactccccttgtctccctctttcctccgtcatgggcaacctttctgtccgccttcccctccgcctcgactttgtctcgtctacccgcgagttcctcctctctgcctgcgtcgagcaacgccgatgtctccgtcgcccgcttcccacgagccaccagcgcggccgtccttgcccgctgctcccgctgcctccttgtcggtgagtgtaggtatgaccatcctctttctcatcgttcccatttttttctttgcctcaaactcaacttctctggtagatctgaaagcttctcttttgggtttaatagtagcttgcttcgaacggaatttggaggagttgttcagctgaggctccatgccccccccattaggcccgccccaatggctcatctgctgccgtagcagaaggagaagaagccagcggtcccggtgccttggttgtcgcaacaccggcggcaacctactctgggacctctcattccattgctattttccttcgtttcgtaaagtagaggggctcgcaacaccgacaaggaatgaagtcaacagagctagcgttagggataggagcagtgtcgcaatacgataatagaatgcgctttaccaaataaatatcatcttctttggtttagatatgcgattaggattattacc

SEQ ID NO: 19251 - DNA, 1324 bp, Oryza sativa
acctcggattcttccgccgccggctatccatggtcggcgcttcaccggtggcggcgaacaggtccgagaccgaccgcttgctgtcttcctggccaccggcgccgccgccgccggcgagctacgacgacgacgacgacgactcaccgcggcgtgtagctcgtcgacccaccaccggaacctccggattggcatcggcgggaagtccccggcggcggagagggccgggtgccggaaccccgccgtgcccctcatgctcgccgcgtactccctttttcgtgtcagtcaacaccaaaccaagaaacaagaatatcaagaaaccaaaaattaaaaaaacaaaacaagaaaacacaaagcatcaaactacataccggatggagaaggagggcgccatggatggatgagctcaagaatcccaaagaaatcgatcgatcgatctctacatggaaacgtgtgtagagagtttgagatgtggtgtggttggcgaggaggaggggaggagacaggaagtatataaggtacaacaaatttcttaaaggataagaaatttaggctcgcttttttaatgttttcccgctctttgtttaacttttcttttcagctgttggtcggccgtggacccgcgtcgtcgtcgtcttcactgggcgtgcagcgtgcattgctacccgtcgatttcagacaaagaggaccagtagtaccccctccatcaaataagataattatatttgcagtctgcatatattcaaaatgtaatgagagataaattaaatagttgaccaaaatacgagtactcattttaatactcattgattatatgtatgtatacactatttactatttattttatactggatgagttaattttttcttgatcttaatgataaaaatattaatactcctatgttgggaattactccttacttttctgtcacatcgtaccaatttcaactaaacttccaaacttcagtgtgaactaaacacaaacacagccgtagctttgtttagtcggtggacacgaacagaacagctgaacaaatcacacatgcttttggttgatatggccacacaacaaccctcatcattttctcattatatagattcatacgagcaaggccgagtttagttgcaaacttttttttcaaactttcaatttttccatcacatcaaaactttcctacacatatgccgtgtttagttctaaagtttttttttcaaactttcaacttttccatcacatcaaaattttcctacacatacaaacttctaactttcccatcacatcgttccaatttcaaccaaacttccaattttggtgtgaagtaaacac

SEQ ID NO: 19252 - DNA, 179 bp, Oryza sativa
ttgtagtttcgtaaagttattgcaaaatttaaaattataatgtcattttaatatatttgaataatataatgagaaaacatatatgctattatatgagagaaaatataatgatgctagccacacaatctgcgcggggcaccatgctagttttattaaaaaaactaaagcgatttgtaata

SEQ ID NO: 19253 - DNA, 1501 bp, Oryza sativa
gtgcctgaccgaagctggaggcctactagacaggcccaggtttgtgttcggccgaaccctagtggcgacggctcagctcggccctccatgtgtacgctccagatactcttccaatgacggttacaggggcaaaaccgacatttcgcgttgctacaaccgtcataccggccctataaaaggaggagctcattcactctcttaacacactcaagcaagctaaattcctctccatacattagtattaatagtatggtgctaagaggaatagtatagaatagtgttcgaaaggcctcagagtcttcggaagagttttcaatatggctctagcagctcttgtaatctcttttgtaatactttccgaattaatgaatattcttctttatatatcttcggcactttgcttagtctgagtactggtcttactttatttttgcattatattaattgtgtgggtagtctaccagagaggtgttatggtgcgggtttaatgtctgatttatcagttgctctatgtcgactgcacgggtatagagtagtatttgataatataagcatggtgcttagattattaaatatcattagttgggcatatatgctgcgggacagtagaggtgggccgctgatggtgacagctcagtacggatattcctccatgttagtatatattcctaagataaattcctggggagggtactcctccgtatttaacctcggttggacggtcatgacatgttatcgtacggaactcggcaacccggggtggtctttcgaagtaccaggaggacactgttagggggtattagccacatgattgtacatttgcatatgcaaactaggatttgagtgtatactagaagtataggaattgaatgctttctatttcttcttccacttacttagaattatttcattacgaggattgaatagctttgcttcatgtcactctacccttatattacatttaacccctatttaggctttgacaattataagtaatatacgtataaagtgcattagcaatgctcactcttattatcttcccttgacattaaaaatacgataccttgaagtacttccgggtgaaatgctataatgatatatccgtgcgcttgcggataaccataaatataccaggactatttctggcgcaattgctaggaatgaatatttctagtaatatcgttaagaaataccaacactggctactgtagagggatggtggcaacaacggcgaccactagctccaccgaatcctaaaggagatgaccggatctagtggcagcaggcaaggaagactagctccaatgatgataggtaaggggatgacgttcatcggtgcggccatgaggagcttttcggacattcgatcaagcagtggcgagtgaggggacactaacttggtagtactccctccctccatctaaaagtgttagacgtaggatgttactcacaattaatcttttcattagtgtagaatagatatggcaatggtgaattcacc

SEQ ID NO: 19254 - DNA, 1501 bp, Oryza sativa
caaaactctacttttaattttattatgtttattccgaattttagttagttttaaattcatatatggactctatactctacttataatattccttattttttaatttcgaatttatattttttcttaattgtatttctatatgtactctatactctacttctaatatttcttatttttaattccaaatttctattatttcctaattgtattttatatggactctatactctacttctaatattccttatttttaattccgaatttcagttattttctagttgtatttctatatggattctagtctcctcttctaatattccttattttttaattctgaatttcaactatttctaaattgtatttctatatgtagtcaactcttctaatattccttattttttaattccgaatttcaactatttctaaattgtatttctatatgtactctagtcttctcttctaatattccttattttttaattccgaatttcagctatttctaaattgtatttctatacggactctgctttttttctttttctccgattaatgtgagaatttctaggccatgagagcaaacgtggaggctcctttttctattcctttaataataatataatagatgtttcaaagtttaactacatttataaaaaaatataacaatatttttaacacaaaacaaatctactattgaaatatattcaatgttatatttaataaaataatttttgtatggtagatattgctattttttttataaatttggacaaatctaaaaaaattaaaacaactcgtaacataaaacaaatatggagttctaagaaaaaccggttgcaccataccttgacctcgaggctcaagagggtaccgacaaaaccggttccttccatccataggtgtagccccacaactacattgcaaatagcagtagttcatatattacacagtcaaatatattggggctttttttttctaaaacagacgtattaggatttgggagccacatttttcctgtgcttaccaaaattcagcaggaagggatgcattcgtgcatgtgtttgtttagatggatgggaaagtaggattcctagcccatccacatgatgggccaatttttttaaaacaaaaatcttaaacccatacttgctgcatacatgaaataataataattaaaaaatctatttccctctttttttctctctcccctcttgtgcacggtggctactgccaccattttccacttctatccccatctccagtgcttttccttggccacaaccaacataaagaaacgcaccacattctcttccatttccttcgccgccgaaatcgccgtcgtcggagtcaaaagggccaaagtgtttgtccttaatttttctcctatttccaaagtcattcggccaccaaagctcgtcgacaacacacacccaccgccccacggcaaccgccctgctcggccttgctttgccactgaccaggccacatgacacaatccacatcc

SEQ ID NO: 19255 - DNA, 1501 bp, Oryza sativa
gtttaatgtaggcttcaacgggatggcggttgtttttgcaataggttttatttaaactcttttcttcaacaactaagtgagtgcttctcaaacgacacggatgagacagtgcgtctcgtccggtcggagtatgtgcaaggtatcagtcttctgaattgatcaaggttggcgtccggccaacagctttcaaacggccacccgggcctggctgatcccatcagccgcagattttccaaacatcgaacccaaaccacatcagcaaatttcacaaagcagtagtcaaacaaaactacgctaggaatcacctcacatctgcctatgaccgtgggcacggctgttcgaacagtttaataacctctgcagagagggtacactttacccacacgacgttactaacccgggtcacccagcccgtgcagaacagccacgtctggcgactttgaggctttcacgacaaggcatttccaaagccgacacatgttcaccatatgccaacgagaggggtcccagaccaacaccagattaggtcccagaccatactgtgccaggaaacccgggggttctccccgacaccaccgcgttgaatccacatgtctcttggcatcatggctcccccgattagctaattactcagccaggggcgtcccattacacccatgtggtcgcacttgtcttatgttcggatgaaattccaaggaaacggtccttagtgcaagagcgggaaaccatacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtacagagtgcacgattaccgaggcgcaactaggtggttacaagggaacatgatataacaattaacaatggaaggatcagatgcaacaagttaggtaggcccaccggtctgcctagcaaacggtgcaaacagattaagtgcaatcctatcaatgcataatattttgcaagcaatataattaagttcaaatataggctcaatatgttcaaaggtggcttgccttgctcgagatcttgagcttgatcctcgaattcctcgcactgcgggtcttcgggctccgaaactacacgcaaaacaggaaaactcaacaaacggcgaaaataaagtcctattattgacctctaggcgtgccattagatagatctcgagatttgaggagttttggaagttgaacggagtcaaacggacttacggttggaaagatattgaatttctaagattattggatttttgatctaaaggaaaaggatttatttaaatcctttttgaaaaagaaaagaaagaaaagaaggagggagggaaattagactttcctcgggcggctagggcgcggcccgagagaaaggggcggctcggccgaacttaacgggccggccggcccgagaaggcggcctaaaaca

SEQ ID NO: 19256 - DNA, 1501 bp, Oryza sativa
  unsure (1)..(1501): unsure at all n locations
tgcaagctctcctccagttactgcatctgtgagtacttctgtttttcacatgtggaagtatagatcaagaatgaatataatgcggatttcttggtgcaaattaacttttacttgcatggtatatgcatgcggaggttggatatcacattctggtaagaaaaatcatctcctttttgcagcagatgcaggagagttgaaatgggtatggtaggagtacattttcatgtctatatgggaataactcaggtagaaagatcaaattggcaaagaaagcacacgattgtgttcaaatttgaattttgtgcgcgtaacaactttttttttgtgcatgtctgcgactgctttgtatatctatgtttagcagtacatttaattaattcatctctaccactttcatatctttcttaaaacctactaatagcttaagctaaattaatagtctcggtctcccagcaattttctgactatagcaaatggaatgtctgaacacattcagcacaagtgccattcatagtgcaacatactgccacccctacatgncaatgtgagcatggcaggtgggcatgcatgtcagatggccctattcaagataaaattcactgtgaaattaaatgcatgtaaccaggccagtggagtagtacttatacaagtcatgagcccaatgaattatagaaatataaaagattcctcccttcgtccaaaaaaagtctatccaaactcctagaaaaaacaaagtcttctgggacgataatcatagcattttatgtggcgacggttcattgtgctaccttcgttttttaatacatgacactattaacttgttaatcaacgtttaacgaccattcgtcttattgatttttttctacaaacataaaaaattaagaaataccatttaatgataaattaattaagtcccaacaaaacaaattataataatatttttttgaaaataaaataaatgttcagacatatttcaaaaaattaatgccttcatgtattaaaaagagagagcagtactagtactaattatcagcatgaatggatcatgatgcatgagtgaagtcataaaatgcaatctttttatgcagagcagtgttatccacattggacagtaggtaaggtatactacatccatgatccgatcgatgcacaccaaacgcccagagatttataaccggttgattgttccttgtccatgttgtgacaactggcaagatcgaagcctatcttggtacgtgtcctgtcgaattaataccgtcaagtatgaggtgatgagatatggtatactctttccgttaaaaaaaaaactccatccgttctaaaatgtaagcatttttaacatagtgacaagtgaaaatattttaactttgactattaataataaaaaaatcaatcatgtaaaattgatgttactacattcatcattagacaaactatcatcattatatgtaactccttttatttaaaacatcttacttttatagatattattggtcaaaat

SEQ ID NO: 19257 - DNA, 1501 bp, Oryza sativa
aagggtcagaagccatagagctaagccacaagttggggaagcatgttacattctcaggggtggatgacatacatattagaaacaagctaagttccacgttaccccaactgcaaaaccactgcaatgtgtactcagacaagtctaatgaagctgacagattagtatctgcaaaaattagttctcatgagaacaaggaagcctcaggtagggatatatacgacagatggacttctgaatcaagtggtgcaaaggacccaattaacttgattgatctgaatcgcacgctcccatgtattcccgattttaatggcgcattcatttctggttcagaggtgcctgatcttgagcatacggagaatgcaacttctgatctccaaatacctggtgatgtaagagaagaagctgttcttaagcacaatcaagacctccattccaaatcaccgcgatcgcagtgtgaacttaacagttgtgatcttgggagaatcattaacttaagatcaatagcctcactgttgcctgatgaagcaattaacatttctgacagaggaatgattggtcatccattgaactcaacagaagttaataagttttatgctgattatgagagaagttcagtaagagatgatactatggaaggaaaggctccttacatattgcctcagcatacagttcagtacacaagtcagtttacggagaattggtacaccaatatgaatttgggcaactttcatcatgctggaagagaattttcttcttgtccatgtgaaaaccagctgaattctgagaaacccatgttacattctgaaatcaatgtgcaacatgagcatgcagttatgtcacaacgtaccatgcgtctgatgggaaaagatcttacagtttccacaacaggtggcaaatgcattggtgagacagcaaaggtgcatgtgaactcctctgtcagctgccatcatactactaatattttcttagagttgccacgacaaggtcacccgtttctgtcactgcaatcccgaagtttttccaatatacaggtagatgccccaagcacaagccatgattatgttggatacaaaatgcataatttaaagcgtcgttttccggaagctgatgttttctctgggaatggaatcgaatgcgaagataggttgagggacttttcatatttgcactgtggccaaaatgcgcttgctggattttcacctcaaggaggaaaatacaacacaagatctgatcaaaactcactgtctgctacaacattcttgcctaccttgataccacatgccaagcagtcagcagtttaccgtgccaattcaacttggaaacataatccctatcctgcaaacttactagttcatcctcctgatggtacaaattttagaaaggatcaaaaccagataatcagaggagttgcagagatcccaagttctgtaaacccatgtcaagagatactgtttggaagacgagaaaaatagacgtcgacaattctaacatttcttctggt

SEQ ID NO: 19258 - DNA, 1501 bp, Oryza sativa
agtgctaaaactgcacttattttgggacagaaggagtacttaatttgtacggaaaatcgaatcccagtaaatgaagcaagccccaaccacattgaagtgtatgatactgcacgtgctattttacccagtaaatgttgcggatgaaattccatattacccgtttcatattataagtttgattaggtttataaaacaatttagcaacatctaacattaaatatattatcattgataatatatttgttttgcgttgaaaatactaatatatttttctataaacttaattaaacttgactattaaaaaaagtcaaacgacttataaaatgaaactgacgagtacatttgaatgaaagcaataactacaaatttttttgacggaaaaaagatactactatgttttggggtcgaaaccacgattaggatggcagggcttcgttgtagaattgatcctttcggcaagttgggtgacacggttgcgaggaattaattcctcgtaagcactattttttttccttcaagaaacaatgaattcaagaaaattaaatttcacaacattacacttcgttcaaactaaagattgaaggtgtggtaaaaagatataatattaccgtgaaatttcttactacaaattaacatggaatatcataaaaattaaagattaagtagtaaatctatcaaattataacgtttatagctttaaccggaacaatatcactagagatttaaactctaaaatatgtagttttataataatttcaatattaaatatatagttttgcgatacttaactttaaatatataattttataataattttacgttgaatcaatagttttctgaaatttactcatgcaagaaaaattttgtctctatcttttacttgaagtaactgctcattactcaatcagtcaaagttgagcaaccaactcaacaacaaagtcggatgaggtgaaggtctcagttcagacttgacaatggagaagagcaaatatgaatcggcatttagggctgatttggtttgatgcactaccaaaccattggtagcaccactaccaatgttttggtagagttgaactatataaattgtattagctatagtaaatattggcatcaaaacatctacaaagtactatttaaattgactactggttggtaggacaagttttgacatcagaccaaaacaaccctcagagtttcagacacaagaatataaaacgaggtgaatacagcacacgcgccgacgcgactgtcactaattttggcaaggaaaatctcagaaaccaccaaaacgacgcttcttgcgcctgcttccctcttccccgtgcgtctccaacgtacgaacgaacattggcgacgtggaggcacctgcgccgagcaaacgcaaagcgcggccgtatttatccaacccgatcgatcgatcgatccccaaccgcacgcacccgagccccactgcaatcccacctccccaactccgccgcacgcatccccgcacccgccacca

SEQ ID NO: 19259 - DNA, 1501 bp, Oryza sativa
taattttttaaataagacaaatggtcaaacatgtttaaaaaagtcagcagcgttaaacatttagggaaggagggagtatattatacgagcactcaccttctccatggcgccggtgatagtcattgcctccggagcgagatggaagcagccccgcgcgtcgccggccggagtggccttctcccaaattaatagggcgttcttgcttccaagagtcggaaacggaagtatcaattggaatcggatgacaaagtggtattgacggttttgtgatggatgcaggcatgatcacactaattaattaccttgcttgatcggagtaggcggcggaatcgatcgggaaaggggtgtgtgtggagaaaaagacacggcggcgttgccaccggcgacggcgacgacggcggcggcgctcctcgcgactcgcggagacgaaggccgcgcggctgcggctgcggctgcgaggtaggctttggctgggattgatatatccgatcagtatttttttttttgagggaaatccgatcagtaaatataatggtatgtttggttttcccgaaaagtaatctacttaggtattaccaaattttataacgagttattattttataaataaataaataaaaatacaaagacatactacgtatgatttgagtgagaccttaccatatttttgcaactttataggtggacattgtggaagttacgaaaatgtggctttttttttgtggttatagacttattataggtgcatttttttaaaaaacaaaactcaacgctgatgtggcctgtattccctataacccccaccatctcgtaaatcaaagagttgagaactttgttagagagattttttttaagtatcctagtggaaacaaataatttgaggttatgcgttaaaaggtgcaaacagaaaactgattatgcggcagaaaaggcccaacgaaccaccgccttatttgcaaattgcgtgtcttcggtccggtaaaacttgggagccaagttggctgggggggcaaacttgatagccaagttttgcctgcatttcgagttggtcaaaaatctgtatttccaaaactgctagtctcactttcagatccgtaatgctggagcagaaatttgcacccgtccatgaagaggtgtatttgtcaaaccacatatacatacatgtcgccatggaattcgtaccgttgaatctttctttggcactatagtttcacaagataaaacgaatgcaacgaggagacaatgactgactgaccctgtatatcaccccactcatgaactcgtggtagcccagcccagccagcaaagcccatcaggttcaagaacaggcccaccaacaaaaacacgcccggcccaattgtgcacgttctcgtgtactcaagcctgaaagggatcagttgtgagcttccatccttttcacaaaacacttttagtttcaatcatgcgctgtgccaatactgccaaacaccaaaaccaaacaaaccaaattcttctagatcct

SEQ ID NO: 19260 - DNA, 1501 bp, Oryza sativa
ttgcaaaattgagtgtaacttctacaaagagcaagactccagactctaaacaaattgctgaacataggcatgaatgtggaggtgcctgttgggcagctgttttgccagctgatatagttttagctgggcggataatggcacagtacatagagaaacaattgctggtcggaaagagatctaccatctctggtccaaatctggtataagagaattcatgtctgcaagcactcaaatgttatagcataagtactgttacatcaggaactaatgaactaaactgttgcaggatctcgttcaccactatgatcaagattcttctgctagcaaatttgagtcacatatatatgcaactgtcctgttcttatgcctccagagctattataaatcaggtgtctcgtgggcagaggattctttatcacaggtatatgtggcatttgtcctcaagagttccctttgtatgtttacattttcaattgcttgtttcattacaactgtggcttgagcttgatggctgctttagtcagattttttggattgttctggatatcagatttgacattattgtttatattagctcagtactccctccattccaaattgatctacatatttcataggtacactaagaccaagaaaagttaataactctctcatactatatttactctagcatcaaacttgatgcatgcactatccccactatttcttagccaatagcaaatcaagatattgcatgtgggttatacttgtgtgcatggatgcatgcatcaatgtccatttactccaatgcacaaataacgaataggcttaatgaatgaacacaaatatgtagatcatttaggaataacctcaaaaatactatatgtagatcaatttggaatggagggagtatttcttaaactttcagaattctgccatatacttctgccccctaggatgtagattgtagagaactgatggaacactattttcatatttatttataattactgaagaagaagctaattcttgtaactatatctgcagttggttcttttgatatgtcaaattaaagtcaactcaattgcaattgttcatatgaaatccatggatggagtcaaggcgctgacaaaggggttttctggatttagtggtgatgttatgtgtagtgtggaacaggtttgtctcctcttcttatcttctctagtaacatcaccctataaaagctgtttgatatttgttgccaaccatggtgtttctataggagtacattatttaggatagtatgtttctgaatcatgttcaggtaaatagcaatttggaaattgaaaaattctttgtagtaaattcagcaaacacatgacaacatgtagctaatcttaaattgcaataaatagcaatatcaggcacagtattgtattactcttactttgctttagttgagttatcgcaccgcagctcatttattatcttgaccatctataacctgtgtttagttttgcattgttaggtcagggttgct

SEQ ID NO: 19261 - DNA, 1501 bp, Oryza sativa
ctgtatgggagtcgagacacttgggtggttgactgtctgaccccatgattttggaaacaaccttctttactgcgtctctttacaataaataatcctacaagtgaattttaacatccgatacataattccagatcgatattgaagtcctataattagtttcataaaaccatattgttaactatcttgcgagacccaatttttcctcttcttttttgggactttgagttactactatagcaaatagcacagataataaatgaaatgcttaccttgttactgtggccaaaataataataaaatgattatcttaagtggctaaggcttacaatgaattgaaagaattcataaatttaatttaactttagagcttatggtggatgaaaaaaagaattagtcgatgacgtggttttatgaaactttagaatcataataatactatgtttattgttacgtgtcaacttttatttatgtaaagagttatagtactaggctaatttatttcctcaccattttcaacttctacctttcgtttttcacgcgcatatgctttttgaactgctaaactgtgtcttttttttctttgcaaagttttaggtattccaatataggtacttctaaggaggttcgctagtactcagaaacccaggaggccaggcagtgaaacgttccgcagactgctcacccggccacacctcggagccgatgaaggctggcaatacaagcatcatatagaaatgttgccttaaaaaacatattaatctaatttttaagtttattttagttaatacagtattaaattaatcatgtgcaaataagttgtttcgttcgcgtgcgcgtaggattaaggtccctacatgttttgtccaacccagcctaagatatttctttttttttttgtaaaagtgttttctaaaagggcttaattgtgaaaactacccaaacatgggcctcgtagcccaacacaagataccatttcggcccagacaaaaaatcgattcgctaccagtagcggcccagtacggcgccggcggtgccgaagccgaaaatttccatccctcgcagtcgcagcagccacctctcgccaaactccctcttcgcgccgccgcccgccattgccgccgccaccaccaccgtgcccgagctcgccgaccaccaccccgccgtggctcgcgcgagatgcgttcacgcgagcccctgagcgctccctcgcaatgaacccgggcgctcgcccgcccgcgttgcagacgctctccgcccgcctctggccgcgcaggcggctctgcggagtccacgcggggagccggagcgggggcgaggggcctggagctagggagagtggtggtggtgacgttcgcattggaaggggggaggaggaggaggagggagggttggatggcggacgcgtcccgcaggaagtgctgctccggctgccgacgccgcccggccgggctgagaccgacgacgatgatggcgaaaacttgtcccctggcgcggggtccgg

SEQ ID NO: 19262 - DNA, 1501 bp, Oryza sativa
tacagggtcagtcagtcattgtctcctcgttgcattcgttttatcttgtgaaactatagtgccaaagaaagattcaacggtacgaattccatggcgacatgtatgtatatgtggtttgacaaatacacctcttcatggacgggtgcaaatttctgctccagcattacggatctgaaagtgagactagcagttttggaaatacagatttttgaccaactcgaaatgcaggcaaaacttggctatcaagtttgcccccccagccaacttggctcccaagttttaccggaccgaagacacgcaatttgcaaataaggcggtggttcgttgggccttttctgccgcataatcagttttctgtttgcaccttttaacgcataacctcaaattatttgtttccactaggatacttaaaaaaaatctctctaacaaagttctcaactctttgatttacgagatggtgggggttatagggaatacaggccacatcagcgttgagttttgttttttaaaaaaatgcacctataataagtctataaccacaaaaaaaaagccacattttcgtaacttccacaatgtccacctataaagttgcaaaaatatggtaaggtctcactcaaatcatacgtagtatgtctttgtatttttatttatttatttataaaataataactcgttataaaatttggtaatacctaagtagattacttttcgggaaaaccaaacataccattatatttactgatcggatttccctcaaaaaaaaaaatactgatcggatatatcaatcccagccaaagcctacctcgcagccgcagccgcagccgcgcggccttcgtctccgcgagtcgcgaggagcgccgccgccgtcgtcgccgtcgccggtggcaacgccgccgtgtctttttctccacacacacccctttcccgatcgattccgccgcctactccgatcaagcaaggtaattaattagtgtgatcatgcctgcatccatcacaaaaccgtcaataccactttgtcatccgattccaattgatacttccgtttccgactcttggaagcaagaacgccctattaatttgggagaaggccactccggccggcgacgcgcggggctgcttccatctcgctccggaggcaatgactatcaccggcgccatggagaaggtgagtgctcgtataatatactccctccttccctaaatgtttaacgctgctgacttttttaaacatgtttgaccatttgtcttatttaaaaaattatataaaatatgtaaaactatatgtatacataaaagtatatttaacaataaattaaatgatagaaaaagaattaataattacttaaatttttcaaataagacgaacggtcaaacatttttaaaaaagtcaatggtgtcaaacattttgggatggagggagtattagattagaaatttcttgtgggagtgctcgtatgtttgtctggtacgcaagcagtaagattgaatggcttaattaata

SEQ ID NO: 19263 - DNA, 1501 bp, Oryza sativa
aaacaacccaagcatataagatgcattcaacaaagttcccaaaccgtattgctaccttagcataattaggtgaaacagaaatggccctgtcgcaatctcgcagacactcttccaaaaggcccaatttctgtaaacttcagaaacatgatcagaacgcatgcactatccagtaatgaggtcagatggcaggaaaaaaatccttagatacataaaagggaataagctgaatataacctattcacaatgcactgtttaccatgaaacaccaccaagaactagaacattacatcaatatgtccagaatgcaaacaggtaaatgaaagactcacatgcatggtagaggcacggttgacatataatgtggctatcaagcttgcatccgttccatcaggactaatcgggaagtaccgtaacgcctgtaacaacagagaaaaacaattagctatcatcaagactgatagattgaatatcaataaaatgggcattgtcccgtgccgatttgttccaaaaaaaaaaagacagatagattgcagtccacacacataaatgctagtactgaaaaggagtgaggatcattttcttttgcaatatcaacgcatcactctttaaaaaacagaacaggtgaacaacaacaaacttcgaacagtaaagttacttctgacttctgaacttgcactcatttttaccaatcgaatcagaacccatcacttcatcacctacacaatccaagcaatcaagaggaagaagaagaaaaataaacgagtaacacaacaaatcaacctgcgagtagaatccaagcgcttgctcgaactctctcttggagaagcacgcattccccttccccttcagctcggccgccctccccttgtccttgcggcacagcgcgagctccgggtcggtcagctcaccaatcacctgccctcacaccaacacgccacgcgaacgataccatcaaatctagccgcacccccccatgcctgggggaagaggaggagcagcggagcaccgagcgacgggaggtggttacctggcggaagagagggagagcttcgaggaaggcgagcaagcgggaggtggtggaggggaggtcggccgccgtgccctcgccgacggctcgccggagctccgccggcaccgccgacttgagccgctccatgggcgagggagagtgtgtgggctgtgggcagcagcacgcggcgctcgggctttgagcccaactggatgtattgagcctacgtgggctgagatgtgggcacagtatagttgggccttttgggcagaggctattcgtcccactacgacggcccaatgaggtgtgcagcgtagtttggacttttcatttgggcccctgaattgacaagtattctccatttgggccactgttgcattttcctactttgctaccttgcttggatgatggatataaatatacagaaaacctacaccacgggcttccgggacaactactatcactaaatatctagcatccttatcctcttct

SEQ ID NO: 19264 - DNA, 1501 bp, Oryza sativa
ataaacgagtaacacaacaaatcaacctgcgagtagaatccaagcgcttgctcgaactctctcttggagaagcacgcattccccttccccttcagctcggccgccctccccttgtccttgcggcacagcgcgagctccgggtcggtcagctcaccaatcacctgccctcacaccaacacgccacgcgaacgataccatcaaatctagccgcacccccccatgcctgggggaagaggaggagcagcggagcaccgagcgacgggaggtggttacctggcggaagagagggagagcttcgaggaaggcgagcaagcgggaggtggtggaggggaggtcggccgccgtgccctcgccgacggctcgccggagctccgccggcaccgccgacttgagccgctccatgggcgagggagagtgtgtgggctgtgggcagcagcacgcggcgctcgggctttgagcccaactggatgtattgagcctacgtgggctgagatgtgggcacagtatagttgggccttttgggcagaggctattcgtcccactacgacggcccaatgaggtgtgcagcgtagtttggacttttcatttgggcccctgaattgacaagtattctccatttgggccactgttgcattttcctactttgctaccttgcttggatgatggatataaatatacagaaaacctacaccacgggcttccgggacaactactatcactaaatatctagcatccttatcctcttctttgtctctttcccttccttctcccttctctctctctctctgactaccagcacgaagatgacgatggtggctagctgtgcggggtggcgcgttgggcgtggaggacgctcgtcggagccagtgcccgccgttgtccccgtcgccgtcgccccaccgccgcggggtcgaggcgacgacgaggagctcggcgataggtgcggtgaataagagggagagtgggagcgggacgtggaggccgctgctggcgccggggacggcgttgccgggcgggagcttctcctgtcggctcaagacctcggccgccgaggaggacgacgacggcgcggccccggcaagggtcgccctcaagctcgcctcccttaccgcgctgctctggctccccgccctcgttggtcttctcatcggctgccccaccttgacgaccatcggattcgccgctgcctcctcctccacactccgcctcgccgaccaccagattcgccgccgcctcctcctcctgctccaccacgtggctgccttctcctctctctctctctctccttctcctcctccaagttaccaggtaccaggtatcacggataccaggtacaaggtattaggtatcatggtaccagataccaggtaccagccggtaccagatttcaggtatcaaaggtatcagtcggtaccaaaggtaccaagcaccaggtaccaactgatacccaaggtactaggtatcaagatggagtgcacgtggaagcggagaggagtcactt

SEQ ID NO: 19265 - DNA, 1501 bp, Oryza sativa
tgttaatgaatcaaatatatatttaaattttactccctcgatttcatatatatggtaacattaatacgaatgtgagaaatgttagaatgatttaaattgtgaaagggaagtcgaggcagtctctcgccgtgccctggtcgagcttgaggaagatggggctgggtggctttacgtgcggcaggaaaatcggcccagtggtgttagatttcttgggctggatgtttctggttttttaatgcctgtttgattcgttgccgaaatcgacctcgccaaatttcgttaaatgcaaaaattagttaacatggtgaaaatgttgtttagtttgagaccatactgaaatttgatatggattggcgagtggaaggttcaggaataaccaaattttgatacgaatttataaggttatgagttatgacattaagagtttgtttggtttactgttataccaaaagtaattgtaacacctcaaaccagatacctaaattcaaggaaccctcacatttggctctttgcttttgggttgctacgaatggcaggcaacttcctccgtttcaggttataatactttctagtattgtgtatattcatatatatatatttagattcattaacatatatatgaatgtggacaatgctaaaaagtattataacctgaaacggaggtagtactatttgtttgggtggtcgttaccaacaattaattaatatcgatcatgtatttttcatttgggcccttgtttggtagtagcgatcatgaatgtttcatatggcctctagatttcaaccagtatttttcatttgggctaccagttgaatcgctatcagtggtaacgatgaagtgtttttcatgtggaccctggtttggatctagtataggtcgttaccttgttgttttttttttgttttttttttactccctgtaaattttgggggcttggatggatgtattacatgtgcaagaagccaagaactgtgggggttttggtggcctaaccgatcgtctcacacgggcaccgtgttgttaccggtcgataccaaaatatgggaccgatgtgggatgtcaggtcgcacagatgacggacacactcatgtaggtgaagagaggttgtggagaagcatcaagactcgggcattgttcggttggaagaggaaacttggtactgttctgggaggatatctggataaatgggtcatcgatttgttagttggcgccttccatctatgatgcggttcctgcgagatttcgcaatcacaggacagttgcagaagcacttctcaacaaaagatggattcaagacataactggtgccctgggaatgcaggctattctcgagtatcttagcctctggccagtgatgaagtctatacagctctcggaccaggaggattcgctgcactggagatgggagacgtcaggtgaatactcctctcggtcggcctatcaagcacaattcctgggtcgcattcgcttccagtccagcccaatctagaaatctttagc

SEQ ID NO: 19266 - DNA, 1501 bp, Oryza sativa
gcggtgccgcctccgtcgtcggattcgcagcggtgcgttccacgtcgtccccgtctccgtgcagctgccgccggctgccctcatcgtctcctcgccggccccggtcgtcgtcgtcgtcgtcctctcgtcgttctcggtcgtcgtggcgttcgtccctccgtcgagccgttctcgttcgtcgtccgcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgtccgtgctcgttgtgcggtcgtcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccatggaccgactctgtgtactcggtctaccgcggtcctttaggttgacatgtggggtccgcatgtcaacggcgcagccttcctgtcttttccaggctagcgcttacacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcgccgaaggttcggaaggccgttctctctgagcaaggcaagtcacatcatccttgaacatattgaatcccagtttataaaattattttgatttaaattattgcattaacgctttatttaaattcccgcgtgatcactgttttatttagccatgcctatttacctttgttatgaccttaatattattgttattgatattattaccttgttcaccctagattaaacaaaaccccaactagtggacactctattcatggttccacaagtatgaatttaggtagatgcttcgctgattaattaggcaatattaggtggttttataactttagactttgggaattctcatatcacctggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 19267 - DNA, 1306 bp, Oryza sativa
aatatgtcacatccggtcctagattcgttttttatgggacggagggagtacagcacaagatagttgaaggacattagtattatatattaaaggagcacactcatgatcctaggcagaatttaaatatatattttttgtgaggattaacagaaaatatatacccacaagttcaattagctagtatttcaatgttacaagctaagttcagcaatcaagtatctttccagtttctacctactttcccaaagcaagaactgcagagaacagagaccaagaaataggcctgaaataatttccctagcagtttgcaggtcgaagcccacaagcttttgtgaaaacttgccccaaattacaagctaatggtgcaatgccatgaggtaaattaacctgtgcagtgatgtcacacaaaggtaggtaaaataaggcaaaagaattgattaaaccccatgcaattaatggttacaatgtgcaggtaggccagccaagaggggaaaggaggaaagttcaggaggaagaaaaacaccaggggcaatatatagatggactctctccacagctaccaccactccatctcatctcatccttccccaaccattctcttctccttgaacacacccctctcttcctcattataatctcttctttgattagagaggaattagcaaacatgcacatatacaaagagcaggaggctgaaccatccactggcctgatggtaattgtttttcttggcttggaaactcctaaatttcctcttctctttcagtgtcattttgcaagagggtttggatttcttttttaattgtatgcatatgggagctttgggaaagtagaaaagtagaatcatggctgctagctgatgtgtgagaatagctagatggccatgaagagggagagatatagctagagatctttagtctttaagcaaaacaagaaaaagaagaaaaaaaggtgaaagaaaggcacaagatcaaggagattgatcaccacaggaccaaagatctctccttttttttcccctcaaaaaaagatctctcctttttccttcgatctacaagaattatacaactcacaaaagggggctgtagttacatatattgatttttaagagagatgatggccatgatgtctccagcacttcttgattttcttgccaaagatccatcttccggtcttgcaatttcttgattatgttggctcatgctgtgctgctaagttcttacatagaggactgagtcatatctctggaattattttgtgactcaaatttagatgccagagccagcacctgttgcttcccccggct

SEQ ID NO: 19268 - DNA, 342 bp, Oryza sativa
tgagggctccttttagaccaaggataatttaacaaaaattctccgggccacattcgaatttttcttgtacgtattttagtgtttgccaaattcttttcgaattttaattaattctattattccttttagcgaatgatttttaattcgggatgaatttatcaggacgtgacaaatccaccccccttacaggaatctcgtccccgagattcgaggaggctagcaagaggataggttgggcggtcttctcttcttgtctgactccttccgctccgtcttctataacaaacttgcctaacaaaacttctccactctggactgcttggctcgatctcctgttgcaga

SEQ ID NO: 19269 - DNA, 1501 bp, Oryza sativa
catatatatggtgatgtgcgtccatctcaccttcttttctgttactacatatatgtgcttcagttaattaactgtcttgttgttacttctgtgctttcttgggggtagtagcaactagcaagtgagaaagaaattgcaggagtttctttgtgtgtgtgtgatgatctgtgtgcttgctgatgtggtgtgcacatttctggtttcttttgtgtttcctgtgaggtgagctagatgtgtagatagattcagcacaatgcatactttgtgaagcaagcatgagcatgtacatgcattcttgtgagcttttctatgtgtgtgatgggtgtctgtgactgtgtgtctgtgtgtgttgctttggcttggtggtcctgttcttttattgctccatttatggttctttcctttctctacctctgtctggttgtgatgaggcttgctttagatccttaatacctcactgcatatagcggtcatatattatattttctctattggctatgcatgtgtgcagtaacttgtaactactagtaactagtatgcaagattgtgggcatgtgaggtttgatgttttttttttcagaggtaaaaagtggtgtacacgagtgatgcacacattgatcattcatgattcttttgcatcatcttcttcaattggaggttagttagggttagggtttcatcacatcctccatctctctctctctctctctgcagagtgctgtagatgttactgttttcactagtcatttctctgttcatttacagccatgtgtggtttcctgtattaacaggatgccccatcacgagtgctctgggcccctagctacctatcctctctgacaccggcactgtacttctcatgaggtaccgaacacagtgaagtcagcagtaaataggaaaaacagtgcatgaattacccttttttttctccatctataaggtttggactttcatatgtatttttgttactacctaaggtttacagattagtaatttgtgcaatatttttagtagagaatcttaaggatttgttgtgcttctttttccttgtgcgattacagaagaaatacacgcacacatgacaccacacacgcagaccacactcacacaagtgtgtgcttagttatgcctatagttgttcagccaagaaaggataaagagtaatttatactatataatcaggatgtatgccatgataatacccttatgttctaaatcctaatcccatgtgaaaaaaaattatgaaatgtgtgatcccctgtgagtctgtgactacacatgaatgaactactagtagtagagatgagtaactagtactagtagcaaaaagatctagaaaaaaactctaaactagatcatgtatgatttgtccttcatttttaaaattacgttttaataacccgtcttggttaagaaaaaatatctttacttaaacaattaaacttcatactccaaatgttaataccctgcacaacactatctagcttagactctagtatca

SEQ ID NO: 19270 - DNA, 1501 bp, Oryza sativa
ctggtgacaatgaggtcctttggcttgctgccttccagtgaaaccttgaagtgtttcgccaaaagctatactgactgtctttgcctttgatccgaaaaagacacatctgaaactcttagtccaacaaatgtttctttggttaatcgcttgattttcttttccatcatcaggttggttattaactcgaggttagaacatagttcctctggaatgagaccctaggtctcctttgacagtaaacaattatacgcatgatcccatatcagcatcttccaaaataatcctcatagaacttgtttttatcacacatgtctcccttattacatgaatacaaggcactaccttaaacaaaaaagggaagatgcttaacatcggtacattgtttctactatgggttaggattaacatgaggcctcacaggtacggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttactgagctgtccatctggggacgatcattttgacttggagttggaattggtggttggaaatccttgctaacattggcatcagtggtaccatagttgctatcaccattggagtctttctcagtgtcaaaattgctaaggttgtcattctgggttccaacattgatactatcgttgacatcttggtgaatgctactgacattgcacgctttattcgggtggtcactaatggggcaagaaccatggttgttggtggtatcatcatcattagtattgctagtgttgttgtctgcattgcgtccatcttcttcgggcaggaattcttgatgcacaacagaagatccggtgatctgaagtggctcagtgcgctgtctttggttaccacctggaaatactgggatgttgacaatccttctcttgcagttcgtcatccgattatgctcactttcaagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgcgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgag

SEQ ID NO: 19271 - DNA, 1303 bp, Oryza sativa
tatgaagtattaaatataggctaaaaaataactaattgcacagattacgactaatttgcgagacgaatcttttaagcttaatttctacatgatttgacaatatggtgctacagtaaatatttgctaatgatggattaatttggcttaataaattcgtctcgcagtttataggcggattctataatttattttgttattagactacgtttaatacttcaaatgtgtgtccgtatatccgatgtgacacgtcaaaactttacacccctgaatctaaacacccccgaacagaacatatttatttctcatataatttgaaaaaaatcataaatcacatctgagcatgcaatacatgtatggctactgggcctctatggctctatagagttgagaaaagatgtcctcggtaaagcgcaacaactgtagcaggtagaatgacttgtgatgtaaaatttgtactagactcctgttcagactttttcaacctctccccggaccggtggatttggcattgttcttggagacaaacagatgaacacaacaatggtatatacagtacagtgtttgtacagtactatgacactcaatcttactggcttcctgatctttttgcaaattttattagcaatgactatatgaaagttagggggtgtttggatccagggactaaactttagtccctatcacatcggttatttgacactaatttgaagcattaaacataaactacttacgaaactaattatataaatgagagctaattcgcgagacaatttttttaagcctaattaatccataattagcacatatttactgtactatcacataggctaatcatggattaattaggctcaatagattcgtctcgtgaattagtccagggctatgaaaggagttttgtcatttgtctacgtacgtttaatacttttaattagtgtccatacatccaatgagatatatatggactaaaaatttttagctccatccaaacagcccctcagagtgacatttttttacaaccaaacaatgctttagattaaacattaaataagatcatgccacagttgttttattgtttagaaaatgaaaggtggcccaaactgccactaactccccttttttttttgttgatatccttcaggaaaaaccccatgttagtttgaagatttgaacttagacatatgtataattggtgaaaaaaaaaaattctagaagaaacttctataccgtggccaaaacttcgtagttattcttacttccatggacgtatgtgtgcaagtaaactaactatttatgtgtgctacta

SEQ ID NO: 19272 - DNA, 1501 bp, Oryza sativa
ttttatattcttgtgtctgaaactctgagggttgttttggtctgatgtcaaaacttgtcctaccaaccagtagtcaatttaaatagtactttgtagatgttttgatgccaatatttactatagctaatacaatttatatagttcaactctaccaaaacattggtagtggtgctaccaatggtttggtagtgcatcaaaccaaatcagccctaaatgccgattcatatttgctcttctccattgtcaagtctgaactgagaccttcacctcatccgactttgttgttgagttggttgctcaactttgactgattgagtaatgagcagttacttcaagtaaaagatagagacaaaatttttcttgcatgagtaaatttcagaaaactattgattcaacgtaaaattattataaaattatatatttaaagttaagtatcgcaaaactatatatttaatattgaaattattataaaactacatattttagagtttaaatctctagtgatattgttccggttaaagctataaacgttataatttgatagatttactacttaatctttaatttttatgatattccatgttaatttgtagtaagaaatttcacggtaatattatatctttttaccacaccttcaatctttagtttgaacgaagtgtaatgttgtgaaatttaattttcttgaattcattgtttcttgaaggaaaaaaaatagtgcttacgaggaattaattcctcgcaaccgtgtcacccaacttgccgaaaggatcaattctacaacgaagccctgccatcctaatcgtggtttcgaccccaaaacatagtagtatcttttttccgtcaaaaaaatttgtagttattgctttcattcaaatgtactcgtcagtttcattttataagtcgtttgactttttttaatagtcaagtttaattaagtttatagaaaaatatattagtattttcaacgcaaaacaaatatattatcaatgataatatatttaatgttagatgttgctaaattgttttataaacctaatcaaacttataatatgaaacgggtaatatggaatttcatccgcaacatttactgggtaaaatagcacgtgcagtatcatacacttcaatgtggttggggcttgcttcatttactgggattcgattttccgtacaaattaagtactccttctgtcccaaaataagtgcagttttagcactattcatatccaacgacagcactgttcatatccaacgtttgaccgttcgtcttatttgaaaaaagattatgattattatttttattgttattagatgataaaacatgataatactttatgtgtgactaatttttttaatattttttataaattttttaaataaaacggatggtcaaaacgctgagcatgcatatctatgtctacacttattttgggacggagttagtaagataggagtagtagtagtagtagtacggtctatgcatggtgatggtcatggtagcatg

SEQ ID NO: 19273 - DNA, 1501 bp, Oryza sativa
ccccttggccgccaccgctgcaagctccaaggccgtcgacaccgacgcggatggcggcgcttagcagtcgacgtggatggcggcgcttggcagccgacgccgccatggcccgcgcctggccaccgccgccgcctgcgccttggccgccaacgccatcgctctccttgtgatgggagaggatattcccaataggcaatatgacactgaaagagatgggttgttaattttgaccatgattcagttattagatttaacacgagtgctcacacttacagttaattagacacctgaggagacttcatcaatctcaagttatgccggtaaagagtttcaaatgtgttaatagaagtaggatgtgtgtatatacatacacaggggtatgtgcacgcactgtatccttttctaaaaaaaaaggaataagttcaccggaggtccctcaacttaacagcgagattttttgaaatcccctaaccataaaccagaaatgtgtgcccctaaatttacacaagccgtgcacacaaggacctatacagtatatatgggtggtttcactgacgtggcatcctagtcagaaaaaacattttaaaaaatacatgggacccatacactggtggagaaaccatctttcgtcggtcggccgatttccacagtagtcccggatgcaataaaaaccggggctaaagatgttctttagtcccggttcaaaagggtaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 19274 - DNA, 1501 bp, Oryza sativa
ctaattaggctcaaaagtttcatctcgcgattttatataaactgtgtaattagttttcttatctatatttaatgcttcatatatagtctaaagattcaagattcgttgtgatgtttttgggcaaaattttttagaactataccaggcctatgagaaaataattagccgtgaagtttagtacttaatactcttctatgagtaggtttcaactcaacgaacctaatcattgagtgtaactcgtaatttgtactgatacaagtagctttatgatctctcattcagcatcaatttgagcatcaatactcgtagtattgtatagatgactttgtgttgtcatccactcgatttttacgtaaaagcccttttttttaggaaataagtttactttagatcccttaatttgttgtcgagtttaacattcgtcatcaaccgaaataccaggtatagcccatccttcaactcacaataccgtgttaattttagtcctttagcagtatgatgaccgattttggctaatggagtcaacggctcactcctctctctctcttatcgctctccctctctgccacatctctctagggcacgcggcaaggacatggtgccatgtggcatgcggcggccggcggaggtgatgatgaaggagatggtggcgcacggcggccgatgcacggagtcccaaacaaggagacgacggcatcccgaggatctctcaaggttgaggaaaagggaatggatgtagtggtagtcgagggcattcaagaagccatcgtgaggacgaggacgactccccggccgcaaggacaaggacgactttaccgatcatggtcgcaaggagaggacgactccaccagccaccgtgcactacaatctcctccgccatcgcgtatgtcgcctcctccgcaggctagcaccgcgtgccaccatctcctctgtcatcgccttagctagctgcctccgctgccacctccgccagccgccgtgctattcctttcccgtcaaccaccgcgcgatgcaggctacgcgccaccatgacttcatcgcgtgccctagagagacggggaagagagagacaaggaaaggagagagaggagttagccattgactaatggggcccacatgggtctcacacgccacgtcagctaaaaccagccactatatgtcgagagactaaaattaacacaatattgtgagttgagggatggattataccttgtattttttgttgagcgatgaatttcagactcagcaataaattaagagatctatagtgaacttactcttttttttccggtacaagattttatcttgcttatatgttgccacttgttatccacaatgtcactaccccctccacgtcctgcattgatatacctctgcttctccacgcctcctggtctgtcaccattctcacgttctctttcaccaaagcttgcatctcccatgagggcacgagcatggctccatggcttctatacgttaatactaccttcgtttcaggtta

SEQ ID NO: 19275 - DNA, 529 bp, Oryza sativa
ttgagtaatattgtcatttcttttattccactttttgtctttttattgattgtattcatgctgcagcataaacttatctttatcttttagttacatgcccatgcatggttgtttgtcctgtcttgaagtgatgccaaattatggtagcatatgtatatacgtcatcttctgaattttttgccctggtattggggtacaccgacacgcacacacaaattcttcaaagtatatatgtatattattggtgaattatatgctatgaaattagctgctattagcagaaagaaattaatttatattcacacaaataaccaggattggtatttttaaattatttattattttattttattttgtacatgatcttggcgggtggcgaaacctaaaagatcagtaggtctgctctaatcaatggtacgtaaaaatcctactcggtactcgccatatgaataacttattcgtgttctacaaacaacttctcatgtctctagcatattcgttctagctgaaggcttatcgtctctttagg

SEQ ID NO: 19276 - DNA, 775 bp, Oryza sativa
ggggtgttacgcaggcgccgcgctgtgcgcgagccgttgcgtagcgcgcgagtcgcgacaccgcacgacgccacgcgatggtttgggcggtggtgtgtgcaggtgggggttgggcggggcacgggaggcgtcggacgcgcgcgatggtggattgattcattgattgggtccggcctttcgccgggtggttggacggtttgctctacttgtggatttcgtgttcacgtgtcgtgcaggcttgcggggtgtgtcgcgcgcgcggtagccgtttcgaataggaacggaaaacctccttcaacactacctggatttagactgtttctcgtgaaatcgtcacagaaattcgttactatattcttgcgtctcgaatcgaatggggactcaaagagtcggcatgcattggacacgcctgtgctgactgttgtagaaaccaaccgtaagatattttgagtttagatgacgccatagcggtcatgacccacattttaaatgcaacaattaatcatgcgaacccaaccacagcgctcgccgttttctgtcgtcaaatcgtggactgtgcgattgattaggccatatttggtcactggtacaactagttgtcaatatcttgccacgaaaaagacgagcagttgacagaaaacataaacataatctcgagttctttgcctccgaaaacaagagtttcacccggcagctgctgcagcacagctcagtccagctgctaatttaacgtacaactgtgctatggcaagcaggacacgctggatggaagcaa

SEQ ID NO: 19277 - DNA, 639 bp, Oryza sativa
atatacgcacgaaacacttagcagacatgactattttagtcttagcatgtaatattatttgagttttaatataagattactttatttgagattagacttagtatataattattgactacggaagtggtgcgacaagtagcaattgactattgcagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtatttagacttagcacgtaagtttgtgtagggttctaatgtacgacatttacacttagcatacatgacttagattgttaaaacataaatgtctcgtggcttagcagatgtttcttgtatcaacaga

SEQ ID NO: 19278 - DNA, 1501 bp, Oryza sativa
agatctacttggacttagctaggcacacaatgataccaaaattatcccactgagtcttgaacctaggactaggagggggctacacaaacaaggagatccccaaaaaaatatctcattgagattctcgacaagttagtctcgactaggtctaattatttccatattcttgtacacatatatctttcatatacaaatacaaccagtaggacataggttcattatcccttaggggacaggacctatataaattttcttcatggcatattgatatactcgggagaaaggatataatgctccaagccataatttaaaccttgccttctcaataggcatacatatatagttgagtaaagtccatcaccggtccctaaacttgtaccgatgtgtcatcccggtccctaaactcgcagatcactcgtttaggtcctccaagttgttcagttgtgtcaccccggtccctaaacaggatagtctaaaaactttatatcaaaaaataattcataactttttcatgtgaactctaatgaagacaaactttatatcaaaattgtagctctcgacgcgacctacaactttgtagttgaaaagtttttgaattaaaactgtttagggtcccaaaatattgttgcatgtttatagattttgaaattttaattttaaaattacattttgggacaaaaaatgacttaaaataaaaaaaattcaactacaaagttgtagatcgcgttgagggctacaagtttgttataaagtttatcttcattagagttcacatgaaaaagttatgaattatttttaaatataaagtctttagaccgtcctatttgacccagatgatattcaaatccaaatttagggactgaggtggcacaactgaacaagttggaggacctaaacgagtgatctataagtttagggatcggaatgacacagtcgaacaagtttaaggatatgaacggtcgatttgcgagtttagggaccaggatgacacagcggtacaagtttagagaccggtgatggactttactctatatagttctaccttaagttggcaatttttgatgatcaaatggttaaaaatatgagggcaaccggctgacaggtaggtctaggtcgtagagcaagccataaactcggtagcatacgaaacggagctaacaaaactagatgtgttctaaagtgctgatggacgatagctgaaattgagtttacatatcaattattcaagggtaagacgaacaaattaaatattatgaagttaataaattgatttaatttaaaagtatcttaataataagaagcgatgataaagaaagtttttttaaaaaaatattatttgtgcgggatcatatctgtcaacaccgaagttgatgggcaaacattaatccatgaatcctttgtaacgcggaatctagctagcttttcctagctagtttcttttaccccatgcaacgtgtatatattctttttcaaaatataatacaaacgtgggagctaacaa

SEQ ID NO: 19279 - DNA, 1501 bp, Oryza sativa
attaacccccattggatttctccaccctcaagttaactaacacctccaagatcttgaggggtggagtatgcaatggattgttttattgaagtaatccaaacaaacaattgataataattatttcttggcctttatattagtgaagattgcgccttatattttgaaaatagagagagtaataatagctaaactaaatgagtaataccccgcaatttaatcaatggctaggggataataacctatgattatggtctacggaaggtacgagcattaatgcaattagttgtaacgtacacctggattagcatggacaaacttaatggagaatcttggcgatttgatgaatactcttgatatggagttcagccttcttcgtgcttcatcttgtttaacgcgaacgaccttccttccaaaacagagtcagagtctgagttcttattccaccgagatagtactactagtattattttagtgttcgaaatggaagaaaataattagtattgagcattgccctacattacgtttttacagggattccactattgtgtagaaaccaaaatcgtgtactttacatataagtaatatcttaattagatagtaaatcctttttctttgcgaggcatattagtacacttcctttcttggcgaggcatattactaattcctttacatacttttcttattaggaaaatctgtttcacaatgtcttccattagaaaacgacaaatatattgctattgcagttttcccacattttgcctttgctgctttaaagggctgatatagtttgacatgtagtgatatcaacaccttggaattagaaaaataactactctgtggctccctaattactctttactttttttttctaaataggcttagaaaaaaaagtactacaaagggatgaatgtgtatttactattcaaccttagcctccttgaaaacaaaaaaaaatgcatagaaaatagtttaattttccacatggaaattttggtaggctttaatccatcaaatcaaccacactaattactccatcatttaatacggcctcatggctatggaccgatggacatggaccatgctggtacagtatacgtgcacagtagcgcacgtgcttcacacctgccggtgcatagaccgcgtccacgcagactctataccctctccttcctcactgtcctttcctttccaaaataccatttcttccaattcgcagctgttgcgatgaattaaaaaaaaatggccaaaaccttgtaaaaagcaaaacccactcgccactaatcgacgccattggcgagagctcgagcgcgcaacaccaccacgcggtagcctcccccaacctccacctcctcctcctccgcccgccccagagccaccggatggcctcgcttctgtaggagtagaggcgtagagcccagcgcgagggaaggcggcgattgatttgatttgaccaagattggtcggccgtgccgtctggtctgaggagcccggctctggggga

SEQ ID NO: 19280 - DNA, 371 bp, Oryza sativa
gtatagattttttataatgtatggcaaagggtataaattttgtagaatgcatggcagagtataagattttggtacaattttggaggcaaatctaacaaaatagattttcataattggatcgaaatatttaaagtaaaaattattgtcaaagtttaaacatattgactgcacgtatttcaaaacagaactaaactgtgaccggaggcaacctagatcatctgggatgtaaatggacaaaacactttgtttttacgacttaattatgttgagatctccatccaagcatgttgtccccatgcttgacaatccaggtaaaaattcagaatttcatagaacaaaatttttgcataacccatgaaagcagcatgcta

SEQ ID NO: 19281 - DNA, 1501 bp, Oryza sativa
acgctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagtatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctg

SEQ ID NO: 19282 - DNA, 961 bp, Oryza sativa
tgtggttaaaagatatcacttcaatttttgaaaacgtatagtgcatttatatgggtaatctgatcgacataaagcacagatgaggctgcatgcatgcatgcacgaatcttgaagtgaatattcagaggaatacattcttcatggtttcttttcaggaaagataactgttagaaatctgtgcaagtgtgattatattactggataaactaattcttgtctatgatcatgtgtagcaactattgaattttttctgtgagttttttctgaatttctcaaaacattgctcctatactgatataaaaaatgaagtagcaagtcagcaaccagtaagttcttcattagatgatttttcacatctgtttttcctggctttgtagattggtgggctcgctgctatgctggtagcatactatctcttaggaaatggatgggctacaagaacacattcaccactatgtatcctattttgcagatctgattctgaaataacacgctgcaaaattctatcttttttgtcaattaagacttccatccaaatttcttatgaactcaagtaaatgatgttgaaaatccctcactttgtatagatagctttggaagtgaatcactggagaagggaacacaagttattggaatgaaagaaatggtggtcccacttactgctggaattttatctgctttgaggagagtattagctcggcgggtgtcccttaaggtactcttgatttcattaactttatcaataatgataaagtgttaattattttccttaagaaatactatagttacaggcagtatccatagtaaccaggatagtcattctacagaaggtaattagcatgcaacgagacagatcattttctgcagagtataaaacattgtggaacatgaacatcgatgaaatttctatcgattcaatatgcaaccacatctgatatgcactttttgcaatgtttaaagt

SEQ ID NO: 19283 - DNA, 565 bp, Oryza sativa
ttaatttgaaaaacaagtccaatttactccctcgaactatttcacttaaccccctaaactatttttctgctcattttaacccctaaactgttagaaatgattcactttactggctaattacatttctcttctttgtttctctttatatgagtagtattttaagcttatattttgaagagccatagatgacaccattatcaaagttctaaaatagtttcaatattttttcatgactattttcttaaaattttaaacctatatgtttaaattagtctcaatgcttgcaacctatgtaaacagcgattaaaaatgccaataaattgttgagacttagttataatgcatatatcaatcccaccaaatttcattgcaaaatttgacctatatagagataaacaaaaaagataaatatcgtgagggagtaagacaacattttcaatagttcggtgagtaaaatgagccgagaaattgtttaggggattaagtgctccagcgaaaaagtttaggggggtaaaatagactttttcccttaatttcacatataaattctatattgtaacttagg

SEQ ID NO: 19284 - DNA, 1501 bp, Oryza sativa
atgttcagcttcattttaaacatcaaaataaggtatctaatcctccttttctatttgatgagatttgggtggggagttcctacctttcaaatttataccaaggttgacagttatgtaaagactccttggcacattgatgtgattgagcattattcgttcataatttccaaatagttggtatactttgcctaaacactaacattcatttccatatgagagtatgacttgattatgtttgagtgctatccaacaactttcagttgaccttgacatgttcttctacttgactacttatactgctatgttttccaactacaatggttcctgcatcctgaccttcacttttcttgtgtttgtgagagccaaacttgtaagcagccagtgctccttcaacggggaggttgcattatcatcttttatgtgtatattaagtgtgtattccttattttaaactttgctacgtgtttcccataaacataaaatatattcttttgtaacaatgaggatttgacactctttaaaatagcatcattaagataagaacaattgtttttcttcttaaagtttgtagctactggaccattgactgcatcacaattgattggtcaccgtttctgataacgaaatggtttggcacctagctcacaagtcacaacttgctccacttgctagaaattgtgatgctttcagctttgtcctagtttttgacgactgctgcttttgcaggaatctacggatcattcagttttgaccagaacccatattgcaatgggtgttctacacacccctctctgagattctcacgggaggtgattgattccaaatcctctgtagtagcagataagtcaccaaactttagggtggagaatgctccttttgcttatcaggaaccatggcgctgcttgaagatcggtcagccattcctatatccttaggtgcatacctcaagctgcagtgagggaacatatgacattgtagtcttgtccggatagagatcaatataccttagcttgcaactgttctcaatgagtagtcaacggatggcgggagagggaagggggaggtgacgtacgagcacacgagggaggcggtgagatcgctggatcaggagaaaggattggtgcgaaagcacaattttaccctcccaccaacagaacacaatcggtacctcctttcgcggggacgcggtaccaccaggtatcgagcaattccagccgttagattgcgccagatcgagtgccaggatatggtacagcctcccctcaaggattgtaaaaagtctcctagtattatttatcagatgtttagtatatgggttatcactctgttaattgcagtttgaccttgacaagttccaagtctcctactgatattttctttttttctaacattttcacagttctactatttaacagacccctttgcatttgaagccatccgttattactgattgagcattacaccttagtattgccataccttgcctttacctatacctcaa

SEQ ID NO: 19285 - DNA, 233 bp, Oryza sativa
ggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaagg

SEQ ID NO: 19286 - DNA, 916 bp, Oryza sativa
gaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 19287 - DNA, 1501 bp, Oryza sativa
agatagccgatatataatattttgacagtggtacatgctgtcatgcagaagtgctgacaaaattcagatccattttgaggtccactcccttcgtcccacaaaaaatcaacctagtactagatgtgacatatcctactattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtctttgtagcgtcccagcataagttcagttacttgtgtcattagattaagaggtaaacatatttaattgagaagaaaataatttgcactctttagaccagcctccacaaacgaacaggatccgccgcactctctagaccacggcactactcagcgttctttctcatttttaaagaccctgtcagcttcattcattttttttatgaagatatccttagcattattagagctttatccatgctgtgtggtacacagaaaatctctgaaaattatatggttctctactaaaacgaccatattctatctttggaatttcgatcgaatttaaggagccgagcacacgcgtgtaaatataaagcttttactagtatttttctgctttgagaagaagagcaatttagttgcacgtccaactcttcctgtaggcaggcataatgtagccgttgaaattaaatccctgacgaggatagttactgattaattattggtgacagcggtagttaactactcaaaccgtggtagtggagacagcagtgtactctatttaccagcaatttaacactatgtaatattgttcttcctttcattgagcagtttgaaacagatcatttgatcagattatttatactaaattatctacacgattatatacataaattaactattataataaataaacttaacaaatagcttaaatcaataaatctaagcaatcgatagaattttttatagaaaatatataattttaaagacttaaaacaaacaatcagcaataataatgttttattttgagatggtagatgacgacagaatcacgaaaaagacgtatcaatgaatttaagcaatcaatatttttttagaaaatatataatttgaaacaaataatgggggacaataatgttttatgttgagatagcaggtgatgacagaatcacgaaaaagagaggctaccgtggcttatctctgtgggccccattggtcagtaggatattagggagacatgggcccacgcgtcatcctcacgggagcttcttgtcttctctttacaagagaatagagaaagaagacgaccacgccaccaccgctcgtctccaccgcgagcgaaacccaaaaaggcaatggcgaccgacggcg

SEQ ID NO: 19288 - DNA, 1501 bp, Oryza sativa
gacagcgcgtacgaggtgatcagcctcaagggctacacctcctgggccatcggctactccgtcgccagcctcgccgcctccctcctccgcgaccagcaccgcatccaccccgtctccgtcctcgcctccggcttcccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatgg

SEQ ID NO: 19289 - DNA, 296 bp, Oryza sativa
cgcagcccccgtcgtccgccgacagccccctctcctcatcggagtaagagtccggtcgggttcggacgccgttctccccactccatttgagagcgtgcaactcggggagtcgtgaggaatggcgcgggcggaaagtagcggggaggctgggtggcaagcggcggcttcaccagcatggtggcgagactatgatggagggtagaaggccggctaccccgtgcgcgtggtgagagttccaatccccgaaaccccggcggcgcgggatcgggggagcagctccgacgaggtgaaggtga

SEQ ID NO: 19290 - DNA, 665 bp, Oryza sativa
gtccccgtagtacttgttctcaatttttcttatgcatcagtggatgtgtttttttcagctgagtgcaatttggtgcgacagctgtatgtttttatttgtttaatgaaattgtaagatagcttgcacacatgcgcgtccatcttttttattacgaatatttatacttattctattgtaaacatgttttttttaaaaaaatttatttgggattaccattgtggcgtataacaatgtataacttgtaaactaaaattacttaaaaacaccgagttttgaatttataagaaaatatcgtgtcacgatgaagttgctacctatgaaactatataacatttgtacataagtgtgtttttgtaagtatcttacttttggaatttctaaattctactaagtaacatttttttcatactatatatgtctttgtgaattttacaatattttatttgaagatattatctattaaaaatatagataatatgaccgcatcatctaattaaatgaggtggatatgttgaagtattgatttaattatcaggatatagttttgcaataggaaactacagttgtcctatctcttagcgattgtcttcctgttggctatctcttaacgtggcttgtggctatggctctctatggctcgtgattgtatgccctcttcttctagg

SEQ ID NO: 19291 - DNA, 1501 bp, Oryza sativa
ctctctctctctctctgaaggtcacatcctcctatcgttgtcaccactacgtgcattctcactccgctccatcgcctgtcatcctcgctggtggcgcccaacttggaattgtcgaagatttctcatacacctacgccgaagccctttcctctttcttgcacaaaacaaaaatattgcaatggtttgatcaatgaaaagcgggtgataaatgttggtgacttggtgtttgacttatgcccagttacccaccttgatcttgtgtctaccttcaaacatgaagcctcactatgattgttcaccattctagctatattgaaatatcaatctattctgtaagttgcctttaccaattattactctttgtcgatagtaatgttcagtgccattgagcttcttcttgcttttaaatgtggtgctgctatcatgaatattgataaagtctgccatctcttcatggtatgtttgtgcaggtctcccaaattacacatagttcattgtgcttgggacagaataatacaaaggttgatataaatgtgcagaaaaaaaactaaaagaaattttggattgcttaatattttgatgtgagttgatcactggtgcatattggagtgactgagcaatgattctcaatggtaatgtttttctcctaacttctacttccttcggtttatgatattcctttcttacgaatgatatacctccgtatttaaacaatgttttatatattttgcaataaatattgtagagtaaaatacatgcaggctcatccaacttgtttagatgtgtcatatagatcactctactttcaaaatacacgtatggatcactaatgtgagttaagtgagtaattatttagccatctaactatccacatgtcacatagtgtcaaagaaatgggaaccgggttcctttcccctcgggtcatcagggcgctgtggtacacatcacgacgtataagatctacatcttcaagatactgagacaagtacaagcaatcaagggcctcccttgtaagttgtgacatcatgaactctttcatctttgataatttcgagaagctcgtccaaattcgatgaacaatatatatctagcaatgggaacggcttgggtgcccgatgctgccccgagtacgtagggtgccctaagcgtgatgaatccaaaggcgaagcccaatcgtctttgggactcgggcagcggcccaagcactcttcatgcctcgagagggggcccgagtgtgcccattgcgagcgcgatggatccggaggcgaagcccaaccatctccgatgtaagttgtttccctttgaggaacgtagccacatcgagggaaagctgacaaggcgagggagttgctccaaccactcccccacattaatgttagtatgcgcacgtcttctacacatctcgtcgataacatggggagcgtgagggtgcctatgcagcgtgccacccacgtgggggtagctgcgcctttttgactatcagcgctctccctccattagc

SEQ ID NO: 19292 - DNA, 1501 bp, Oryza sativa
tgcccaatagaaaacattatagtttggttaacaaaaacgtgctattatactgaatgatatcacatatcttaagggtgctaagccaaatgaacatctgatatgagaaaaataattagggaaattgggtgttttcagatctgaaatgggtagaaaaaacaattgaattgagaagctagcaatcttgaaatatttgaccactctcattcatcaatgaaatttgaggaatttcatcatatgtcaatcacacacaattggcccaatttcaatatataacatcaggtaactcattatgtaccctttataccatttccattataaaacagttttgtgtgcttcattgaacaaggtaaaatgacacaactcagctacctcaaaactgacatttatctcaatggcatgtgttttcttatgaaactaaaattgaatgcagcaaaagtgccttcattcttttaatggcctccaaaaattatttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaggaagcggttag

SEQ ID NO: 19293 - DNA, 1501 bp, Oryza sativa
gcccaatagaaaacattatagtttggttaacaaaaacgtgctattatactgaatgatatcacatatcttaagggtgctaagccaaatgaacatctgatatgagaaaaataattagggaaattgggtgttttcagatctgaaatgggtagaaaaaacaattgaattgagaagctagcaatcttgaaatatttgaccactctcattcatcaatgaaatttgaggaatttcatcatatgtcaatcacacacaattggcccaatttcaatatataacatcaggtaactcattatgtaccctttataccatttccattataaaacagttttgtgtgcttcattgaacaaggtaaaatgacacaactcagctacctcaaaactgacatttatctcaatggcatgtgttttcttatgaaactaaaattgaatgcagcaaaagtgccttcattcttttaatggcctccaaaaattatttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaggaagcggttaga

SEQ ID NO: 19294 - DNA, 280 bp, Oryza sativa
ccacccattttacccctttattttagtttttaattttattttagcagcaatttcatattagtccctgtgttttatttaatttagtacaagcagttcatcagttgtacaaattacaatgtaagaccactggtgttatatgttacttaacataggtgtttattcaaataccctgcttcactaaatttcatgttgtcttaattaaatgccttttgcatattattttgagacatgctctacttcctcgcttcattaatttacaaaattctttaaattttgtact

SEQ ID NO: 19295 - DNA, 1501 bp, Oryza sativa
aatccggacgaatccgagggagagagagagggaaaaacggggggaaagagagagggaatcgtggggaatatttcccccctctttattgcgcgcggggacggcgggaggcggcgagattcgcggcggcggcggcgctagggcacgggcgagcggcgggagcggcgggaggaaggggatgacaggtgggccccacccgtcagcgagggtggcgggcgggcccgcctgtcagcggcgcgcgcgcggggagggagccgatgggccgcggggagaggagagagagagggagggagagttgggccgagccggcccaagagaggaaggggggaaaagaagacttttagggattttctttttataaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgcgacaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggtccacggccttgattaataatattgtatagctctagaatcgtgtttacaaaatagcttcaagcaactaagtgtcttttaatgctattttctgcaaaccctaaccctttatattataacccccttgtacttccctgcatttattctgcacttgtgggtgtgttttgtgagtacggtgggtgtactcagtcttgctcaatttttcccaaacccagaagaggagtccctagaagatgaaggctttggtgtctagctcgtgcctgccgtcaagcgcctgtggtcgtcgccctagtcttcagctgtttcccgtttgtctttgtgtgtgctgggccttcgccgcccatgtaataaattaactatttacgcttccgcttgttgaactctgaactgtatcaactcttggtgtaccttgcctcctgggacaaggaataatgcacgcacgtaaggaacgcccgttgggttatttccggtcgtgacatccatgctatagaaaaacatcgggtcttctgcttgcaattcttggaagtacttgatggtttcagccatgtcaccattgcatgtagtccggttcctcattgatgtccttatgttactaacatctttcttcgtgaacggtatgttgcgaatgtttccatacaggtcagacaaaacagacatgatcctgcgagtggg

SEQ ID NO: 19296 - DNA, 369 bp, Oryza sativa
taggtggagtcctgcttataccccagttgagcgcctgtgaagatggagccgtaggccgctagtccgctgctgtttattttttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaaattatttgcgaaagttcctttttctccttcccctaatgctatttgcaaaagg

SEQ ID NO: 19297 - DNA, 1501 bp, Oryza sativa
gttttttttcaaatgcaccttcactctacccctattatgttaagataacttaacggtgtcaattcagccataaaaggacaattatacccttgggcattttcctaactttttgtataatttgcatgcatttcaaatgtgactaaacactgacaaaatttgacaacattttaacacaaattgtacggttgcaaaacttcactacaaagattcatcacaaattccaaccaaatagcaaatactgtgagatggcaaaaaagaaaaagaagatcaaacggcaacgacatcgctcgtctttgtggacgagccgcccgcagtgtgtcgttgttgccggcttgcggcgccaagctgctcgctgctcgccaccattgaggggaacggccgtccctgctgcgggtaaccgagacaccctgccctttcccttttcgcatcgtcagattcgctgcctgcccatgcgctgcgtcggagctaccgcggcctccccatagcatctgctatggccttcccacacgctggtcccggatgtgacgtaataggaattactatacaagcaccatcaccgatttttgttgagttgtgatctaaattttttttagaattacacagtacaacacagacacttacaacgcacgcgcactcacccatataaacacatgcacgcaaaccctacccctatgagcatcttcgaagactgggccagtaaattctgaaaagattgacgaagtcaccacaggtgcctcgctgtcgacgggtacgtcgcctaccactgaaatttgtgatccaaatttatttacatttaataaaggccagcttttgccggagtgaagcggatgcccaggggtgcggggacggagcccccgcggtacggatcgtcatcccttttagggttccaccatatatatacacctcttgtaagccgctgtacggtgttgtaatctcaccccgatatattgaagatattttacatgtgtagattggagataattatacggatgaaacacatcagatgatggtcaacgacgtaaatgactagaacaaacaacatatcaaaatagggaaaagataaagtactctcaaaacatacatgtatactctgaaaacatagcaatccacatgacatactacctccattttttaaatgtataacactgttgatattttaatcaacacttgactattcatcttattcaattttctttttgtaaatataaaaatatttaaatcatacttaaagaacatttaatgataaaccaagtcacattaaaataagggtatgtttagttctcaaacaaaatttttcacactgttacatcgaatgtttggacacctgaatagagtattaaatgtagaaaaaaaaccaattgcataattcgccaggaaattgcgagaccaatcttttaagcctgattatgacatgatttgacaatgtggtgctacagcaaacatttgctaatgacggattaattagacataataaattcgtctagcaggttcctgggggaat

SEQ ID NO: 19298 - DNA, 1265 bp, Oryza sativa
catatgattggatcctaaaatctttgtagtcgaaaaaccacaacactcccctttttgcaaaccaacccttaactcatttaaacaactagaggaactagatagagaattacttgtatgcacgcggtcctctcgacaatacattttatcatgaaaatgaggtatagtcaaattcgaacaaatatatactcgatgcacattatattctcctttactatcataattaccaataatatgaaaaatcacatcagaagggcatggcaattcaactctatcaaataatttcttctctaagcagttgagtggacaaagatcatcaaattgaatataaccccaagtatttaaagaagattgcaatttaggctcttcattctcgctagcaatgtgaataacatgtttaaactcaacacatagtggctctactatagaactaacatgttcattcactagttgttgcatggatataagtgaagcatcgcacaactcttctttatcacaagaaacatcaagcaaattgttttgtgacaaaggtatttcaacaatcggttccactatgggttgctctaacgtagcataagttgtggacatagttggcacatcataaatatgcataccttgagtagctgtagcaccattatcattactttttttctcatcttcagaaattataggtgcttggtcaattgaacattcttcccgcatgcatgtagctatagatagatctttttcctctccatctttcttctcttcctccttactaacttggttgttctcagatgcctacaaaatattagtatccaaaacaataggcacaacattacgttcattttgtaacaactcagacttagttgaaggcatcacaatattagtattattcctggtatctctgaaaatctcatcgattctattcttcgtcctttcaatactatctttgaaaatttctttgattccattcttcatcctttcaagattatcttcgaaaatttcagaaaaactcattggttccaatttcatttttcaaccgttatgtctaaatgtgtatgtattagcaacaaaattatgcaaaccattattatcatatacccatggttgaccaaacaacaaagaatatgcttgcatagggacaagatcaaaactggcagtatcatggtaattttcaatcgaaaagtttattctcacaattctatttaccttgaacttaccacaagagttgaaccatttgatgtaatatggatgatgatgcggttgtgtaggcaactcaagtttct

SEQ ID NO: 19299 - DNA, 292 bp, Oryza sativa
ccaccccgaaattttttatttttgttttatttgtttgctatttttttcacacttagggatacacaagagccagccatagaaaaattgaactcaaatggacctaatatgtgacctatagaatttttcctctcctctcctctctccgaactagtgcagaggagagagatgtgcaattttttaattttattttatttttttgatattttttcacacttaggaactcacaggaatcaaccatataaaaaataaactcaaacggacgaaatatgtggcatgtggaattttctaaagc

SEQ ID NO: 19300 - DNA, 1501 bp, Oryza sativa
cactgttttatttagccatgcctatttacctttgttatgaccttattattattgttattgttattattaccttgttcaccctagattaaacaaaaccccaactagtggacactctacgcatggtagatgcttcgctggttaattaggcaacattaggtggttttacaactctagaccttgggaatactcttatcacctggacactagggaattgttggattattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcaggggtcgatggacatctctaggacaaatgaaggctacacaagctgcggcccagtagtcgagatgtcatggcacagggccggtgtcctgctgctagggcctcagtcctgcctacctgtcccggaggttccggccgtaggtggggttgggtcggtactcttgtctatggctaggatgggttggaaactatgtcacgtcttccgtccatataccgtggtggtatgcgacacgtggttacacgtgaggaagattgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcacttgacggcaggcacgagctagacaccgaagccttcatcttcaaggagctcctcttctgggcttgggaaaaattgagcaagactgagtacaaccaccgtactcaacaagacacacccacaaatgcaaaataaatgcaagggagtacaagggaattataatataaagggttagggttgcagtaaatagcatttaaagatatttagttgctcagggctattttgtaaacacggttctagaactatacaagattatttatcaaggccgtgaacccacacgaacctgccttaacccaaggcctacgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggcgcggctattcgaatagattctactctgatcagaggtgtacatctttacccacaagacacatcttcctcacgtgtaaccacgtgccacataccaccacggtatacagacgaaagacgtgacatagtttccaacccatcctagc

SEQ ID NO: 19301 - DNA, 370 bp, Oryza sativa
gtcgtgtgggggcggatggaatctgcgtcgccgtgtgggggttggtagatctgttcatcccccgcgtgtgtcgccgtttgccctgtgtgcgtgtatttttctcgttttgcaaattgcaagtgctgtgctgtgttccatcgcagcatgacacgagttccctcccgttgcttttggtggtgacatgtgggaaagggagattgctttgaggattttctgttcgtttgtctactttttttttctcttccctgctctgtatttttgtgatgggattttgttcgttttcttcttcctggtggtagaagtacggtctaatgctcgtcgtttgatgccgcgtgacaggtagcagagggagagtcgtgaggtgcagcca

SEQ ID NO: 19302 - DNA, 288 bp, Oryza sativa
attcctgcagccctcatgcgccgtaagcgggcgaatgggattagtggaagcgggggcacgggaaacgagggagcgagatggcgagatacgagggacgaggtagtgggcgcgagaaacgaggagccaggcccagcgatggcaagggtataaaagcatcgagaaaaggatttgcttccttcctttcgccattgttcctcttgccttcgccgcctgagctctactctttctctgctacgccctactttcgccacacgcgctcgttctcaatcatctcttcctccaccgcca

SEQ ID NO: 19303 - DNA, 542 bp, Oryza sativa
agtttattagagtaaaagcctttttcttttccgttggtcgtgtagacgctgcagcttcggaagatccgctcttcgcggaggttgaagccgacgtttgggaaagcgagcaaggcaagtcatatcatccttgaacatattgaatcccagtttataaaattattttgatttaaattattgcattaccgctttatttaaattcccgcgttatcactgttttatttagccatgcctatttacctttgttatgaccttattattattgttattgttattattaccttgttcaccctagattaaacaaaaccccaactagtggacactctacgcatggtagatgcttcgctggttaattaggcaacattaggtggttttacaactctagaccttgggaatactcttatcacctggacactagggaattgttggattattgtggaattggattcacacctccccctctattcaaaatccccaaaatggttttaggctgggctcggggtgcatggttttgatagtagcacctcggccatataaggaccggt

SEQ ID NO: 19304 - DNA, 1050 bp, Oryza sativa
tgcatacttgcatgaagcgcagcctgtactcgcatccattatttaaatgccgttcagtttttatgtatccaatgaaactttggacttcacaaagatatcgtgccaaataatttatctctacttattttgtccttttttgtgggggggctagaggtagtagcaacgaatggtttgatgtttccctcttcgcggtaggtgggatacctcttgaccccacaattgaacttcttcaatgttttctcaaagaaccaacgaactgatcgaccatacatggcgcgttagttgtcgaccacctaacatatgattgaggccgccaaggtagccccaagtggttgcaatgctgaaatcaaacctaccttttgtcaaacatttgtactagctagtctaatttggtggcaagcatcagctatatatgatgcggtatcccattttctcaaatagcccaaatacccacaaactaccttatttactcatatagtactccatataagattatgaaactttttagtttttttatattgtgcttctaacacacgtttaaaaaacacaaagactagtggtataaaatattgagcttttaaacagacatggcagctatacatggcctcgcggcaagacgtagaagatgtcaatatcttctctgattttaaatataaataatttaattataccattaagtaagaagaagaagtagcgaattttttagaatttatcggtattgtgcttttagtggtaggcaacgtacccatcgacagcaagatgctgtggtgacttcgtcaatctccaggatttattgtcccagtcttcgaagatgcttataggggtagggtttttgcgtgcgtgtgtttatagggatgagtgtgcgtgcgttgtgagtgtctgtgttgtaccatgtaattttaaaaaaaagtaaatgactttgcctaattacggcattttcaaatcaagaggatctaaaataacttgcatataaaaatgtacagaaggataagacgactccatgttctctcggccagtcctcacttgaccccattccggggtgtccccagc

SEQ ID NO: 19305 - DNA, 1123 bp, Oryza sativa
tcctccgctccggtcgtcgtttccgccgtcctcgtcgacccggggtgagccgtggaccgctcctttcgcttcccccttccctcttctctctcgggcgccgctccgccgcgctgttggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtagaccgagaggctgacgcgtgggccccactcccgtggacccggtccgcgcgccctctctctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattaccttgttcaccctagattaaacaaaacctcaactagtggacattctacttaagacaccactagtttaattttaggtagatgcttcgcaatttaattaggtaacattaggtggtttttcaactatagactttgggaattattcatatcacctggacactttggaatggtttggttattgtggaattggcttcacaccgccccctctattcaaaatccccaaaaaatggttttaggctgggcgcggggtgcatggttttgatggtagcacctcggccatataaggaccggt

SEQ ID NO: 19306 - DNA, 1501 bp, Oryza sativa
tagatgcttcgcaatttaattaggtaacattaggtggtttttcaactatagactttgggaattattcatatcacctggacactttggaatggtttggttattgtggaattggcttcacaccgccccctctattcaaaatccccaaaaaatggttttaggctgggcgcggggtgcatggttttgatggtagcacctcggccatataaggaccggtcttcgggcctctgttgcaaagcactaccgtacttccacatgtctaatgggtaaggcttagtttgtggctcaggctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagttctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtagaatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgataaataatcttgtatagttctagaaccgtgtttacaaaatagccctgagcaactaaatatctttaaatgctatttactgcaaccctaaccctttatattataattcccttgtactcccttgcatttattttgcatttgtgggtgtgtcttgttgagtacggtggttgtactcagtcttgctcaatttttcccaagcccagaagaggagctccttgaagatgaaggcttcggtgtctagctcgtgcctgccgtcaagtgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaatcttcctcacgtgtaaccacgtgtcgcataccaccacggtatatggacggaagacgtgacatagtttccaacccatcctagccatagacaagagtaccgacccaaccccacctacggccggaacctccgggacaggtaggcaggactgaggccctagcagcaggacaccggccctgtgccatgacatctcgactactggg

SEQ ID NO: 19307 - DNA, 161 bp, Oryza sativa
tttttccatacggaccacttaaggggccgcatgcaaaaatgaccatcgatttttgcagacgccactagttgtggtccgtttgtaaaaatcaagaggtctcgtatagaaaaatcactttttttaagtagtgtgggccgtcgtacggcacgcccggagcatca

SEQ ID NO: 19308 - DNA, 562 bp, Oryza sativa
atggggggaaagggggagggaatcacggggaataattccccccactttattgcgcgcggggacggcgggaggcggcgggattcgcggcggcggcggcgctagggcgcgggcgaggcggcgggagcggcgggatgaaggggatgacgggtgggccccacccgtcagcgagggtggcggacgggcccgcccgtcagcggcgcgcgcgcggggagaggccggatgggccgcggggagaggagagggaaggggaaggagatgggccgagccggcccaagagggagagggagggaaaggggactttttagagtttttcttttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcaccatttagaggatatattttagggtcgttttgggacgtgacaatggagttgcagt

SEQ ID NO: 19309 - DNA, 1501 bp, Oryza sativa
acgaatatatcacagtgtcttgcctgatatattatgagaatggaactcgttggctcaactagatgggagggtgccacaacgcacttcaaatctcccttgtttgatctcgcttggattgcaaaccatacctggtgtcgatctggcacgtcgtggtgttgggcagagaagaaaatcccatcacaactaccgccggcggttgcagtggcgaagacggtgcataggtccaatggtgtcgtagaagcagaagctcactgtcgaggccatccccgacacaccccatcgtcacaaccgcgtcgaagttgccccgtgcccatgcagccatggtagctagcccggcaacgacgagataccacccggacgccatggccccctggatggatggggtggcggcgctggtgaaggttgatgtttgtcgccctcaggtatcatgtggagcggattactagtttatttgtgatatagtataaaccgtataacaaagttttaaatggtgcaagatgttttaaagaaaaatgatgctgccccatgcgtccatcgaggttagttagtacaattaggcattctttaaaaaaagtacaattaggcgaatgatgtctgctattatgtgtgtacgctattactccctttgtccctaaatatttgacgccattgacttttttaaacatattagaccgttcgtcttattcaaaaaatttaagtaattattaattcttttcctatcatttgatttattgttaaatatacttttatatatacatatagttttacatatttcacaaaagtttttgaataagacgaatggtcaaacatatttaaaaaaagttaacggcgtgaaatatttagggacggagggagtattatatcagtgagcagcgaaggcatcatacaagacactgcttgagcgtttcatgtacacacaaaatgcattgttaattttatttgtctgtacgtactttgtttgtagctacaaagtatcttgcataatgttcggattaatgtggtctgaatttaattgtgaattttgaacaggggaaggaagtgccgtcccgtgtgttaaattactagatgaatccgaccacgaccatttcatagatttaatttgatttgagctatatagcactgctgcaacggtttgcacggatgtgtcccactgacgcaattaaacacacaccttgctgttagcagtagatcgattcgaccatgcatagctccaaaaccaattttgtgttgaataatataaggtcagatgaaattaatatagttagctggaaactgatcaatccaatatttcgtgtcatcccggccgtcggcggcgagtccgtgtgaaggccaccgccaccagctagcagcctctgctctgccgccgacgaccaccaacgttgtttatttcagtacgacggaattaaccaacattcatgcatgcatggtttatttaaaccgattttctggaggagattaccgcccggacgtccgatgtaactcaaaatatcgaactctaccc

SEQ ID NO: 19310 - DNA, 1501 bp, Oryza sativa
gccccctcgccgcccatttgcaggcggccccccgcacagtacaaaatcgccctcgcggaggccggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattattttttaaaacttttaataaaaaaaattaaaaataaaaaaaattcgtactatggatgtgttactactgggcctgatttaattcaggcccatcagacaaaaggccgggccagctacgatccctaagatttaggcccatattgatcgtcagcccactgtaggcctattggaggaagcgggaagaagcaataggccgcgtgggaagcccatattttgcgggctgcctttctgtataggccagagcgggtttgcggtaaacacttgattatactcctccattcacacatacacacacaaaaaaggaaaaaagagcaatgtactcctatccaacacccgggaggacgcatcaatttgactactgtttgactatccataattttggtcaggcatcttcatgcacaacaccaccactaattagtgctaaccttttcacgcgatgaaatggtctggaaccggaagcattgtcgtttgggtggagaactaaccacgttgaacacagagtcagtaactatcgtctatctgaatgactgaaggcatcaaaggcagccacactctgaatcaatcgatgtgagtagaaatacaggacaactcactgtcggatagtaacaacaggatagattgatgtgcattatccactttgccaaattaggcgtaggctaagcacaacctaagcttctgtataaatatccagcgtagtaatagtaaagtagcactgattatcatgcatttgccaatctagatattaccaaagtttgccagaatcatgcaactttatatactactcgtttcgaaatgtttggcaccgttgattttttagcacatgtttgagtgttcgtcttattcaaaaacttttgtaaaatatgtaaaattatatgtctacataaaaatatatttaacaatgaatcaaatgataggaaaataattaataattacttaattttttttaataagacgaacggtcaaacatatgctaaaaagttaacagcgtcaaacattttcgaaacggaggcagtactagagtactagtggcacttgcctttccgtcagaattaagcaagcagacatgcatactgaattcccgatttcagtcattcaagaggcacaccacacattgagtgaccacaaaccaacgatataaacaccatattgaatactcgagattgaatgatcacctaactgtttgtg

SEQ ID NO: 19311 - DNA, 1501 bp, Oryza sativa
gaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcactttatttaaccaacaccagcaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctgggggaacctcggcgactatcttgaagtacaccggagcgtcgaaggaaccggaatctagcgacatacaaagcaatcattgcaaacaggctataagactactgaaacagagaacaaaaccatttttaatggattctacacatttttcttgatttactgagacttgaatgggcttaaacggagctcggatgaattagttatgaattttagaagattcactgtgtt

SEQ ID NO: 19312 - DNA, 414 bp, Oryza sativa
tttcgggcgagatgtgagcatttcggtgggggcgaaatttcgaaccgaaatttcaaaccctgtttgtgcttcacgttctttacaatcaagttaataatattgtaataagtaacagctaaagtagaggatgggattttcattgcattatcaaaaaaatgtatatatatattcgacgaatatttccaccggtttcacctcacaacataagctatagctatctatcttcatcagcagcagaggcagaggtgagctgagcacaacacatctccccttgagtagttgagtactgcacttgagtgatataaagcttagctagtatactgactgcactaagcttaaacctcactcgactactaccacaaaagtgaaatattcttggctagtctagtctactcgagaacgccaccatcacca

SEQ ID NO: 19313 - DNA, 1501 bp, Oryza sativa
gggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctca

SEQ ID NO: 19314 - DNA, 1501 bp, Oryza sativa
gtaaaatacacctgctgcattttgtagagcagatgcttagcacagcatttatgttgatctcaccacaagattatctaaacatgtttgagaatgccttttgttcaggttaactgaaggggtggtgcgctctgtaaataacctgctcgagaagttccatcaatcgtttttcctgtatttccttacagccccaagcaagttcatttcagttggtgtatatatgattccgtttgcattactcctggcacccctcccaatagttgctgctgctcttgctggtggtagtaaaaccaaggggaaattggaggatgaatgtaaaacaaagggtaatgctgatgacctgcaaatggagggtggatcgtggaaatggcttaaatctgcaagagtactacttatcatccaattttgggcagtacttgtttctttactcccatactacattagccaaattcctggtgctatgccaatacagtatgcagtgatttgggccgttctctccatcactatattgatcatcctgtatgcaatgtttggctctccatcccgtgctggtgtggaatggaagcttctaaaagctacgatgatcacttccatcaccataggaatggggcttatgtcgatcataaattttgctactgctcagcttggggctctgatattgatcccaatgtgcttgttttctcgaccgctgagggcacagctcgagatgaatttcctacctcgcacagtattgttggcctcaaacatacttctcaccgtcttgggtttccctccagctgcatttcttatcatgaaaggtctatccaagggatcatggacagtagacattgttggtgatttctggctgtggatggagttcttgtgggaatggagcagcgcgacatatctgtatgtatttcttgtccatcttccctgctggctcttgtgcatccatgtgttgctgcatccatgctaccagcctgaatcaaagatgaagcaggagtagcgtttgtttggtcacgcattgctttgaggttagagaacactgcaagtctgtaatagatattcctgattttgggtgtgctttggttgccaacatcttgaaagcagcaacttagttttgtatgcaggactagcagcttagaaacatcgatgtatttttgatgtttcttttggaagaagcacggatgggatagtaaagcctgcttatgtatactatagtggtggtgtttgttgtgtcacactactcaaaccactgacatttagtacccataatctataccctttaacgtgtcctttcctgtttcactattgactcttctttgaacgaaactattgactccttctcaaattagcttcgggatcagatcattcaactaaagctgtcaggccgggtaggcttatcggaacattgggggttccttatgttgtgactgagcagatatgtctattgtgcccggcaaaaacggatttgcaaggccaaaggctttctcattcggaaaaaaagatcacccctttcaatcta

SEQ ID NO: 19315 - DNA, 1501 bp, Oryza sativa
gccacgagagagtgtgtcattagttggtattagagcatcagttgcctggtgaggattttagtttgcaattttatttcatctacccatcgtctaccatatagccacactatttttttccatcaccaaacattagttttgagccacgcaatttcattcagtttttgctttactgagttttgatgcactgtcgagtcaagtgctggtttaagcctagattagtcttggtttgagtttgcaagtgtgcgtcgccaccgtagagaaagtttcgcagaagattgatgggtagcagattggtttgcgagctgaggttccgttcgcatctgagattattttgttctcggttgcatgtgccagataattagggaaaatttgtttttccttgttattccctccgagattttatcgtgcaaccaagtgaaaaaaaaacaacccagatatatttaccatactttaaaccgagctatcctacttcctccgttccataatataagggattttgagtttttgcttatactgtttaaccattcgtcttattaaaaaaatttagaattattatttattttctttgtgacttactttattatccaaagtattttaatcacaactttttttttatatttgtacaaattttttgaataagacgagtggtcaaacattgcatagaatattaggtgacggatggagtattttattgcgcatgtgtttccttgatggatcagttgcttgtttgattctctccttgatttgatgggcatgcatgggagaagttaattctgtaccgaatattgagcccatctttcctgtatgtgcatgcagactagcaagttttgctatttcgttctttttttagtgtgagtttgctaggtggtctgtattttttttgttttgcccagctattttgtgtaatagctgccgtttgttaaaaaaaacaaagaaaaaaatatagaaaaggcagaacggtgcaaaaaaaaagaaaaaaaaagccgcacaaaaaaaatcataaaaagaatttagaattattttttttagttgttggatttcttgggagagctttgtgataaaatctagttgtttctagtctgagtggtgatcatttgtttgcttaagttgggattaagtctaggctaggccagcaattttgactagtactttggactattatttaatttcgcaaatctgtttagttaagcctaccaagatccagatactactaatctttacaagtccgactttgcaatcgctccactcatcaaacgtgtcattgtgccacaaatcagccatggtaattgatatgtttttgcattatttgagaacattatgagaacttggtatatgctacagtgctgagcgaattgcaaccccacaaacaaaatattgttgttaataagaagttacatgcatctgtttgtttttcttatttgctaccgacaatgacagaagtgtacaaagagaatgggattgaacaaataaaacattggctttcacaacgagaagaggtaca

SEQ ID NO: 19316 - DNA, 1501 bp, Oryza sativa
tttgaccataatggcactggtgacgaattggagaggagggagttgtggccatgctgctgcttcttcactgatggatcacatcgatcggcatatgtttttcatgtgaagtagtagcagcagacaacaaccagaggttttttgtatttgcatattttccccttttactacttctgctaccactacttccattttgtcagggaagaactcgtactacctaatcgattttattgcgacgcagtgtctgggaggaagcgaacaaatgttgggctaccttccctggcaccaagatccggattcccgggtacaagagctatggggcacgtacattacacatgcgtgcgtaaattttagctcggctgcatgcatgttttttttcccaatcttaaactaaaatggcaggactactactaatttgtcagtgtacataatgacaattattacgtgtaatgcagctacccccacatacatggagtagtgagaaaagagatgcacgctcatcgatcaataatagctacccaaagtaattaatgcaagtttggatgcgcattgaaaaaacaccatttcgtgaacagagcgagtcactgaattatagacaccttagagcaagtataatagtgagctataaatctattataagcttatgtggagcggaaatgctgttcggcgatcgatcgccctagggatggagcagcgatcgatcccctcccccctccctccctccacctggtttccttttttggcaccgcattactttcctattttagtaaatttatacacctaaagtttatacacattaagtttacacatctaaagtttagagaccaaaagtttataagtcaaaagtttatatatctgattcaaatttgaatttgaattcaaatatttttttatatatagtatttctatacatctaaagtttataagttaaaagtttatatacccatttcaaatttgaatttgaattatatctgattcaaatttgaatttgaattcaaatattttctatatatagtatttctatacatctaaagtttatacacctaaagttttagatcaaaagtttataagtcaaaagtttacatacccgattcaaatttgaatttgaattcaaatattttctatatatagtatttctatacatctaaagtttatagacccaaagtttataagtcaaaagtttacatacccgattcaaatttgaatttgaattcaaattttttatataatagtatttctatacataaatttttttaacttttgtttttttaaaaaaaattgtgtagtgtactgtagtagaaagagaagaaggggaggagaaagggggagaagagggaggagtatagggggaagggggggggcaaaccgatcgctgggcacgatcgcccattaggcccccctatgtggaggagagaggtaaacaaaagagaagggtgttggctctcatgtaagagctagcttaacacaagctccaagacaaatacattgaatatataggtgagag

SEQ ID NO: 19317 - DNA, 1501 bp, Oryza sativa
catcgccgcgtgaccatcttcgctctctataggctggctgccaggcccctttccaaacactactttaagatctttaaccatagcaaacactgttttcccgctgcgatgtttaggcttcgtacgatggtccgccgtatgttcaaagtgctttcctttcttccgtaccgggtggtttgctgcaaggaatcaacgatgacccatgtacacaaccttcctacagtgcttaagatacgtactttttgtttcatccatacagtgagtgcaagccttgtaccccttgttggactgcccggataggttgctaagtgcaggccaatcgttgatggttacgaacagcagcgctcgtaggttaaactcctcctgtttgtcctcgtcccacacggggacaccttccttcttccacaacagtttaagatcttcgaccagtggtcttaggaacacatcgatgtcgttaccaggttgcttggggccttgaataataatcggcatcattatgtacttcctcttcatgcatagccaaggggggaggttgtaaatacacatcgtaacaggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatccgcggggtgtctcagcatcccgtcctgttgacgttcttcagcgtgccaacgcatcattctagcattccccttgttcctgaacaaacgccttagccgtggtattatagggaaatatcacatcaccttagcaggaattctcttcttcgttagctgcccgtcaacctcacctggatcatctcgtctaatcttgtatcgtagtgctttacaaacagggcatgcttctaggttctcgtactcctcactgtgatataggatacaatcattcggacatgcgtgaatcttctgaacttccagtcctagagggcagactatcttcttagcctcatacgttgtctcgggcaatttgtttccctccggaagaatgttcttgacgagtttcaataaatcgccaaatgccttgtcactaacaccattttttgccttccattgcatgaactctagagtggtatccaactttttgtgcccctgctcgcaacctgggtacaacgacgttttgtggtcctctaacatcttgttaatttatgggcccccttttcactttcgcagtcctccttggcatcctgcaacatctgaccaagatcatccgcaacgtcgttataaatcagcatctatgtcctcctcgcccgtttgatttccttcaaatccagcgtactgagcaaagtctggaatattgtcgtcttccacttcatcttcttccatttcaaccccttgctctccgtgggatgtccaataattatagcttggcatgaaccctgactcaaacaagtggaaatgaatagtcctggatgcagaatactccttctgattcttacactta

SEQ ID NO: 19318 - DNA, 826 bp, Oryza sativa
ccattagattctccatggatggtagatatcaaccattcccatcccctaatgtgtgaattcaccgcggggaatcggtgattgggttctcattatcatctctagaccgaaatgaccagaattttcaaaatttcggaaatttcgatccgcaatgtctaaccctgctcaggagcactcccttgctgtcgcacgcccggatcatcacgcagctgtgtaccccatggatggtattatgcctccctcaactctgtgttctttctctgtcatatatcttagaccagtaggccaaaccagcgcgtctccacctccctggatgaggccatgaggtgaccttagccattagcaagagccgtgttatatggtactgttatgttcaacacttgtagttgatttgttctctaggcccctttttttttttagataatagattttcattaatccagtctctatatccacgaaggatatacacagccaaaaggaaacaagagtacttagactcatatctcaacaaggagaacacaacacaaaaaaaaaaacaaacaacctcggcacatcctgcttctctgtctcccgccatattctcctgaaacggccgcccctagtgtgccgttgatgcaaacctccatttgtgccatcttcatcaatttcaggtaagctgacgtcacgcgccgcttattagcccactttcaaccgccgtcattcgtcgtatagtcggaactagacaactagacacgaaccgacgggatcggcttccacttcgccggattctaggcatctactatccaaagtgctcaaaccatcactgtctcgagccgccgcaacccctagg

SEQ ID NO: 19319 - DNA, 1501 bp, Oryza sativa
tacggtcatcgcatccgcaaagatacgcaatcattgacatggcaatagaagcgcacgagttcataccaccaaaacacacaaattcgtgatgtcatcggcggttgagattgtgggagtttttgagttcaccgtgcaaactcataatgttgtgcgagttcacgagcgtcctcggtgcgaactcttgggtggtgtgagcaagttgagagcaatcagagacgcacacatagtcacgtcaggtgcacacaagggaaggagtggcatcgcaagggtagatgcgacgacaatgaataatgctttcatgtcctcttcacatgagttcgataaggaatcatggtctcttactatgacaatggtctaatcttatcaatattttataattgatatatcttaaaaaaaactgtgaaaaatctatttttatttatttttactaattatatatgaatattacccttatacttttttattacttgcctgctactctacttgtagtggccttcaagtagatatgattgtctgatgtcaatttatacgaaagaatatgctagagaaaaatggacccaagagtaaatttcctaacttctactccctcttttgaacattttcctaacttctactcttatttttcacgtgcacgctttaacttttactttctctttttctacgtgcatgttatttaaactactaaacgatatattttttaaataaatctatagaaaagtttcctttaaaaaaaccatattaatatatttttttaattttagttaatatttaattaactatgtactattttatcgttcaattttacgtgcgcattgagaagtctccaccagcctaaagagcattttgtaggtgtacctgacgttttctacgctgagttacccgcatatgataaagaatttcatagtattcatgtgggtattttgtccagaatttctttgcaaacatctcaaagtgaaaatccttaccatgttataaacacacttgacacttgacagataaatgcatgcacattgagtgccagctcgggaggcccgccggggacctgactacctgatctgccactgccagatgccagtgcgtcggaggtggtaccccccgagctccaccgcagcccagcccagcccagatggaggcgatgtaaacacagatgacgccgacgcctgcccatcttctcgacagcagagaccgccgtcgcttccacagcattcggctcccatccatcaccgtaagcttctatctgcttcttgcgatccttctgcgattctccgtcgaattgatcaaccctgtgaaccccaatgcatttgctactctctatcatgtctctgataatttgattgatcctggttctaattcttaccctcattacaagcgagcgttcgttctgattactgattgcgatcctggttttttttttatatatattgatctctccatccgaattctctaactggccatgcaggtagacgagtaatcaactccattgatgccagcggtgaggtga

SEQ ID NO: 19320 - DNA, 1501 bp, Oryza sativa
tatggaaatcagccatggcagaccaatcgatagtgccagccggttttaaggcgcataaatgctattactcgattgagaaaatgaggacagggaaccggcatccaagcacacgttattttctccgatgtatgatgcggcgccatgataggccgtgcggggcgagtgaatcaaatcaacgacagaagcattcgatcgaacggttcatatgcgatctcatccaccgatcgaacgactaagaattagcgatgacgtggaacactgaggtttcagctttaagtctaactttatagaaagaagggatatgtatgtaatcactggacttgtatactgtttaatggcttactctgaacagtggattgatatgatgctacgttatatgcagcttgccgaccctgtaatatctttcattgtaaaaatctgtttttagccaattaataaagttcaggctggtataaacacccgccgtagttccccctaaaaaatatgcagcttgctgattcttcggagggagtaaaggtagacgctaataggagtatgtctgttatatttgatatcttgagaaatgagaaggaataaaagggcaaggctggagaaccttgttcttgaatcttgatgaactgatgaagaaaaaaaaactataattttcacgactgctgaagcaactctttcctgtagcagacattgtgtattaatattttgttcaactgattgaatgccatattgccagtcttggcccattatatataacacgtcgcaattttctttcaaaaaacactagaatttagctggaatttcaaatactatattttattgaaattatatgttccagccctactcttgataaatgccctatcttggccacttctagttataacttaattaaaagcaagataaagaacaagcacactagcgattttaacacatctccaatcatatcatattaagtcattctatcacatcttctccaatcatattgccgtgagacgtagatgtgtagacagacctttctagtcctcagcatgagacatagatgtttacatggttctaacacaatcagatctacacatgtacttaacatacgagagtacagagattgtgtgtatacatataccaccctaatctcctactcggcacgaggaaattgggatccgaggatccatagcatacctaatgccttgacggcgctaagaaatccaacagacaccgctagcacaaatccaactaggaaccgtgtgcacttaaacacgctgatgcaaaatctgtgctgtctagcaaatagggcagtgctcaaggctgcaatagccataccccacgtgcaacacataagcacctgcatgaccataaatataacttaatcaaattaggaagacgtttgagagggggcgaatgagttatgagttaaaaggaaagcaaatttgtcacttaatattttatttccgacataatacatctttttaagaccgcccatataaacaaagtattaattaattccctccatttc

SEQ ID NO: 19321 - DNA, 1501 bp, Oryza sativa
gaaacgctcgatcacataatcggtaatcactaatcttaaaaaaagactctctcagtgaagttattaaatgaatttaccaatctttacgccttgaacctcttgtcacttcgcatatcctcaacgaagttattaaaatgaaacgaagtctcataatgtacatacttgagaattcactgggataagacttgacaagactaataattttgtctttgtcatatgggagtttattgggttcaaagctggcatacaaacaagcaacgccatatctaccttgctaaagaaacaaagaatgcccaaattcctcttaatatttgattaacaaagtgtttgtgcgttgcaacaggaaaaaatacaataaccataaacactaaaacaatgggaaaaattaaaataacaattgaacttttctgaaattcctcaaaccatattcaaaaataaatgaagtgacatgacagttatatatgttagcgaaaattcccaaggttcaccagtaattgttgaataaggtcagtgaaccacagcacccacccctaactctgttccttaccacagtgcactgatcacatatacaacctttgcaatctgttctcaggtaaactccagatgtactaaaaactaacataaacttctttatggtgtgtaagcatgaaatggagcttaatttctgcaaaatacatgtcccttataattttcttcttctatggaattactcctttacatgtctctttgatgagcaaatggagcttaatttctgcaaaatacatgtcccttataattttcttcttctatggaattactactttacatgtctctttgatgagcaattgcagcactgaactaagctaaatagattaatttgacagttttcagttgccagctaccatatcgcacaaagcccttgacatgataccacacacaacaactttgagaagaatcaatccaagcccaaaattttaatatatgttcttgtcgatcaggatgttagatttaatatttttgaggagaccagattaagatggatcaagtagagctcatttttttcttgtaccaaatagattgaggtgacatggaaattagctttaatcttatccctttttgaatgcttaggacatccttaattaattatagtattatatttctaaaaattaaagtttgtgttaagtcttttttttagaaattgtagggaaaggtataatgcttgacgccttgacctatcacatatggcttgttgagatgttcaatatctcaacttgttataaattttgatgtttcgtctgaaagtaaaactcaaatttacatgattgctgggtaacaatgaaaattttattgaaaaaacaaagggaaataccaatatgtgctctccatcaagatatctaattcctaatttgccttcagcactttctagtgttttcagaaaagaaagtttacatttactaactttgacatgggtatttgactttaaggatatatataattccaggatgagatttaagcacctcca

SEQ ID NO: 19322 - DNA, 1240 bp, Oryza sativa
aaacgtgaacgaacgcgaacgaacgtgactgaaacgtgaacgaacatgagtgttagtgaacgaacgcgaacgaaggtgaacaagcgcgaacgaacgcttaacgaacgcgaacgaaacgttaaagaaacgtgaacgaacgcgaacgaaacgtgaacgaacgtgaacgaacgtgactgaaacgtgaacgaatgtgagtgttagtgaacgaacgtgaatgaaacgcgaacgaacgtgattgaaacgttaacgaacgtgaatgcacttgaactaaaagtgtgagaacgaacgcgagcgaaatgtgtacgaatgagataattaaactattgttgaacttagcatatatatatgattatatatacttgaaaacgttaaatacattatatgttcctttgcatttagactaatacattttttttgcatgttgcagagaagacgacgtcgtcgtcgtccctcaagccgaagtggtagctagccctcgaaggaattcgcgcaggcaagtgatgtaaagatgtgattgttagagatataatataagattgttggatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacatgacacttagacttagcatatttgagtgttagagatagttagagatttaatataagattattagaggtttaatatacgaaacatatttgattgttagagatttaatataagattattagagatgtaatattcgaaacatatgtgaatgttagagatttaatataagattattagagatgtaatattcgaaacatatttgattgttagagatttaatataagattattagagatgtaatattcgaaacttaattagacttagcatatatgattatctaccatacaaatacatgacacttagacttagcatatatgattatttgagttttaatacaagattagtagagtgttaatattacgcttagcaaatatttcttctatgaacaga

SEQ ID NO: 19323 - DNA, 1501 bp, Oryza sativa
atctggttgttatcatgtcactttccgttaagaggttttggctgaatcaatgccacctgccatccatgatctccaggcatgtcatggtgtgtgggggaatctcgagctaggcaagataccatgtcgtcatcccaccgatcaacaatctagaatcttcattttaggctacaaggcgaaaaccacaaaaattgtataggtaactatacaatattttaccacagtaacttttttttctgcgaaaaaaagagactaagataccatatatcccccataaaacaattaatttaagtgctatgttcataacaaagtacatttatcataattgcttaaatcttactcctaaaatggtgggagtaatttttttcggtccctcttcaagtaactatgagtaaaactagaaattttttcccagaaaatgtcaagaatgggaaacggacctcaaatcaaatcaagtgtggtccttgacatgcatgttccctgttcattagtgaggacaccgaccctacgacggaaaggagtaggtagaagaaaacaacatcccgagaaaatgcctccccggagactccccaaaagcaatgcgcactttagcgctttgagagtccccacatgataaggagatctacgaattgatgcttgatcgatctctctttgccttaaattagcttcatttaactcgccacctctcgtgtttcaggcttccggttattattcccgacaccatcacacaaaaaggctaaagcactcgccagatttcaggagtagtagaatttaataattttttgctgcatgatttggagaattagtcccctagcatctttgtgttttgtatacttgtgtggccagagagtaatcgccatgaaagcagtaagattttttgcattactacttttaattattcagtccttgccttgcaagtctggatcttctttttgtaccgcatcatttttttttattttttttgctttccgctgatgctttgatgttgatgcctatcaacccacttgacacttgaaaatgcgccttgctatctttgagctcctaaagaaacgtgcaatcgagaaagaatcttgaagaagaaatgatcgagttgcctggccaaaattttacataaaacaattcaattcgtgtaagaaccagggaaaaaaaaggtgtatgctctacatttattcaagacagtgaaagtacatgcctctacatggggcataatattgttttctgtcgcggttagaatactggaatttgaataattatgtcctcgatcttgtacttacataggagaagcaagattcgaaatgaccacccagactaaacatcatatgtccctttgtgctttgcattatttttgctagtattggattggtcagaagtggataggtaggatgggtttatcagcttctgagatgtgatgcagctgatctcttcatgacttggcccagttacattgtactactgtgatgtaggagtactgtgtgataagggagtggaccaactgacagtaaca

SEQ ID NO: 19324 - DNA, 1501 bp, Oryza sativa
gctatgtgttaacaaccaaatttggtaatctaagtatcggaggtgaagactagatcgaagtggaatccaagttcgagatcgtatcggaaacagagcaaggatcggctggactccaaatcggctacaaccagatcggctgagtccgagtcagaaagggagagccgatgcagccgattccgacaatacgactcggtgtacatcgtcgaattgagttaatgtgcttcacggtgattgccgcgcaaggatggagtcctgagaaggcaattgtatctattaattaggatattttatgtaatttacctagagatatgtttggtcaaaagtctgccgtaaagacttatggtatcttagagtttgttagagataatagtcgtgtccggtatggacatatcttgtaattctcgggtataaatagaccccgagccttatgtaaaagaaaacacacgttcaatacaacttcggcgcattgccaccctttttacttgttatggcggtttgcgttctcgggattagtgcttccatctttatgacactctaatcttgtttgtgtaatccgtcgagttatcatatatcttacataatctttagcaatatcattatctaacctacaatcggctagtatctgtcggtggagtacagccgattcggttagatattgacgttgatttagattatataggatatccaccactctatgaaacttccagcggcttgattgtctagatattgttcttcttttcatacttaatgctgcatcagttgagtttgatttattaagtcgtgcttagaatatcaatctctagcctgccttctggttgccgattagggtagtatcggggtttcagccgatcttgcctgatttaactacttttattctatatgcttgattgatacgttaaatccgccctttatgttaagatctcattgcattcgagtatattaggcttctgtttgatatattttacttgctttaatatcttgatatagagtagtattggagtattagccgatacatgctagatctatttgatcggctatgctataaacatatatagccctgttattaatatatatttcaatctaagtgatttatactgtctcggcatggcgtccgatctatcccaatcacttgacttaagtatatatcgatatagggagtatatatcattaatatctacagccgatcaagtaggtttagtttcttcttatttattcatgactgccgatcgatgcctatatgacatcggctcaaagataaatgatatgtcatcggcacctagccaatcggctatcgtttataggattaatcgcggtttctttgtctttatttcttgttgattgcaggatcaaatcaactggcatgctcatacacccgaaggcgagttttggacctgcactggagttaagcagatctcccaggccgccgtgttcgatttttacgtcaacacgcttttggcacgcccagtgggaccgattagaagtcagaagacaatttccctcg

SEQ ID NO: 19325 - DNA, 1501 bp, Oryza sativa
tacgtcaccccgtcgcgctcgcgcatcgcacgcacccacccgtcgtcgcgcgcgtcaccgtacgccgcttctgtcgccatggcctcctgtgagcgaggcgtcaaacgtggtacacgcccaggtagggagcagaggagaggagaggaggggacaccaacattggccgcggccgcagcggcgagtggagggatgagcgacccgcggcgtcgcccaaggggcgcgcgtcccctccgcatgcatggcggccgccgggcgaggcgatcgcgcatgcacgtccttgcatggcggacggggcctaccgccactagcggggaggacacaataatgcgagctcgatctatcgctatagattacggactagtggtaggataggtgaattctgttgcagattaatctactatagtatagtccttggcacaatttgagttcatgataggctattaggctgtgacgatgtgttccttttagattcgacgtagatggacaaaaaggtctgtcaggtgttgaccatttacgtcacgactatgaaaatggcttctggcgagcggagagagcatttggcctgagatatttttagcctagcaatctagcatggtgccaaacggagttgatgagcctagcgaactgtacgagactgacgccccttttcttcacaggaaagacatgtcaaggaaaaaaaacaaaacaaaacaagaaagagtaggataatcgaggtatcaaactaaaccgagcccactagcccaccaagcccaagccgggcccagccttgcttgggctcacccgtaatcctttccccagtcccagacggaccaggccgcctggcccaccccactgctttggtctggtctgtgcttcaatcatcgtgcacatgtctagcacacttcatatgcacttcaagcacataatattcacatttccaaccaaaaggcctatgcacggagcacattcaacctgaatggcatcacctatcaacctgtggcattccaagccactgcatgtccacaagaaaggatgtatgtagtagtagtaaatactggagtggtacaaaatggccacattcacgttccaccagcttttctacaactagccaagagcccgtagacaaactaagtttctaacttattaaatcaattaataagcatatatttagtctaagtagtattatgattttccttattgaacaagtaggtagattagggaagttctattgattgctgctttctccagaccgccggaaaaagcatgaaagaaaaggctcgaattgtacgatccctccgtcacttagattgaaaggggtgatctttttttccgaatgagaaagcctttggccttgcaaatccgtttttgccgggcacaatagacatatctgctcagtcacaacataaggaacccccaatgttccgataagcctacccggcctgacagctttagttgaatgatctgatcccgaagctaatttgagaaggagtcaatagtttcgttcaaagaagagtcaatagtg

SEQ ID NO: 19326 - DNA, 1501 bp, Oryza sativa
tttcaaacaaacaacttgaccagatgtgcaaatgagcaaaatcagtgtcaacacagtagcagagtagccagcattaagcagttcaggtctggattacaatctaaagtgcgagttagcaacacaagaatcctcccttaacttacaagtgcccttcaaagtttgtgtttactgaaagtccaacaagtgctatttacacaatgaatcttataaaacagtatacaatgatgaggtccaaccagcttgtttgttagtcaagtggcacctaacacttgtcaaatgaccctagttctttaatgcacaaaaaaaaaggcctagtaaagaacaagcagcgttgcatattcatatgctaaagtatgaacatattaacacttaacaaaatggatgctgactctgaatgaacagataaggccggaaattccatagcccagactcagactatgcttaaggatcaattttcaggttaagtgaaggacacagctagttatcagaaggtagtaggtctccataggaaagaagattatatctaattgtctatataaaacacaaaatcgcatgcatacctcaaaaaagacctgaggtcttggacacaaggttgaacaacaaacatatggctataggatataataatggggcttttttctaagagaagatcaaaaagtcaaggtaaaagtgccaaagggtctcaccactaaatctcctcgaactccagcttcttcaatagcttcacgagcagctgcctcttcaacagtttcatcattctcccatcctccctaaagcagtatggcacatcaaacaaaagaccgcatgccacagaatcatgtactatataataaacaaacagatatatttatcccaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttacaaatcaaggaacatatctttatgtaatggtagatggataacggatattggattatagcctaaataatttcccatcaattactctggaaatctaaagcacaaacagaataacatcacagatgttttcatataccatgttctgagaattgagtgactcttaggcatagatgtttaaaatgttaataccttaggaaataggagaccagatccactctgggagttgatcatgagaacttccacaagtttcttgtgtccatcatcagaagtttcatcattgttatctttatatctaaaaggtatgcacctacatatataagaaacaagtatcagatgaatttaaagcatgacaacattcttctctagggtctttaaccatgttgtcttacagcaaagataagagcagcacgctcacagatacatactaatgtagacagtactgtttaattgagttcataaaatcctgttctgaa

SEQ ID NO: 19327 - DNA, 1501 bp, Oryza sativa; identical to SEQ ID NO: 19313

SEQ ID NO: 19328 - DNA, 1501 bp, Oryza sativa
cacttctatccttgcttcaaaggcccaaacgtccccgtcgtccctatcggtccaattcacctatgtagccacacgacatataggctgacgggtgggcccacttacccacgccaccccactgcctataaagttggatctgagaaatgtgtactaaacatactgcgagggtcggctctgagcccactaaacatactgcgagggtcggctctgagcccaaccaatggacggataccactccacttacaggctctgagcgcaaccaatggacgggcctacgaacctacttatactttcgtcctcgcttcgtgtaaaagggttaacctagaagtgatatgattggaaggaagatgtcttataagttggttccaaccttgttaaactagtaaggtggtactaaacatgagcacataactcaaggtggtactaaacatgagcacataactcaaggtggtactaaacatgagcacacaactcttataagccacacaggctaaattctaattggactgggatattaaaaaaccatactggcctacaatggtaataagctgtctgaatgatgatttcaattatgttccttggtaataatagtacactataattgacgatgctacccaaaattcaaccatctccgcgcttgttcatcatttggccggatgctttaaccgtgattatcctgtgaaggtgaatagtatagtccactatcggctgcaattttttccatgtcatgtatagccaacacgatgggctgtaatgcatctgccattttacttcagcaaatgatatttaattctttcatttatcattttctctctcctttgcatttctgttccgatacccatgggccatggggcgtcgtcgagcagttcctcccgcgcgtagaaaaacggaccccactttttcttcaagggcgcgtgtaggcgggcgacaatttagtcgcacgctcgtcctctctctcatccgcgcttagcaccaggtcatcttccgaacctacgtggactgcttatagccatttctagttctgtgcatgctctaaagtttaccccatacccacacggcatgtatatccgactaggtataagggtaccatatacagatagaataaatttagtaaaggactcggttgttatgttaacttgtgtatcaaggaaacatccgatagttctagtcggttacgattgtaatttatcttgtccgttaggaacatgggttgtatcttgtaattccggctcctcctcctatataaggaggggtccgggtgcctctaggggcataatttttctccctgatcatacgatcaataatacactcggcggatcaatccccggacaggagtagggtacttctcatcgagaaggcctgaatctgtataaacctagtgtctcctaacccatctacttttccagcttgatagccaccccttttagtattgccaaaatattgtttcgacagttggcgcaccaagtaggggtagcgtcaagttcttcgccgattagtgcaa

SEQ ID NO: 19329 - DNA, 1501 bp, Oryza sativa
cacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaacggggatctgttcttgtggttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgca

SEQ ID NO: 19330 - DNA, 1501 bp, Oryza sativa
tattttaagaatatccggatttcatccaatctgtccggaccgggtcgacaacgaaaaaacacatgtttttgtcatgctatgataaattaactaactactattttaagacaaaaaaatattttacgtacagatttcatacggtctgtcggatcgtgtcgacaatgaaaaaacacgtggtttttgttgtcctaaaaaattaaaccactgttatttaattatatatatttttcatgtggtctatccggaacgggtcgacaatgaaataacacgtgatttttttggtcgtgctaacattttttaaataactatattttaagaccaaaaatatattgcatctcttttccatgcggtttgtccggaccgggtcgacaatgaaataacacatgaattttttgtcgtgctaacatttttaattaactatattttaagacctaaaatatattatgccactttttcatgcagtctatccggaccaggtcgacaacggaaaaacacgtgtcttttcggtcattctaatataaattaaataagtactattttaagacaaaaatatgttacttccgaatttcatcccgtatgttcggaccgggtcaacaattttttttggtcgttataaattaactaactactattttaacacaaattttacgtccagatttcatatggtctgtctggaccgggtcgacaacgaaaaaacacgtggtatttttgtcctaaaatattaaatcactgttatttaattatatatatatatatatattcatgcggtctgtccggaccgggtcgacaacgaaaaacacgtgttttttatcgtgctaacattttttaaataactatattttaggacaaaaatatattacatgtctttttcatgcggtctgtccggaccggattggcaatggaaaaacacgtgtcttttcagtcgtgcttagataaattaaataactaaccaaaatatgttacgtccgaatttcatccagtctgtccggaccgggccgacaatgaaaaaacacttgttttttggtcgtgctaaaaaaattaaatcactgttatttaattatatataatttttcatgcggtctgtccggacaagatcgacaatgaaataacatgtgattttttgattgtgctaatataatttaaataactagtttgacggacaaatcaaccccaaatcgatctgaatttagcaatttatgcctctccgaaaattattttcttctccctccactctttccctccttttttttttgctcccgcaatttttttctgttttcttttttttgccgccaacttttttttttgcccccaccttccccatcgagaaaagcaagccaactgcccctaaaaatctctttcctctatcctgactccctgagtaaatctctttcctctgttgtgggattcccctttcctacgaactctcctgtcgttctacggttctcctcctcgtcttcatcggtgttgatctgtaggtaagatgccgggcgctttactgacc

SEQ ID NO: 19331 - DNA, 1501 bp, Oryza sativa
taagagacatatttgccaatggcatttccacatatgatgcatttagaaatgaaacttttaatttgaggatagctgtactgtggactataaatgacttgccagctttaggaatgcttgcttcacatatggtgcatggagaatttgcatgcccgccttgtggtccaaatgtatggtccaaacgtttggcacatgggaagaaatcttgttttatgggtcattgtcgatttttgccacctaatcatgaatttcgttttgatagaaattcttttgatggaaccacagagattagtacagagcctatgacttactatgggcgtccggtattggatgaaataaattctatcggtgattttaagaagtcaaaaacttataaggcagtaagtagtttattcacactaccttactaggatgtcaatcttcttcagcataatcttgatgtgatgcaatatttatggtacacttctaaatttagaaggaaagtcaaaggataatctccaagctcgtcttgatctcaaggaaatgaacattagaggggagctccatccacaacaaagaacttcaagcaagttctacttaccacctgccagctttactatgtccaaaagtgagaagcaattgttctgtaaagttcttagggatataaaagttcctgatggctattcttcaaacatatctagatgtgtgaactctgctgaaggaaaaattcatgggctcaaaacacatgattgccatgttctaatgcaacaattgatgccaattgctttgaggggtattcttcccaatgaagtcacatctgtcttgtttgacttatctgcttactttcgaggaatatgttcaaaagttctccatgttgatgagcttgaccgtttggaagaagcaattaaaatcacattgtgtagaatggaaatgatatttcctcctagattcttcactgttatggttcacttagtcgtccatttagctactgaatgtaagattgttgggccagtttgctatcgatggatgtactttattgaaaggtactaaaaatatattagcatacaatttataatatttctcatatgtcatatgatacaatactaacttattagttttgtgccttgtatgtatattacaggtacctaggtaaattgaagtcgtatgttcgcaacaaagcgcgtccagaaggttcaattgcataatcatatttggcagatgagtgcatggcattttgttcgcgatacttggaaggtttccctaccaagcataacataccatcaaggaataatgacaaaccagatcaatttgagactcccatgagtaggcaagaatccactttgtttcctctagtaggaaaaccattgggaaaaccatcggcgtactccttaactgatagagagaaattgcaagcacatagatatgtgctatacaactgtgatgctgtagtgccatatctaaagtacgtattgtcctaacatagccttttttttatgtgttgtaagtgttttgcttcaaatttatg

SEQ ID NO: 19332 - DNA, 1501 bp, Oryza sativa; identical to SEQ ID NO: 19313

SEQ ID NO: 19333 - DNA, 1501 bp, Oryza sativa
accagcgtacaccaataccctctatatccggtctacgggtatcacccgtcgacaaggagggtatccaaaattgtaatcgccgcaaccgcattctgctgtggggtgcgaaaaactgatgtgccttcgatgtcttgttgtctgattagctcacgctcgatgccctgattccaaagcacgctgtcgtcgctcctcagcttcccatgtcaatcgctcgggctcctgctgctcatgcagcagtcgggcttgctcttgggtttgccgctcttgttccaaccggcggcgcttggcttcctatcatgtgcacagctcatcggcctcgcgtgccagacgttgttcttctgtctcgttgtcggccataaagacgccaaaaagagaggagtgtagttgtcttcgtagtcttcatcaaggtcgtcgaagttgttgaagtcatagttgtagccgaagtcgtcatagtcgagaatctcggttggttgacgggagtcgacgccgggagagctgaggtagccatctagttcttccgtggagacagtcactacaacaagaacccccctctagcaatacatgcttggcaacgcattaagcatgcgttgccaaaatgcgaccctagcaacgcttagtagtgggtgagcccaatttgcaatagataatatgtgttgcagaacatgcgttgcagagattgagtatcttgcaacggccgaatccactttacaacagatatcatgcgttgcaatggtcttgatgccctgtaaaaacttttggaataagcgaacttattgtattttttaaaataatcgagtgagatatttatttttcatttcggacctctagcgaactgttttttaaaagaaattatcaagtgagttgcttttttttcctgttaaaacttttggactaagcatgctttttaaaaaataataataattgagcgagctgctgatacctgataggaataaattaggggggcaaagatgcaaacagaggattcgaacctgggtctcaaggatagaatgtgcgcaacccaaccaactgagctaatcacatttcttattaaatgatttctttaggtgtttatatcataacaactaaaatacgatctgtgaaattagcactttagcaggcaaccttagtctcccactttctctcctctcctctcgtgtctctcacctcacccaacacgcacgagagcgccgccccatcttgttcccacaccgcatctcattttcttctcacgcactcgcacatcactgccacggcgcacaccgacggccagcggcgcgttctcagcagcggcggcggtgagcccgcgaggggatcggccgcggcaggccggcgacgggccgaggctgacgacagcgggtcaacggcaagcacggtccttttcttagccacttctcataggttgattccccatttggccccaaatccaggtcagtgtcagatccaggtcaatgtcaactttttttttaattattcaggtttgttgcatcatgagtctatctga

SEQ ID NO: 19334 - DNA, 1501 bp, Oryza sativa
aaattccaaacattatattactttgcagtaccgcataccttattagaggatacatactgttgtactgcataccttattagaggatacatgagtgaaacgaggatcttcaaattgagaagcatgaagtgtttttgtgtattccctgaagatggcaaaatggaacttcactagataagtcatatacagtgtttacacttctaatcagagaagatccagatgggcttttgggttaccatcttagttccacatcattcaatattacttataaagtttgaaaatattccataaaaggcgagtgtatgtaattgtatcataattgaagttcattccttaaaatgaacaaaccaaatcctggttgatactcctacatggtagtgctgagtatgaaatatacaaactgatgcataaaatctaaagagcaaaccaaacacaaagctagaagaagtgtctcagtcttttgattaaggaataaggattgctggtttttctttcaactttactgtgccaaagatctcagttttgttcggtaaacccactgtagcttagctgctaagctattcataaagactgggtatccatcttcaaatattcagaccagatgtcatatatcaataaagatgtggatatgagggtaacttccaattccaaatggcatggttaacagggatagaatttagttgaagactgggccgatcaatgagtaactgatgaccaatgttctccttagcaatgtttgcacacacacacacacaaaaaaaaactgatagtagtacgcaatatgttaaccttttattagagctcatctgacggtgtgagtttgcagcagatgatccctgacctggagaatgatgagataacccttcaggtcttccagaagatgctggagaaatgaaagcaaacatttatatataactatccaagcaagataaactagcaatgtgtagtcgtagaaagaaaacggttacatattgaaacaacgaaggctaaacagcatagagttagggggaaaagaagaacatggaagcacacatttcattcggccaagaacttcctttctcctgacttccagtttctccttagtgtccagaagactctcaaactgaggggcgtatgacacctgcagccggttgccaagaaatacagactcatccaatttcctctttgcaaacctgcaattaatgccgtttcttgctttcattgagaaaataaacttgcgatttggcaaatagtaggtccagatttgttcccaattgctaacaaactaaactaaagctgtaatcctaagcacagagctcaaaacagggatgagaaggagacaaatttgtcttagaaaagactaccaaacacaaatttaattgttggaattaatggtggctagtaacatttttcactcattctgtgaacgtcggttcttcctgaacaggaaaaaggactgaaagaaaaggtactattttggttactcacctggcattgctgacctgcgagaacttgatgaagaaaa

SEQ ID NO: 19335 - DNA, 1501 bp, Oryza sativa
tgttgacgggaagaatgtgttgtagtcgccaccagatcctcgggcttccgcttgtgatctttgttatgagtgccgcttccactcgcccctacggttggtccatctttcttggatttctagtggctgcccgactggttggaagcaagaacggcttcgtcagcctttgcatactcattggccttctcaaacatttgcttgactatcctgggaggcttgcatccaaacttgccgactagaaggtcattacgaactccttttgtgaatgcggctatgatggcatcatctgtgatatcagagatcttgttgcgttgttcagaaaagcatcgaatatattcccgaagggtttcaccgggcttctggaccacgttatagagttcaaaacatgtgccgggacgctcgaaggtgccttgaaagttggcgatgaagtgatctcggagctccgcccaagatcctatggtgcctcgtggtaacccatgaagccaggatcgagcagagtcagctagggccactggtaaataatttggcattgccttgctatcttctcctactgcgcggattgtgagaccgtagacagtgagccatggttcaggatctattttttcgtcatacttctcgatgccagtcggcttaaaaccagccggccaatccactcgacgcaggtcgcttgtgaaagctgcgactccatcttcatcatattcgtagcagtccagggttcgatgccgccgatcacctctttctgcacagcagcggttaagtgtgtcacgtaggtcaatgggttgccagcgacatggcaagtgaggctgctcagcgcgtcactctctgtgcctatcggctggcgaatgaactaaatgttcatgatgatccctgcccccgtgagcagaccatgaccccccgtgattggatcttgaccccgcgatgctgagacttggttgatggtaatcttcagattggagggatggaacccgactgccagttggcacccgaatgctttccaggttgactggaactgatgcggcgatcattgtctttgtctgattgattatgttgagaacgtgattgggcacatcctctttaaggagtgtcagggttacgggttaggcataccccctacccttcgatatacgttacgtatcgacatggcatacccacgcgcacgcggatatttcctttatgatctaaggaaacctttcacgagatcaatagatgggaaaagtccttctcggacaagaactgggtcacctacgtatcgtgctaggtctggtatgttcgagtcccactcggagagcaccagacctgcgatataaaagggaccccccagggagggcatagatcatcgaatctcagtgccaacataacccacacagcctacgaagtcagagcctgcgaggagccaagtcgtcaagagctagtcgaatgagctcgactacaatctcgccggatctgacaagttccatcctttcctttgtaacctatgttttccaccgtataatcccacatcaat

SEQ ID NO: 19336 - DNA, 1501 bp, Oryza sativa
atttggctaacgccgggcgtccaagtatagcatggtacgctgtctcaaagtcagcaacttcgaaacaaacgttctctgtacggaagttctcccgagtgccaaaagtaactggcaaggtgatctggccgagtggggttgaagacaaccccgggatgactccatggaagggcgcaccactcggtttcaactcggttcgtgggatttgcatctcgtccagagtcttggcaaaaagaatattgagtgcactgccaccatcgatgagggataaccgaagtttgatgttgcgaaccactaggtctagtaccagggggtaccaccctgggtggaccactcggtcagtgtcacgcccggaatttctatccaaaattccaaacgcttacatgtgtgtaaaccctcgtccagaaatcagccgaggcacacaataacaaattgataatagagtacaattattactctaattaataagcgaatataaagtcattacagaggtagatagttcctctcaaacaacaaagttctaagcagcggaaaataaaagaaacagcacaggcgactcctctccacaggcagcttgaccagggctacgcctaatcatccacaccatcagcatcactgtagaactcctcctctgatgaatgactgcaaggtgagtatatgacatactcagcaagccacgcaacaaatatgcaagtgcaatggataacgaaggatggcataatatgggctcatttgcataaacagcatttaataagcaattgagagaatagtaaaacagttgagtaattaaacaatattaaatcaacactatacaatacacccgtgttgcataggcccaaccattctgaacaaccaatcccggctgcacagttctatctccaaaccaggaatataccattccaaaccaggagctaaacaagttattaacatcatcatttaatatagtgagaagtgtgagactaatcacgaaagacattgttagacccgcccataaccgcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcctggatcataatcacccccttataaacaaggcatggactccccagcgacccccgtgggcttatctccgccacttcacagtctggtgctctacaatgaaccacactatacagaaagtaaagccgttgcccacgctggcttgtggttcgcacgattaatgtttcacaaccgaaaatcgtgaaccggtccttaattgtcatgagcacgaccatcaaaaccatgtgctcacaacccaccattatcaagttttagttggcaaattaattaattaaccaatcacgatcaaccatcgtgagctatcattaagccatcattaaataatagtgaatcataagttatc

SEQ ID NO: 19337 - DNA, 1501 bp, Oryza sativa
ggtatgctaacagcactgtaaaattctgacgcaagcttagattgtaagctttaactgctttaatcatcctaattcaccccactgcgctagttgattattatttatagtcacaaaatatatatgcaatcgaacattgtcctaaactcctagtgaattattatttatggtcattgttcaaaggctggcaatatcttcattgcgttcttattatccgtatgcattccattcttttctcactagtcctccaggccagagcctgagcatatctactgataatgagacatgactgttgattctttcatggtactcctgataaaaatatatagtataatcatacaccctaggatctctcacttgtgggctgtctatttgactgatgttactagcctttgcagatgaaccattattgtagcagctgtgtctaagtctttcaggaagcagtaatataatataacgcttgttcttaaacatattgaaacggctttcatcttttcccatcagtatgtctttaaacacatctttaaccacagaatatgtcaaaatattgtcagctacctctgtatcgctgcacttaccatacatttaggactatttctagctctcttagaaggcccagcctaataagatgcgtagttgctttgttttttttttttttaatgttgggcaatggccataaggcgtggcatgcatcagtagttgcattttcctcttaagtccaacaactgtaacatgtgctccctcctgatataagcaattgggagccatgcctaagtatgaatgatttcattataagtttgagcaggcctaatcatgtcaatcatgcatattcatttaagacgaatatgaaaaatatccagttttgattacttacataggcatatgatgctttactgcagtgatgatactgaaatgttgctgtatccaagttcttacaagcattaattgacatattcagtctataaaaatagtgatccctatttcttttggcttcactattcatgctaggcattgatgtttttattttgctacctaaatccatacgaaatgacaggttgaactgctttcatgatgtccttttatatggttttttcaatatgttatatttttcattgcatttagcaaggtttatgtctatcttacaataaacatgtcaagacttctagtttcacgagattctgcttacaccctgtgctgaagttacaaatttatgtttctttgctatactgatctatttataatatgctattgcacaataaactaatcatcgatgtgcattttggttgaacaaatgcacataaacttatatcatggactacaatcaattgcaccatcctgcaccttgtgcaatcatatagagagcaacctggggcagagatactccatgtggttctcctgttctttttttttctcttgttgtaattccatttggccttaatttgagattttatcccatgcttatggatgcaggacatctggcgtcacatacattccttaatgccga

SEQ ID NO: 19338 - DNA, 1501 bp, Oryza sativa
atacaagtcaaagtgtgagtttgttatactcacaactcacgacggcatgtagctcctttcaaaaattaaaatcaaaagtgtgatgtatttgtagaagagacaacaactactttggagagttgagagatttcagtttctgctctctttggttgaggtctgggcctttgtgctgctctgtaaaattcaggcttgtaatcttatcttaaggaaaaagtacaccgaaagaacaagctgcaaccctgcacttcggcccatgctcttaattgtgttacatgggcccatttattggataaaatctgtcacttcacctaagctgcaagaatacagcccacgatgcatcacagccatgtaagagtctaatgggccgagaagcaaatgatccaagcaacccgggaccaaactaggcccgatctaactacttgggccatgaattcagccatgagggtcttaaaacgggccgtaatttctggaataaatcgtggaagcccatgaggggagcgggagggcaaactcgtaaatccggtgaactaaaaccctacaccaactagtatatatagcctctccaaccctcgctctcccactcttgtcatctcggcggcggcgcggcgcggagcagaggaggacgaagcagcaggcggcggcggcagagcacggcgacctagcccgacctcgcaaccatggtgagccccctaccccctctcctccgtcctatgcttctcccccccgcgcgctctctcgcgtctgcggatctggctgatctgtggcatccttctcgttcgtagcttcggtgggattagttccattccccgctctccctgagtgggagttcgtgtgcggcgcgtggcctgctaggatgtagtagcttagtagtcggcttggttattttgctcttggtccatgagatttctttgtgatgtgtaggattcgtatgttgagtagatagctttgtaccacgctacagcctgttaggatttaaacgcatgttatgttgaatttgtactcgctggctggcttcagattgtggatcagttcctagtggttatgtttcagcgttgcgcgagaatgaacagctatgcacaatgttgggcttctagtagtagagtctaggattggacattgcatccttggctgtcgcccatttgtgggatcttagacagctcgttattttcagtatgctttgtataattgtactgtcaatgctagtttgagggtttagctcgtgctgtttgctgcgttattgttcctctacatttctgttacgtgccaaggttcaacttgtatatctgcctggcttcaaggattataggttctggtgtctagattccttttttgttaagaattaacaaagattacttagaaaccatgccgcaccattgccatgagcgatgttagggctgttcataaccttgtgatttcattgtgtcattgtattcatgtcgtgctactctgcagttatgttgttatttgtgctgatcatttccttttcccttaccgtaatacc

SEQ ID NO: 19339 - DNA, 1501 bp, Oryza sativa
tacctgtgtgcccggtcgatcgatcttaagtgtaagataactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagggaaaaacaacatatgcccctagaggcacccggaccccccttatatatggggaggagtccgtgttacaaaagacaatctatatccctaacggaatatgcagatacatataaaatatagtcgtgaccgactaagtctcagggtatttccttgatgcacaagttgagaaacaaacccaagatacacataagatattctatctatattcggtatcctatattcagcccaaatatcatcgccgtgtagatatgggatatccataatctccacagtagcccccgagacctttgcagtcaaccatcatagcctgctcaaagataataatccgagtgcttcaaacttttcatgccaaggcctgccgagtagcgaaaacgaagactgtaaagggcgaaaagataaagaatatggtgcatcgaatagatgcacctaattaggtatagcctccaactatgtgattagttaacaaactaaacatatagttgagaacaaaataatagcataattatgcatcatatgacaaaagcatacacggcgcctaaagaggcattccagccgactgctttttagccataataaaagaaatccaagtggttaacactctaaaaagttcacgaatgaacacacttgacaggcatccgaatataagactctaaagattacccaccaaatattataaaaatcatggtaatgaataagtctaatagcctaggctatgactatttaccacaatgaaaacaggcatataacataccgaggaaatgactatgataaaaacaagtcattccaagttaacccagacagcttttgtagcctaaaaaaacgtacaaaaacagcataacgcctttctgtcgggcaccttttaatttgcattgcaataattccaaagaattatatgaccgcgtaaaaaggattttatcagcattgggcaacactattgtgtacataaattgccaaagcaaaaaatgcctaagtccctaaggaacacaatgggccacgctgttaaaagtattgggctgagatactattcaggcctaggcccattcgcacctccgatacccttaacaagaaaacccgagatccaagcgacacttcgtcttccccgccggaactctcgccattttccccactccttgctacagtacagagctacgccggcaaactagggttcaccattccactcaaatccaccttcaaaaagtgatcaaaatccttcccgtgatccaccgcctcaattcctcatctctcccaagccatccctcgaatcaaatcaacgtattcggggaaaatcaa

SEQ ID NO: 19340 - DNA, 1501 bp, Oryza sativa
agacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgatacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacttatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcccccagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaattataaataaaaaaaattctccatagtacttgcaggggaagctcgcgaatcataaaattccccaagatcggtacggttcctttttccctgtttttttgaaatttttccctcctcttgatttagtgtcgtgtcaatttgctagtggccaggttgtttattttatgtttgtgtgtcacaaagatgtttgcccaatttgatgcttgtttgcatatgcattcttgtgctttcccgaattgttaactactgtcaagtacaatcccaacttttatttattgatgtgaaggcctttaatagtactccctccatcctaaaacgttcgatgctattgactttttttttaaaaaaaatatttgaccgttcgtcttattaaaataatttaagtaattattaattattttcatatcatttaatttattgttaaatatatttttatgtatacatgtagttttacctattttataaaagtttttaataaaacgaacgatcgaaaacttatctgctaaccgcgcgggcacttctagtctagtaagcgaaagcccacgcgcgatgacccacgccgcccacg

SEQ ID NO: 19341 - DNA, 1501 bp, Oryza sativa
caattgctgctggcaattattagataacaggataacagatgattctatttatggtttcctattacaggggaagcagaggttactctatagcttacttgatgcaatgcaatctctcacctcacaagctgttgttattggtgtgagttgccgattggtatgaaatatatcctctcccatgtttctgcatcttagccgtttgtaatttgtgtgctagtacactgtcataagatcaccatctcccatgtttcagatgaccctcttaatcgtgtggtagttgatacacaatatgcattagtgcagtagcatgtcacatgcattgtggtaattaatgataccaacgctgtacttgggattgaagtggctaataactttagacattgatagttctacgaaaaatctactgtttcctttgtgagctgttttgtaatatcaattcatttttaggatgcagaccaactcctagagaaaagggttagatcccggttctctcataggaagcttctgtttgttccttcttcagtggatagtttacagaggttagccttgtgcatttttttttttcaggctaaaacattcactgtttctcaagatctctattcaatccatcttttgacatttgaatgattgcaggttaatggagcacttgctagcacttcctgaagattctcccttaccaacaaagtatgtcagggagtacaatgcacggattactgtatcctttgctcaatgtgacatgtcactttatgtgcttacaaaacctgcaggtcactgttcttgctttataatcctcacggcaatcatatttgaataggctgacaaatacccacagagtgttttgttaatgggcagtttttctgtttcttattccaagaatggatgctgaatgtgttcttttctatgctaaaaagaagccatggtggcaaactggcaatggcactgtttcttaggctaaatggaactgtatgtgatcatcccatcaagttctataatattgtttgtgttattgtgcaaaacaaaattgtaatccatataatcaactaggtaaggtagtgcagaaaattgcattaaaagcttgggatttccttgtatgctgctgaaagttcacattctcatgccactcattgtctcagtgacatgggcttggatccacctttgtcataacgacaatgagggattttagagttcaatgcaatataaggaactaatcccccccaaggtttatgttatcctatacacttcagagcattttcaatgacaaaaagttcaaaggaattctcagctccctcactgatgctgacgcaacaacaagccacatccttagatttctgtaagtatttcagcagcttcttttttttatcctcccttttcttcacatttccacactttttagtactcagttaaatataggagaacgaaaccttcagtttcagagtggtgtcatacatggacatagattctggacttctgtcaatgcaaagcttcatgaatgcgctatcttcga

SEQ ID NO: 19342 - DNA, 281 bp, Oryza sativa
gggtgcacccggtccaccgtggaccgtggggctgccgcgtgggccccactcccgtggacccggtccgcgcgcccctatcctcggctgacgcaataaaccttttttttaattaaaatttaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttat

SEQ ID NO: 19343 - DNA, 1501 bp, Oryza sativa
aatcgcagaaggatcgcaagaagcagatagaagcttacggtgatggatgggagccgaatgctgtggaagcgacggcggtctctgctgtcgagaagatgggcaggcgtcggcgtcatctgtgtttacatcgcctccatctgggctgggctgggctgcggtggagctcggggggtaccacctccgacgcactggcatctggcagtggcagatcaggtagtcaggtccccggcgggcctcccgagctggcactcaatgtgcatgcatttatctgtcaagtgtcaagtgtgtttataacatggtaaggattttcactttgagatgtttgcaaagaaattctggacaaaatacccacatgaatactatgaaattctttatcatatgcgggtaactcagcgtagaaaacgtcaggtacacctacaaaatgctctttaggctggtggagacttctcaatgcgcacgtaaaattgaacgataaaatagtacatagttaattaaatattaactaaaattaaaaaaatatattaatatggtttttttaaaggaaacttttctatagatttatttaaaaaatatatcgtttagtagtttaaataacatgcacgtagaaaaagagaaagtaaaagttaaagcgtgcacgtgaaaaataagagtagaagttaggaaaatgttcaaaagagggagtagaagttaggaaatttactcttgggtccatttttctctagcatattctttcgtataaattgacatcagacaatcatatctacttgaaggccactacaagtagagtagcaggcaagtaataaaaaagtataagggtaatattcatatataattagtaaaaataaataaaaatagatttttcacagttttttttaagatatatcaattataaaatattgataagattagaccattgtcatagtaagagaccatgattccttatcgaactcatgtgaagaggacatgaaagcattattcattgtcgtcgcatctacccttgcgatgccactccttcccttgtgtgcacctgacgtgactatgtgtgcgtctctgattgctctcaacttgctcacaccacccaagagttcgcaccgaggacgctcgtgaactcgcacaacattatgagtttgcacggtgaactcaaaaactcccacaatctcaaccgccgatgacatcacgaatttgtgtgttttggtggtatgaactcgtgcgcttctattgccatgtcaatgattgcgtatctttgcggatgcgatgaccgtataatgttactgttggttttgaaacgagtatatttctgtcacgccgataaaaaaaatatattttcactttttttcttttctataattgtcccgttttctttaagaaaaaaaaaggtaatgaaaggctaggtctcgtgttagtagaaaacgaaacatactggagggtatatatgcaaaatccacaatactggtttgtagcctgggagtctgggacgacttcgatttctgtcgcacatccg

SEQ ID NO: 19344 - DNA, 1501 bp, Oryza sativa
attctattgcctcaatgtatagttcatcactagattatttcctcaaatttcttcatgataatgagctttatcctgttttggatggtggcctaacattatttccttgctttttttgcagtcttttgtgctgttttggacgtatccttgatgctgtaaatattattgctattttcaattttccatatatacacaaaccatctagtatttcttattcagtataggtgtcaggcaaggtctgattcgattactagtataatggctcaccaccatagaaccatactaaagccacataactgagagtatgtaaatcattattatgtgaggccatagcatgaatttgaggtagaccattgtggttatacatttgaagatgccatataaattatataatgcatgccaatttttatgtttgagtttgtccttaacaatgaacagatttgcgtatgatattgtgcacatcttctgatgcacggcataaagaactcaactccgaagacttgaagggagctgtggggtttctccttgaactgaattaacgtgtaaccgcaccaaccctggaggactacattcgttggactgctgtcctgttttgttccttttttttccactccacatgtatcagttatagctctgtactttagaaagatgcaagcttattaagtttaatttacaaattgatgtagaagtgaatccaattgctggcaagtatggtgcttgatcttttgaacatcagaacttgctaggtaggggacaactggtcattgatacatctattgctgcccagcgtgctgatactatactccactagtagtatgttatattgttatcgttggagctctgaacttgcatattgttgatctgatatggcaaagtaaccactacgtggtgtttgctgaggaagttttcaactagcacttcgctatcaagacgtggatctttccagccccggcaaattccggtagctgcaagtcagagggcaacctcccattccggcatccagcaaaacgttgcccgtgggggccgcaggatacaccgcgcgccaagtcgttagcgttggtgtcaatttctttcttgcttgcttccaacatagtgttcccagttcaaagagattgcttttacggcttgcttggcaagaataattgggaagaggaatgaatacaagccattttttgttgggaggagcttccaacatagtgcttcccagttcaaagagatagcttttacggcttgtttgccaagaataattgggaagaggaatgaatacaagccatttttttgttgggaggaggaatgaaatgtttcttgggagttgggaggaggaatgactgtgagttaaggagatttgggtgttctgaattcacactctgctgcagacacgattaggagatcgtgcattgccaccatcgacgtctcactcgtaagagcatccgtgtcttatagcaccaggctagttagttgtgcggtggcgctgcggtgcacagaggctttgggggaagcagag

SEQ ID NO: 19345 - DNA, 1501 bp, Oryza sativa
aaactttaatttttagaaatataatactataattaattaaggatgtcctaagcattcaaaaagggataagattaaagctaatttccatgtcacctcaatctatttggtacaagaaaaaaatgagctctacttgatccatcttaatctggtctcctcaaaaatattaaatctaacatcctgatcgacaagaacatatattaaaattttgggcttggattgattcttctcaaagttgttgtgtgtggtatcatgtcaagggctttgtgcgatatggtagctggcaactgaaaactgtcaaattaatctatttagcttagttcagtgctgcaattgctcatcaaagagacatgtaaagtagtaattccatagaagaagaaaattataagggacatgtattttgcagaaattaagctccatttgctcatcaaagagacatgtaaaggagtaattccatagaagaagaaaattataagggacatgtattttgcagaaattaagctccatttcatgcttacacaccataaagaagtttatgttagtttttagtacatctggagtttacctgagaacagattgcaaaggttgtatatgtgatcagtgcactgtggtaaggaacagagttaggggtgggtgctgtggttcactgaccttattcaacaattactggtgaaccttgggaattttcgctaacatatataactgtcatgtcacttcatttatttttgaatatggtttgaggaatttcagaaaagttcaattgttattttaatttttcccattgttttagtgtttatggttattgtattttttcctgttgcaacgcacaaacactttgttaatcaaatattaagaggaatttgggcattctttgtttctttagcaaggtagatatggcgttgcttgtttgtatgccagctttgaacccaataaactcccatatgacaaagacaaaattattagtcttgtcaagtcttatcccagtgaattctcaagtatgtacattatgagacttcgtttcattttaataacttcgttgaggatatgcgaagtgacaagaggttcaaggcgtaaagattggtaaattcatttaataacttcactgagagagtctttttttaagattagtgattaccgattatgtgatcgagcgtttctgtgctatggaaaagcgccacagtgataaatgtgattaaatttcatcgtttgtgctatgtaaaacttgattctaactgtacttttcataaattaagacctttgttgtatttatgtgcatgaagactttgatttggcacttgaggcgtcagaacacaaagggtaaagatcctcggtttgccactggctggggtggatctggtgtgacgcagataccccaaagcactgagaagccattgaggaagctcactcttgaggacacgcgcccctttggctgcactagcacagatttcacaagaacagagaagagtgaggagagcaatggaacaagaagcagcaacagctttgg

SEQ ID NO: 19346 - DNA, 291 bp, Oryza sativa
ccgtccccctctcctcctagagggtcttgtatttatacccattgtgttcccttttccaagtagaactagggaaaccaatatggatacaatctgagtaatccttgtcgtttccatgtagaactctatttatctttccttatgtggaactccttctatatccgaaggttgttttcatataagatatgatatgtggtgggtcctgccgaaatttagtcaactactatttgatatgtggtattcataactctgacagacttataatatgaaagggatgagtagttattaacgaca

SEQ ID NO: 19347 - DNA, 406 bp, Oryza sativa
atgttgagtataatatattagccattgacttggtaattcatctgatcccaccaaaaatgatgtgcagaacatggaggagcttacaccaccaaacatggaagagcttgcaccaacaccttcaacaaagcaagagggaaatgccagggatgagactcctagaagcactgtcgctttaaatggtgggttcctgcagaattcagtcggccaggacttagtccatcttggtgtggcgagaactagttcaggctttctagggggaggtaccagtacaagtacaggatccctgcgctgcaaaatggatcttgatcctgcatccagcagtatggaccatttcaaaacaccagatagaaaagaaagtggtcttcaggatgatgagaaaggagacactcacatgtatgatgagaga

SEQ ID NO: 19348 - DNA, 1501 bp, Oryza sativa
ctcacctacgtggctacgtctactcaactagggagggtttatgttaccatgcagacatctacgtctcactacgatatgattagagaagatgtggtaaaatcacttaaatatatgattagagatgtgataaaaaaacttaatatgctctgtagcttacctcgcttctaattaagttgtattcccttgttcgcactgaataaggcgtgcacatattttaagattcaacactttaatgtttcaccaataattattttattatactaaattttatttgatgaaaatagtattattagattaacttttgcatttaggctgtgtttgaatctcctgaagatgaagatggagattaagtgttttacgtaaaacgaggtggtaatagcttatgattaattgagttttaattattacaaacttgaaaaatggattaatctaatattttagaacaactttcatatagaaaattttcatacgaaacgcaccgtttagcattttgaaaaagcgtgccacgaaaatccaaaactttatctccccctctgttgggttctggaacagggccttactttcatatgattatgattttgttgctacaaacattatagtatatgagcaatttaaagtcaaatattagttttggagaccgcactaagtttgattgtgccttagtgggatgaagggagtaactagcaggtgcagagtctggaatttatcaaaagtggggatgaaacatatagtttataaactttttatgtaattctaactaaattttagtttttttaaaaagaaacattatcacatatgacagtatatgagtctaataaaccaagacatggcatgttaacttgaatggcagggtgggatcaaactcaatatataatgggtaacacatccgccaaaaggcaaccgagacatgggcattcatatttacagttttacactgaaagtgaaaggttccttagtattatgcacaataaatcaattgccttaaaacatgatgtagtatgatgttatcatctgaaacattcctacattcagataaagtatgatcaatccgatcaaccggataaaacaagataaaaaccatcaatatttcctattagcttggtctatcggaaataattctatttttaatttatgttcaagagcacaccatatgcacctcagtcatacaatcctttttgagcttgttgttttcttctatgtagagataagttcaaactgatcatgcataaaccttgaagacaaaatcaatgcccataagggaggatttcagcaattcaccaaaatgcagaaacatagtacattccattatgggggcaatcaaacatgatttattgattaggactaaggtaaataaacaaaaataaaatgaagagttgcatcaccgccatgatcaatacagcaagaccatgctcatggcactctggtttttatgcgttctgcaactcacactcaatgttggctctattatcttcatctttatgaatctaccttaaatagtttt

SEQ ID NO: 19349 - DNA, 295 bp, Oryza sativa
accagtgcacaaaatgcaattttgtgcctacattttcttgctgactaatacatgacctctacaaagtgcagaatagagttatagaagtgcaggtgttcagttaaatactgtggtacgagactacgagttaacgggttgtcttatctaattgtgctttcaactgaattctggaactgggagtagcctgggacagagttcattgtatatggcatcatgtggcctttgaacccatgacccatgtgtgtcaagcttattagcgtgcccaaactgttacgccattcatgctttctttcca

SEQ ID NO: 19350 - DNA, 1501 bp, Oryza sativa
tatatagtggcatcatacagctaactttgcacacatgatgtgtttatgtcgtaccagtgatatataggagtgctagttttaggcatgattgaaataatatgggttagttataccgcaaaagatcattattaaatgtgataaaatattggagaaaaacaagagggttgcttactaaactgttaaatctgtttcttatcaatagtcatgtggcttacaaatcaatgttatagatgaatgtatactatatattgaatgaggcacaaattttttatttgagcctgtttatttgagaaggaaaactagagatgatggttaaagataggaagacagagaaatcaatgttatagatgaatgtatactatatatattgaatgaggcacaaattttttatttgagcctgttgatttgagaaggaaaactagagatgatggttaaagataggaagacaaagaatgattcgattgagaaataataacatgtaaaacatgtgctaaattatatatcaatttgacacaagatttaatttggttgatgaacacaaattacatatcaatttgatacaagatttaatttggttgatgaacgcagtagattagccactctttaatgatgtatgactgtctactcataaatatgttttgcagtcataaaaaatcaaattccttatagtgtgagtaaccagatttgatatattcatttgagaatgaagctttggctgagaaattataacctcataatattcaactgtataattttacctgttgatatatgttgattggtctgcatgttctgccccacaagtactgcatcaaactttcagttgatgaaactaatcaatggaaggggcataggtttggaaaatatgattgcgctggagtgattcttaatttgattattagccccgttcttttctgcttatttactgaattatttccacgtattatatgctctacgattctaaaaatatgattcataaggaaaaaattaagaccattttaccttgtatttcaaaaccagttatttaactccatatactatacaaattatagcaaacgatcgattccctcaaggtagcgattctaaaaatatgattcataaggaaaaaaaaattaagaccattttaccttgtatttcgaaaccagttatttaactccatatactatacaaattagagcaaacgatcgatcccctcaaggtagtattcaatttgtggttaatgtgccatatcatatcctactcttttgtgatctagctatcattcttgaagaatgatgacgatggcttgaatcttaaaaaacataccataacaatctgtggacagtcatagacagcgttggaacgattatgttttactgagtatgcgtatgttgacagaaaacacgaggcctgggagatctgcttaactccagtgcaggtccaaaactcgccttcggatgtatgagcgtaccagttaatttgatcctgcaatcaacaagaaatagaacaaagaaaccgcaattaa

SEQ ID NO: 19351 - DNA, 853 bp, Oryza sativa
attcctgcagccccccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgatacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacttatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggaga

SEQ ID NO: 19352 - DNA, 1501 bp, Oryza sativa
ccgttcggatgaacaagaaaaatctgcaggtgttattaaactcaatcagatagactcatgatgcaacaaacctgaataattaaaaaaaaagttgacattgacctggatctgacactgacctggatttggggccaaatggggaatcaacctatgagaagtggctaagaaaaggaccgtgcttgccgttgacccgctgtcgtcagcctcggcccgtcgccggcctgccgcggccgatcccctcgcgggctcaccgccgccgctgctgagaacgcgccgctggccgtcggtgtgcgccgtggcagtgatgtgcgagtgcgtgagaagaaaatgagatgcggtgtgggaacaagatggggcggcgctctcgtgcgtgttgggtgaggtgagagacacgagaggagaggagagaaagtgggagactaaggttgcctgctaaagtgctaatttcacagatcgtattttagttgttatgatataaacacctaaagaaatcatttaataagaaatgtgattagctcagttggttgggttgcgcacattctatccttgagacccaggttcgaatcctctgtttgcatctttgcccccctaatttattcctatcaggtatcagcagctcgctcaattattattattttttaaaaagcatgcttagtccaaaagttttaacaggaaaaaaaagcaactcacttgataatttcttttaaaaaacagttcgctagaggtccgaaatgaaaaataaatatctcactcgattattttaaaaaatacaataagttcgcttattccaaaagtttttacagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgactgtctccacggaagaactagatggctacctcagctctcccggcgtcgactcccgtcaaccaaccgagattctcgactatgacgacttcggctacaactatgacttcaacaacttcgacgaccttgatgaagactacgaagacaactacactcctctctttttggcgtctttatggccgacaacgagacagaagaacaacgtctggcacgcgaggccgatgagctgtgcacatgataggaagccaagcgccgccggttggaacaagagcggcaaacccaagagcaagcccgactgctgcatgagcagcaggagcccgagcgattgacatgggaagctgaggagcgacgacagcgtgctttggaatcagggcatcgagcgtgagctaatcagacaacaagacatcgaaggcacatcagtttttcgcaccccacagcagaatgcggttgcggcgattacaattttggataccctccttgtcgacgg

SEQ ID NO: 19353 - DNA, 1484 bp, Oryza sativa
cagtgacccgagtactatattagcaagctgatcacataactgctacatgcatgatgatactacatacatgcactgattaacacatactagtaacctttgagataatttatttttatttatttgattgtcattttgattatatggttgtattcgttataattaaatctttacaacaagatctcagaaggttatattttgattgaaaaattatatatgttttaatcgttaagatttaatgtttcacgtgttagaaataaatgttccatctagaatttgattatgttgcacattttaagttttttatctgatagatgttgttttactgttgcacacgggatcaataaatatattatgatgtttcattacttatttgtggatgttgcacatcgtattatttgaatgtttcatcaagtatattgtgtgcaacagttacaaaaaattagtgaaacataagaaaatatctattaaaacatctaaataatactgtgatcgacattttgttgcaacggtaaacttaaaatttgtaatacaaagtgaaattccatttgaaacgtttatttctcacacatgaaaatctaattgcacatgctgaaaaacacacacacacacacattatttttttcatcggatcatgtgagatcttattacggtgatcttcctataacatagaaaaacaccacatgcaatattacaaataagtatctgaaacatcaaccaatatttattgaaacattccaataacaccgtgtgcaacactaaaaaggtcatcagaatacaatgatgtgggatattgttccgaagatttgattataatgaatccaactacataatttattcatagtttggataaataggtggaggaaagaaacatttgaattctccaccattatgaacagttttactaaatctgagtgcatgcacggatgcacctacaccaattgatgtgtacgttcgatttcttccttccacctggatggctgatgtgaagcatttttccgattttgttaacacagtaagtaggagtactccattggaacatgacgcataatactactctacttaatccgtaatatgcggaccatatatatacatatgcctatactatactccctccgttaaaaaaaagccaacctctctcgtaggttagcttttgtttttttacggaggaagtgcatatgtagagtgggtatgcaacagggtttatgttaccgtcggtaaccgcgcggttaccgcttttaccatgggggtatggtaatagaaaataccgcggtaatctcctttaattcaaataaatttaaaaaataatttaaatttttaataaattttacacggttatcacgtgctgcgcggtaaccctagcccggcggtttggaaaacctggtatgaacaagccgtgacgacgtgagtgaagcgtggcgtggattggataagggaggagaaacaataactccctcctcctcctcctcctgctcctagtactagta

SEQ ID NO: 19354 - DNA, 1501 bp, Oryza sativa
catggcgccgtgaagaaacatgacgccgagagcgatttgcgtcgtcccgtgtgcgccgtgcttctcggcggttgttaatttgatctcgaagatcgctagtgccacgaggtggaggggtagcctgtcgaggcaattccctccgctccggatcttcaccattggcgtcgccggttggtggctgatcttggtgtgctgcggtagcggcctcttcgaacgcattgctgaggttggtcaccgactcccgtaatcgttctgtccaacgctcgaggtcgtcgttcagaacaggatcgtaaggagtttccctcagtatagcttgaatagccctgatgtgctgggccggagtagtcgattgattcgccgcttctgcgttggcttgtgctgatgtgccaacgtcatcgataactaatacttcccatggcgcacttgttgttgatgacccgtagtcttcgaggagatgtaagaccgatggttcgtgaggatcgagatcgattaccccaacgaatcgatctgaggctggagtcgctccctgttccttgccgttatccctagcggggacgtatgacttaggagacagggttttcatggcgccgaggaggactttgcagctcgagagatcgtgattctttgtcttgtggataggacaatagacatcccgagttggagaaatacactgaattccacgttccttgtaggcgcgaatttcagcacggacgttgatgaatacccagcaatcttgaagggtatgtttcttggttttgtggataggacaccagaagtcatctttgtcggcccgtgatttatgtcggagggacaagatttggccgcatcagaatccgtctcgagtttggatgtagtcggtaatccgttctccgtttcaacgggtggatttttcgacatggagccgtcttggttcgtagccactacgttctcgttttcagtcattggaggaccggttgagatcggcgtcatggtgtaaaccgggaagacgatttcgccgacatgagtccataccagcattgttgaagttgagagtgcttggctggagctggtgttgatgttgttgtcgacgaagcttgatggcatagtagtagaaccttgagtaccaagtccccctacctggcgcgccactgtcgacgggtgatacccgtagaccggatatagagggtattggggtacgctggtacaaggatctacgtaatacgacatcgagcaatcaaaagacaagaattatactggtttaggccccttgacaggtaatagccctaatccaattgatgtgggattatacggtggaaaacataggttacaaaggaaaggatggaacttgtcagatccggcgagattgtagtcgagctcattcgactagctcttgacgacttggctcctcgcaggctctgacttcgtaggctgtgtgggttatgttggcactgagattcgatgatctatgccctccctggggggtcccttttatatcgcaggtctggtgctctccgagtgggac

SEQ ID NO: 19355 - DNA, 1501 bp, Oryza sativa
tattgtcacaatctctattcgggtacttgtcaagtatcgcgacgcatggttgacatgatgttgaggttgtgtcttgtgggtacagtggtacacctctgatcagagtttaaactattcgaatagccgtgcccgcggttatgggcgggtctaacaatgtctttcgtgattagtctcacacttctcactatattaaatgatgatgttaataacttgtttagctcctggtttggaatggtatattcctggtttggagatagaactgtgcagccgggattggttgttcagaatggttgggcctatgcaacacgggtgtattgtatagtgttgatttaatattgtttaattactcaactgttttactattctctcaattgcttattaaatgctgtttatgcaaatgagcccatattatgccatccttcgttatccattgcacttgcatatttgttgcgtggcttgctgagtatgtcatatactcaccttgcagtcattcatcagaggaggagttctacagtgatgctgatggtgtggatgattaggcgtagccctggtcaagctgcctgtggagaggagtcgcctgtgctgtttcttttattttccgctgcttagaactttgttgtttgagaggaactatctacctctgtaatgactttatattcgcttattaattagagtaataattgtactctattatcaatttgttattgtgtgcctcggctgatttctggacgagggtttacacacatgtaagcgtttggaattttggatagaaattccgggcgtgacactgaccgagtggtccacccagggtggtaccccctggtactagacctagtggttcgcaacatcaaacttcggttatccctcatcgatggtggcagtgcactcaatattctttttgccaagactctggacgagatgcaaatcccacgaaccgagttgaaaccgagtggtgcgcccttccatggagtcatcccggggttgtcttcaaccccactcggccagatcaccttgccagttacttttggcactcgggagaacttccgtacagagaacgtttgtttcgaagttgctgactttgagacagcgtaccatgctatacttggacgcccggcgttagccaaatttatggttgtcccacactacacctacttgatgatgaatatgccagggcctcgtggagtcatatctttgcgaagcgacatcaagaaagctgtcacctacgacaaggaaagctgcgagatggcccagactcatgagattacacttgcccatgaatcaatccgactggctgcatcaactacgaccgaaggagtagtgcctgcaactaacatgccaaagaccgaagaaggcgatgtcaaaactaagaagattcctcttgatccatccgatctctccaaaactactgtaatagacgcagagttagattgtaaataggaaagcacgctcatcacctttcttcaagctaataaagatatttttgcatggaaaccatctgata

SEQ ID NO: 19356 - DNA, 1501 bp, Oryza sativa
ccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcggggg

SEQ ID NO: 19357 - DNA, 1501 bp, Oryza sativa
cttagctttgaaggcaaaggaagaagaagaagagaatcgcaagagcaagagcaaggcggagatcgatgatgaagagatggctcccttcgtcaagaagttcggcaagttcatgaggcgaagcggcttcttcaagggaggatcttccaagcactactccaacaagtcaagtggaagacactccgcaagagtgtgctacgtgtgcaaagagcccgggcacttcattgcggattgcccccacctcaaggatggttcccacatcaaggaagataagaagaaggatgagaagaaggagaagcacaagcatagcaagagggaacattatggccaagctcaccttgggatgatcttcggctccgactccgagtcaagctcaagtgatgaagaaggagtcgccacgtttgccgtcaagccctcatcaccaccgagactcttcgactactcaagtgatgaggatgctccggtttgtctcatggcaaaggagcctaaggtaccttctcttcttaagtcatttaatgttgatcttgttagtgatgaggaggatgaggttgaggatgaggttatagatgacgaattgttcaagtccataactaaggaatccctaccacacttgagtgagttgcttgagagaattgaggaccaatatgcaactcttgagaggcaagagactttgctcattcgtgagaaagagcggtctcatgaactcaagagtgagcttgctaaggagagagagaaaaatgaggcattggtacggctttacaagcaaatcaaagagtctcatgctaatcttgaggtggcgaacgctcaactttaagagagagtggatggcttggacaaagcatacctcactcttgaagagaacttcgtaaccttaaagaatagtgtctctctccctagcgagccatcttgttccaaaattgtcccaagcaatgaaccatgtgtgagatgcaatgatattgatattgaagcttgtgctactaactctatttccttgagtgctttgcaaaagaaaaatgagaagcttatgggactccttcacaatggcctacttaagtgccatatgggtagtaaggccctaaaggagtacctaggctatcaaaagggacaacttcaaccatgagggtcttgggtatgtttctccaccaaaaggaaaggtggacaagagtgtgatgatcaagaggccccaaggtcttagcaattttgttaaggccaaaagtatccttcctaatgattatgcttcatattgttcttttgatgtatcttatgttcttaggaagaatgctagtggtcgtgttgttgctaagtatgtaggcccaaggggcaagaatatttctatcaagagagtactttgggtgcctaaggcacttgttactaacatgagaggacccaagcaagtatgggtacctaaaattagaaattgatctcttgtaggaatatgtctccggtggaagaagttgggtaattgatagtggatgcacaaatcacatgaccagagaagaatcaa

SEQ ID NO: 19358 - DNA, 1501 bp, Oryza sativa
atccgccccacatccttttttgtcattgtattattatcattttttttcttcataattttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccagagggtttttttttataggaggaggacgcttgtaaatctgcttgataagatagaaaaatctaggccacccttataccagtattttgggggttttttttataggaggaggacacttgtaaatctgcttgataagatagaaaaatctagaccacccttataccagtattttgcgggtagcctttcctcagtaaaaataataatatattttcaaagggcaaaagggctccgtctgacatgaacaccctcttttttaggctgctattagacggagccaacagtcatctgccagataaaaaaaaaagtcctctcaaagtgcatgaggcgtctagatctgtaaatttacaaaacgaatttttaaaatattaaatgaaagaaattaaaaattagaaaaaaaatggtgaggtgaggaggtaggcaagtcaagtcgaaaaacatgatgatgacgactgctaattcggcccaacaagtagtcccctcccctccctcgacgagagaagacaagacaagtcgcgacctgacgacccgaccttcctcttctctcccgctgccctccgccgccgacccgcaggggatcgtggggacgatcgatcgaggaggagagacccaaaccctagccacccaggcgccactcccattgcccccttcgccagccagcca

SEQ ID NO: 19359 - DNA, 1501 bp, Oryza sativa
tccaaaatgaagatcattgcggaaatagagtaagagtcggctgcagtccaaatcggctaaggtcaggtcggcagagttcgagtcggatggggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgtatcgccaccctttttgctttacttttatttcgacgagttcgtactctcgggttgagctgcatcggtttcgatcttcaacaagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattgttcttcttttcatacttaatgctgcatcaattgagtttgatctattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcacatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgatttaagtatatatcgatataaggattatatatcattaatatctacagccgattgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaatcaactagcacgctcatacatccgaacgcgagttttggacctgcactggagttaagcagatctcccaggcctcgtgttttctgtcaacacgcttttggcacgcccggtgggacgaattagaagtcagaaatcaatcttcctca

SEQ ID NO: 19360 - DNA, 1501 bp, Oryza sativa
tttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgta

SEQ ID NO: 19361 - DNA, 1501 bp, Oryza sativa
ctatgtaaaaaagggacgacatccaatacaatctcggcgcatcgccaccctttttgctttacttttatttcgatgagttcgtactctcgggttgagctgcatcggtttcgatcttcaataagaggtaaaacttgtcatgacgacttatgttctcaggattagtgcttccatctttattatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattatttttcttttcatacttaatgctgcatcagttgagtttgatatattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcgcatctaagtatattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgattcaagtatatatcgatataaggattatatatcattaatatctacagccgatcgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaattaactggtacgctcatacatccgaaggcgagttttggacctgcactggagttaagcagatctcccaggcctcgtgttttctgtcaacatacgcatactcagtaaaacataatcgttccaacgctgtctatgactgtccacagattgttatggtatgttttttaagattcaagccatcgtcatcattcttcaagaatgatagctagatcacaaaagagtaggatatgatatggcacattaaccacaaattgaatactaccttgaggggatcgatcgtttgctctaatttgtatagtatatggagttaaataactggtttcgaaatacaaggtaaaatggtcttaatttttttttccttatgaatcatatttttagaatcgctaccttgagggaatcgatcgtttgctataatttgtatagtatatggagttaaataactggttttgaaatacaaggtaaaatggtcttaattttttccttatgaatcatatttttagaatcgt

SEQ ID NO: 19362 - DNA, 1501 bp, Oryza sativa
acatctgtgtcaggaaagaagattggatcaaagcgaagtcggaggcgaagatcgagttcggaaacagagtaggaatcggctggagtccagatcggctatgattaggatcggctgggtctgagtcgggctaggtaagccgatacagccgattccgacaatacgacttgtgtacgacatcgggttcaagttaatgtgcttcaagatgattgccacgcatggatagagtcctgggaaggcaattgtatctattaattaagatattttatgtagattccttatagataaatgtgggcaaaagtctgccgcaaagacttatggtatcttagagtttgtaagagataatagtcatgtccggtatgggcatatcttgtaattctcgggtataaatagaccctgagccctatgtaattgataacacacacgttcaatacaatttcggcgcatcgccaccctttttgctttagttttgtttcgacgagttcttgcttttgggttgagctgcatcggtttcgatcttcaacaagaggtaaaacttgttatgatgacttgtattctcgggattagtgcttccatctttatgatactctaatcttatttatataattcgtcgagttatcatatatcttacataatctctagcaatatcgccatctaacctactatcggttaacatctgttagcagagggcaaccgattaggttagattttgacgttgatctagattatataagatatctaccactctatgaaacttctagcggcttgattgtctagatatcgttcttcatttcatacttaatgttgtatcagttaagtttgatctgttaagtcgtgcttagaatatcgatctctagcctgccttctagttgccgattagaatagcatcggagtttcagccgatcttatccgatttaactatatttgttatatatgctttattgacatgttaaatctgctctttatatcaagatattgttgtatctaagtatgttaggcctttgtttgatatattatacatgctttaatatcctgatatagagtagtatcagagtattagccgatacatgttagatctatttgatcggctacgctataaacatatatagtcctgttattgatatatatttcaatctaagtgatttatactgtctcggcatggtgactgatctatcccaatcatttgatttaagtatatatcgatataaggagtatatatcgttaatatctacagccgatcgagtagatttagttcttctttacttattcatgtctgccgatcgatacacagatgacatcggctcaaaggtaaatgatatgtcatcggcatctagccgatcggctatcatttatagatttaaccacggtttctttgcttctatttcttgttgattacaggatcaaatcaactggcacgctaacacacctgaaggtgagctttggacctgcactggagttaagcagatctcccgggccacgtgttttctgtcaacacttttgtaaa

SEQ ID NO: 19363 - DNA, 1501 bp, Oryza sativa
aacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaactgtaatggttccatcttctgccttcgccatatgatggtgcttgctactactcaccggcgacgacgcgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgtagaacaaaatcttcttcctcacaaatccgaaagataattgtggtcctcattttctgtcctccatcaccgtcaacttaaatagagtatcaatacagcagcctccacactaactactctcctggtcgctcggtcgtgcatgcgtgcgggtaacaaaccatgcatgcagaacattcaaaatgactcaccatgcagaacacagcgcagtgatccgaattttcaaaaaaaaaagaatattcaagtttctgcatcgctggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatatatatatatatattaaatttgtttggtgctccatggtgcccgggcaccattgttgaaattgagtatatacccaattcaaatgagtatgaaactttttcaaatatttaggtattaacattaacaactttactaactagttcaaagcaagtttgaactgaatttaaacttgtttttgttatattagattttgattctatgtatatagcatccaaacatataattagttaggtatgtaattatggattgtgagataaagttaaatttgagttgttttgttgataggtgtaggtataaatcaaattcttataacttggtatatactaataatttgaaaattttgaaaaagttgagtgattttatgcatttgataccatggtgcccatatatggtttcgcggacaagttgaggtaccttaggtgtactttttccttctgtctccaccctcatccagcgatccaaagcccaacacagcaatcgagggtttcggcctcgtcgtccccgccgccggcgacaagcgacggcgagcgagccagcgaccttctccctcgcgcgccgcgccgcttctccctcggcgcgccgtgccgccggtgacgtctccgtgatccaggtgaggacccgtccattgccccccctcgctcatcatcatccacggcctcgactccaccgttcgccaacggcgtgacgctaacccccctagatgtggcggtggccgggtgc

SEQ ID NO: 19364 - DNA, 1501 bp, Oryza sativa
cagccatgctaacatgagatgttctccagcaaacatgacagtggccaaggctagcaaaaatgacagtggccaatgctagcaaacatgacagtggccaagactgcattactcatgccctacgtgcaacacatgagcacctacatggaaacacttcttggggcatatacatcgtacataatcttttctatctagtacattttgagttacaactgagcaaattaaatagtgaacaaaaaatgattatttattatcttgaaggatgaagtctgagaaaagatgtttgcatatggtcgtctggtgcccataaacaccactaggtggtgaggattatcgagttgatcctcgctgcatgaacaacaatctttagatccattgttgcatgttaattgcttgttgtcaatattaataataatattggagcctaacattgagaaaaaaaaaagaaaacaatggagaaaaagatgatatgaagaaaacaaaaaggataaaaataaagaagaggaagatattagtaaaaaaaaagagagtgactccttgtcgagagataatgcattatcaacgaaacaaatatagtttgactttttttgtttttttccttacacagttatattatcagtaaaaatatgtgatgtattcatatgcatattgtgaacaaaaaaatgaaatatatttaatgcgggttgtgtccatagtggctgctaggctacaacatggcgccaacaagtatctaaaaaaaataggtaaacaaacaacaatatatactcatgtttcgacaagtaatgtttattgtgagggcgcggggtgctaggcccccttgtcaaggcagacgggcagacgggtggagctagaccgttgtctggtgctaattcgtcattcaggtgtcgtgcggttgttagctgccattaaacccaatttcgaccactaattaccccaaatagaaaaaataataatatcggtgaagaaaacaaaagggaaaaaaaataagaagaggcagatagtaaaaaaaaaagtggtgactgcttatagagagataatgcattatgaacaaaaacaaatatagtttgactcctttcaaaaaaaatatagtttcaccccttttttccttacataattatattattagtagaaatatgtgatgtgttcatatgcatattgccaacagaaaatgaaatatacatacctaatgtgggttgtgttgctaggctataagatgacaccaacaagtattctgaaaaaataaggacaacaaacaacattgtatactcatttttggataagtatgttcattgtgagtgcaggggagtgggggaggggggcataggcccccttggcaaagcagacgggtggagctacaccattgtctggtcgtagatataccacgaagagagggtgtggtggtgttctagtggaatactaatccgtcattcaggtgccgtgtgttgttagctgccaattaaaccccaatcactaattacccctccaatcctcaacataaggataa

SEQ ID NO: 19365 - DNA, 203 bp, Oryza sativa
gcccaaaaagaaaaggataagatattccgatgcttgtatacgaagctctaaagactaaaggaaaccagcatgtcagcaagatgttggttcagtctaaaattttgatgcaagattgctagcgccatcaggtatggcatatgctgaatgatcaatcatgaagagcgttggcccatgcatgctattgcatgtttatgtgctttagc

SEQ ID NO: 19366 - DNA, 1501 bp, Oryza sativa
aaaatcatcatgtaaagacgtgtgtgggtttggtttgtgctcgtaaaacggcaggattagtacttagtgggcactaagcatgtggtccattgcatcgttagccactaactaatgatatactgttagtgttagtaactcgggaatggatcgaaagggtttgtgtttacctgtgtctgtttggctccagttgggagtgggctggtggtgctgctcatcagacgcagcacgtgggtcagtggaggggagcacgtggattcagagatctgagcttttgtttttcttcgctagattatcgtattcgtctatagctatagcagctgtgtttgcgatgattagttagggtatgtttagttcacttgtttgattaaaattggaacaatataatgaaaaagttaaatgtttctgtgtaagtgacgaaaaaattagaagttttaaaaaaaaatttaaaactaaactcggccttagctatagtggtggtatggtcgagacatgggaatgggagttccaagcaatgctagctcatggagacagtagctcgtgcagctcgcccttgtatacaaaacagtttgctgcttttggctaaccacttgctctgacataccgtgtgtgtaccacaccacagtccatgttactgtcgcctctgccgtgtagcgcgaatcctcctcgtcgggcgcatgatgggtgagaaaaaaaataactgacgatgtttcattatatataaatcaaatattacagtagatttttatactatttaataattttatcttgatggacatatgatttgtttttttatgtatataggatttaagtgttgcaatgactttaaacgtttgttgcatatattgaaccaaattatttcatctagcgatctgaccgttttttgctttttttaagaattgaaatattctttcgctatttactgaaacattgtttttatataaggtgaaacaacgtccgattttttggaaaccgttgcttcatatattgtagcaaaatgttttataaagtgatttggttgtgtttcagctttttaaaagattaaaacatttttaatctattaactaaaaatttttcgatctacttaacgaaacaacgtccaattttttttttgaaaaaagaatcgggcgcccaattcgcctccgccgtgttgggtttgcctccagcgaagcacaactaaagtgtgtgatgggccgatcggttgatgggccatcatccaccactttggtcgatgggttaatgggtcgcctaatcaactcccgggccatcaaaattgcggcccatgaatcgcaaggtcggcgaccgcgaaaatatcacatcacacacacacgcaaacgcaagtggcttggggctccagaaagttgtgtaaaataataaagaggccgacgcggaatacgcgcagtcagctccgtgccgaaaccctcctcctcttcctctctgcctttcttccgctccacgccgccctccgccgccgccgccatggctgatccgcggctgttctcgt

SEQ ID NO: 19367 - DNA, 344 bp, Oryza sativa
aattcctcattagttataccgcatatagctaaccacgaaattttgaggttttaacgcaggacggaagtagatctcgattgaaatttcaaaggtattcgagaatgcaaatttaaaatagtactccgtgctcgccatttcagtttgctcatggagttaatccatcactgcacatgtgtctcgggagtactacgcgccgttgcccggccaatgcattgcaccattgctccgcgtgcgcagcaacagatcatcgagtagatcaattgctccttcctattcttctacaagacaaactcttctccgcttcgctccatcctaataaccacagcaatacgtttccaatgcca

SEQ ID NO: 19368 - DNA, 1501 bp, Oryza sativa
cgattacatgtaacataacgctaaaatataatgtcgagaagaaaacccttctccaataataaattaaccaggagagcaaaacgaagaaatgacattccttttggcgaccaattgattcgaccatttcttatcacagcagagagaataccgtgcggacgaatcagagggcaggcacatatctcttcgccgcctgcttgcctgccatggcggcgccggcgaggaccccaccgatggcgcccgcgacggcggcggagcgcggcccgttggcggcgcggaagagcgcgccggtgccgagccccgcggtgacgctgttgatccagtcgtcgcggtcgcggacggcgaccatgccgctctcgatcccggcgtagagcaggccgatgaccccgagcgtgttccccatgcggcggccgttgctgccgcacgagttgaggacgcggttcgcccggatcttggcggtgtccccgggctcggcgttgcgcgcggcgtcgcggaggccgacggcggcgccggcgacggcgcccgagagggtagcctatgccggtgtagtaggtgaggttctcgccccaggagcggcgctgggcgagcgactcctcctggaagaggaactccggggaggtggggaggtcgtagagctgcttgtaggggatattcaggtcctggtaggggttgtacagccgcctgccggaggcgtccgtccggtcgtcgcgggtgccggatcccgacgagaacagccgcggatcagccatggcggcggcggcggagggcggcgtggagcggaagaaaggcagagaggaagaggaggagggtttcggcacggagctgactgcgcgtattccgcgtcggcctctttattattttacacaactttctggagccccaagccacttgcgtttgcgtgtgtgtgtgatgtgatattttcgcggtcgccgaccttgcgattcatgggccgcaattttgatggcccgggagttgattaggcgacccattaacccatcgaccaaagtggtggatgatggcccatcaaccgatcggcccatcacacactttagttgtgcttcgctggaggcaaacccaacacggcggaggcgaattgggcgcccgattcttttttcaaaaaaaaaattggacgttgtttcgttaagtagatcgaaaaatttttagttaatagattaaaaatgttttaatcttttaaaaagctgaaacacaaccaaatcactttataaaacattttgctacaatatatgaagcaacggtttccaaaaaatcggacgttgtttcaccttatataaaaacaatgtttcagtaaatagcgaaagaatatttcaattcttaaaaaaagcaaaaaacggtcagatcgctagatgaaataatttggttcaatatatgcaacaaacgtttaaagtcattgcaacacttaaatcctatatacataaaaaaacaaatcatatgtccatcaagataaaattattaaatagtataaaaatctactgtaatatttgat

SEQ ID NO: 19369 - DNA, 162 bp, Oryza sativa
ttagttccgtcgacgacggctagaaaaattgatgtttcagtaggattcgaagtatataatttcatccatatgaaagtttaatatttgtctgtgggcgtataaattttatgaagcaaatacatgtataaatcaaggtccgagtccctgttgtattttcacagg

SEQ ID NO: 19370 - DNA, 1501 bp, Oryza sativa
aaacttaaaatgctgagagttttgtaacaatacatatgcattgtgtttagttctgtctgttgcccccctgtttccggaaatctatggacgtgctgctgcatatatgtttgatgggtgtaaattattttgtgctgactgatgaacggatttgtgataattattcgagggtacaggtgattgaatcaactatcacaaaactgaaaaaacaaataaatttacatatacaaagttttcataaatatcatatcgtttcagatcttgaaagtttagatgagttgccatcagtgtttcctgttcatttatctgtggtttttacttgagattttacttggattacagtcgttcatagcagttactctctccgttccattttaaatgcaaacatgagtttccgcgctgaactttagtcgtctgtcttatttgaaatttgttgtaattagtatttttattgttataaaatgataaaacatgaataatactttatgcgtgacttatgtttttaatttttttaaaaaatttatcaaataagacgaaagatcaaattggagtacatggagggagtacatgaactgaagtctgaacgcaacgcacgagtctgaagaacgctatcgccatcggtagcagcgggaagagaagactggccaagtcgtcgagggctaagcaaggcagtagagtggatcagtggagtggagtcgcgtcggtgtctagacgagatatttctttctttctttcaacggccaaattctccgatctagataagagtcgaggagcaaaagtcgctcgatcgatggagccggccgagcgtcaccggcggcggcggcggagggcgcacacggcggacgaggcggcggcggtgctgcggaaggcgtggtgccggctgcggctatcggcgcgggatccgtcgcgggtgccgccgtgggacgccgtcgtcctcaccgcggccagccccgagcaggccgcgctctacgaccgccagcttgcgcgcgcccgccgcctcggccgcttcccggcctccaccgccgccctcgccgtccccgaccccgacgccgcgcgcatcggctccggcgccgccactctccacgccgtcgcctccctcgtccgccatctcatcgcccaggtccagccacttctgccctatgtactactactacagaatcgatcccctcccctgtttaacatcatctgaatctgcaggcttccaaggaagagatcgccgaattgctgcccgaagcaagtgattcttcagcagatgacatcccactcagctcggtggtacgattcatggcgaacaaacacgtactgctgcttcacgctgggggtgatagcaagagggttccatgggcgaaccccatggggaaggccttcctgcctctgccttacttggccggagacaatcctgatggacctgttccgctgcttttcgaccacattctcgcgatctcatccagcgcaaggcaagctttcaaaaaccaaggttgtagcttatagacagagccactga

SEQ ID NO: 19371 - DNA, 243 bp, Oryza sativa
caagccgaaatatatttgattctgatgtgaattactacctagtgcctccatttcctactgaaatattctagactatatatgttaggttcttcaaatgttgctgcagtattttctcattgtgtacagtgatgaccactcgctaggatatatatatcatgcaagatatgataccccgtgtgtttatcacgacaagcaagtccacctaaccactccgtgataacaatacttatcttcactactaga

SEQ ID NO: 19372 - DNA, 513 bp, Oryza sativa
tttaatcatccacccgaaggacggaaccgtggtagtcttggaccctctcgatttcagtcaccagtcatacaaagaatttctaacaatcttatagtagtaagttattctgactcttgcatttttttaatatgaatgtattataattaaatatcctccttaatgcaaaacgatacgacatccatacagtgcatacaactactacaagttcaagggtggagaacagacccgaacaagggagaagctactagcacatacatattggccagtaatactccactcacttaatttattccaattgtttcactaattgcaaaatttaactattttcttctatgatatatcgtgaagtgtcacaagcaacctagaggcactgtcctttgcgggtattacgcgtgcgaattcctcagtgttaatgggaggtacagagttaacacaaaggatgtaagtctctagactatggactagacagcttcacatatttatgatactaacatattgtttatcttccatgca

SEQ ID NO: 19373 - DNA, 1501 bp, Oryza sativa
gacatcattttgtcatgcatcttagcattaccatatgatttgatcatgatattaaatgtttgcgtatctggctcaacacccatcaactgaaactcactgtaccacctctccatttcatgtatcctgttaccatgattcccataagcccaaatgatagaattcatcgtgtatatgtccggcacactgtccccatcttcaagcatactagtcagtgcattctccatctcctccaacatgccggctttcccgtacccatcaattatcgcattatggataacagcattgcattgtagccccaagtaggacatctcatcaagaatcgcaggtatccgatcaaagcggcgcaatttgctacagcaattgatgagaacagagaatgtgtactcatctggcttgcaatccgcgacacctttcatctgttcgacggtggccaacgcctggtccagcagcccactgtagccgtacgcgccgacgagggccgtgtagacatccaccgtcggcttgagacgctccgagagcatcaccttgaagagggcagtggccgcgccgggctgctggcacttgccgagcatcatcagcaacctggcgtaggtctgcgacctcggcttgtaccattgctgcttacgcaacagctcgaagatctaaaccccaatcaagcgagcacagcacaatgagcatcagaatcaagctgattcctcaaggggattgggggttacctcgagagcgggctcccagcggcatgaggcgacggcggagtcgagggcctcgagcacggcgcggggccagaggcgggtggaatgctgccgcgacgccgccgccgccttgcgggagacgccggagacggcggcctcggtgcggaggatgcgggagagcgcctccggctgctcggcctcgggggcagacgacggcggcttgtgcctccggccgccgcgggccatcacgacgtgggtcgcacggctgctggcgcggggaggtggtgacgaggtggccggtgggcaccccgccggcgccggcgacggcgagtgcatggcgccggcagccggagtgaggccgagacggcgataaggtcccgagcgatcagatgacaagtccgagtgaggctgcacgaatcttaaccatccaacagttgggccgtcaagggagagggagctccgtgtggcccacactattgggccggaacgggaatgcgagcttcgtgcgacccattatagttgggccggaacggcccatactacagtcggcttgctgaaattgctgggtccaaattaagccactgttttgcctatttttgcaggagatatgagaagagagttgaggaagaagatgagacgagagaaagtcattgagatgttgggttccacgtgctgatgtggtggacctgtcacgttagcaaaaaaccgtttttaaaaccatagaagcagttgatttgcctcggttttcaaacatagggaagatgttaaacctggtttgtggttcaggtggttttgcggtcgaggaagat

SEQ ID NO: 19374 - DNA, 1501 bp, Oryza sativa
cgtattctgaatgccactagtgcgtcgcaaagcccatctaccacatcaccaccatctttcagaaactatcgaactcccctccgtttttagagcatcgcggagccgtccagcacgatatgctcatgcccttactgctatgagcttgttggagatgctccaccgtcgtcgacacctatccgcagccaaaccttggtgctgacgctcgcttggcaattgccatctctagaatggcgcttccaagagcctctcccaccgccgtcgccaccggtgacaaagggagggctggaggactagccccatctcacccaacattgccaccacctatcgccacctcaaagtctaccgccgccgacaccgctagccctcgccaacgttgacaaagaaaaggatggaggactagccccgtctccgcccaatgcctccccgacgccaccaccaagtttgccgacgctgctagtcctcaccgccaccctttggcaccaccccagtcggtcacctaaactaaaaccccatctacgcaatgccctgtcagatcccgacatcgaagccccgctgccgtcgccctagctgccatgcggggacccggtggcgagctctggcgttgccgagttgaggaagatgaggggcagcggcgagggttcatgagaggggaaacgtcgggggcggtggccaagcagtgtaactgaactatgcagggaaactgatagttttgagtctaggtaatgaagagtgtttgtagtgactaatatctttttatttgttattaatggaggatacagggctgctagaggatgggataccactttagggaggctgacgtcatcccacgtatttgctttttttcctgtaagtttagagtcatcctacccccactccacgcattcggcgtcctcgcttcttgagccagagcctacaacggtgtaggcagcaacgctggtcacagcagtagcagtagggaacatgggttaaaacgaggggaaggaagaagaggagaggaggcgttggtacttgatacttcataccatgcaggtacaagtcctggcacctagggtcccaagtctaattaagagcatctccatcagtctccaaatttgcctctccaaatactcatttagctagcttgccaaccgaatagagagttaattttgtttttcattccaacagcttcttcatctaccctctccattttagcagtgggacccacacgtcagtccctctccctccttcttcctcctttctttccatagcctagagagttccaattctcacccaccacaggccgctgcgcggaggctaagaggcggcgaggtaggggaagtaggacagtcgttcttctgccatgtggagctgtggaaagaagggacaagctcgagcttgagatctggtggccgcctgctccgtggaacttgggagttgggcggcggtggcggcgatgaggcaatgagctcaccacttagagcaggtacaatagcaggctataagccagctgcaaacatatttt

SEQ ID NO: 19375 - DNA, 1501 bp, Oryza sativa
tttcctgatcatcacactattgtctacatattttcattggacacatgttcgcaaccattactgttgacccgggttgtttcgttgcttctgaaattcatgtcgcaagccgcgcgaatatcacggagtgagcaccaagcgcatctcttcctaggatttctcatgggaagaggatgacatccatcgaaatgaatgacatatttctggagagagtggttcatcacttcactccgggcagcagtatccatgcaacgcacaaaaccattcctgatgaccaaataacgcaataaccagttagagccaaacaaacaaacaagagaaaaaatttcaacagaacataaactaaaactaaacttcaatgtgtacctatctgcggcaggattctgctgcttgtcaccattaactgtaatggttccatcttctgccttcgccatatgatggtgcttgctactactcaccggcgacgacgcgcctacggccgccaccgacttctgctgctcgacatcaggcgccgacgagcctccgcctactcgcgccgcggaaggcgacgcaacagacctcgccgacgacattctgccctttccaccggagagtttctgctccatcaaaaacctgtagaacaaaatcttcttcctcacaaatccgaaagataattgtggtcctcattttctgtcctccatcaccgtcaacttaaatagagtatcaatacagcagcctccacactaactactctcctggtcgctcggtcgtgcatgcgtgcgggtaacaaaccatgcatgcagaacattcaaaatgactcaccatgcagaacacagcgcagtgatccgaattttcaaaaaaaaaagaatattcaagtttctgcatcgctggtttaatggatcttttctcacaatccgttagtgagttgaagcccgaaaccctgatgtgagttggacaggtgtccgatggttacaataggagtagctactcctgggagtagaatataggcttcctatatatatatatatatatatatatatatatatatatatatatatatatatatattaaatttgtttggtgctccatggtgcccgggcaccattgttgaaattgagtatatacccaattcaaatgagtatgaaactttttcaaatatttaggtattaacattaacaactttactaactagttcaaagcaagtttgaactgaatttaaacttgtttttgttatattagattttgattctatgtatatagcatccaaacatataattagttaggtatgtaattatggattgtgagataaagttaaatttgagttgttttgttgataggtgtaggtataaatcaaattcttataacttggtatatactaataatttgaaaattttgaaaaagttgagtgattttatgcatttgataccatggtgcccatatatggtttcgcggacaagttgaggtaccttaggtgtactttttccttctgtctccaccctcatccagcgatccaaagcccaacaca

SEQ ID NO: 19376 - DNA, 1501 bp, Oryza sativa
gctcagcctgacactgcgcatgctcacaaagggaataagggaaagtcaaattgcaacttcataaccgattttgaattaaacccattgaacacgctcatcattcgtgcatcctttctttcattttctgtaaggatcagatgatgaccaaattagatgagaaccaactgtaagattttttttttcgaggggaaggtcaggagttctgccgatttcaattaagtagggggaaaacaaagttttacaacatgcaaagtccagggtttggggatcccttggatacaactgtaactgtaagaatttccagctgcaattagtttttcttaaagaatcagatgacaaagaaatcagatgaaagcacctcatcagagacgtacaaacattatcaggtagcactttctgacaacagaacaaagcatggattaattccctgccaagactggtgccgagtaatttccagatatcatcgagccattggaaggagtcaaaccaatagtaacactgcagatgttagatcaatgatttgaatcactttgttagctgaagcacactgttctcattggcatcttcgttcaacaaactcaaggaagatctcaaattcataagtggagagcctgttcaatcggataaccacatatatcctgcgcatttttacaattcgtaaccaacctcaaatgttcatatagatatatcaatgatttgcactaagaaacgaaaaatgatcagcttatcagtactttgcatctgctgtcaagatcaatatgcaagccccacaggaactactgcaaccactgggaataaatgaaatttgaaactggtccacttgaatcgcaatcacttatctgaccatatcagagtgtggtgtgttcataactacacatggcccatttgccttttttaaaaaaatgcacgcacataatatacattctaaatgagtttttgcagttccaatttcaatcaagattgcctgaactggaatattctaaagaggcataggcagcaaaaaggtaggcagcatgttgctcacaaaaataatgatgaaacgaaaacaattcattgaatttaagtagccaacgattcttttacttctatcatggagcagccgtttagcggaacaaggccagagacagagatgtaccaagccctctggagagtcgcagctttcaaccagagaaatgctctttaccatccaccggtgatccaaagaaaagataacacatatcctgggttatcaccacttcaccataaaaatgaaggatttgggactagcaccatggtctcaaaaaaaagagagagaggctatttctgacaaggtcacttcacaagtcacaagatatcttcatctcaatggtgtatgttcttgtcctctctggcattttatgagatattgtacttattttcaattgcgtgatcttactgtcatataactgcattgtgactttgtgaggtggttcagcacaaatttccatctttatatcaagaagacatgaccgccaacacaaac

SEQ ID NO: 19377 - DNA, 722 bp, Oryza sativa
cagaattttatcttttatgatattctctatgtagaatgaatttaaagatgcgactttgcacgtagatgtaatgctattgaaagtacatgtatgaatttttctagaatttttcgcgataatttttagttggcgtacacggtgtgtacacgccaggacctgtgtgcataggatacgctccctatatatatatatatatatatatatatatatatatatatatatataggaaaattatatactactaccgggagtagctactccctccctgtccgccaccaattcaattcgtttgcccagataatggtaatgactattaacaggtttattgaatcgaatacttttacccgttttcttttacccgtattttttttcccttggggtcaacaagattgtttctgttctgtagcagattcgaaaattgaatcaagattcctgagtttgttgtagatagaattttgttcggagacagctgaccagatatatttcagggtggttttttcgctcttcagtttgcttatccaaagcgagaaagcaggatgattatcccgttgagcagaacattatcgatctaaaaccgttctttgcgttttgagagttcttaacccatctaaactcagattagtagcctcgccggcggctgcgttgcagataacgttgaaaggtctagcatggagaactctagttccaaggtttgttgccatattcatctgttattttgcagt

SEQ ID NO: 19378 - DNA, 1501 bp, Oryza sativa
ctcgggcgaggcggccggacttggcgtaggcggtgaggaggtggttgaggaggaaggttgggggagcctggagaaacgtcttgagaatgaggcagtgcacagcgccggccacgcgaaccccggtccggccgccgtcgccggcggcggaggagaggatggcggcgtagcggttgcatagcgcgtgggcggcgtgggtcatcgcgcgtgggctttcgcttactagactagaagtgcccgcgcggttagcagataagttttcgatcgttcgttttattaaaaacttttataaaataggtaaaactacatgtatacataaaaatatatttaacaataaattaaatgatatgaaaataattaataattacttaaattattttaataagacgaacggtcaaatattttttttaaaaaaaaagtcaatagcatcgaacgttttaggatggagggagtactattaaaggccttcacatcaataaataaaagttgggattgtacttgacagtagttaacaattcgggaaagcacaagaatgcatatgcaaacaagcatcaaattgggcaaacatctttgtgacacacaaacataaaataaacaacctggccactagcaaattgacacgacactaaatcaagaggagggaaaaatttcaaaaaaacagggaaaaaggaaccgtaccgatcttggggaattttatgattcgcgagcttcccctgcaagtactatggagaattttttttatttataatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgatttttgcctctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatataagttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtatcgtaattttagaaatttagagaacaatattgtagagaatgtaacttagggcgtagtacagaaatgcgaggttaacgcagttattgttttcatcaggcacaa

SEQ ID NO: 19379 - DNA, 876 bp, Oryza sativa
atgctctcatgcatagggtaacgtgctttcacacaatatttactattcatatattttgtatgacaggagaatatattggtgcaattttgagagaagtattctcgaccacttcacttttatttatcaagaaaatggtacggcctgctttaacttgttaaatactagatatattggacgaaccaatggctgccatatcttcgctcaaaatttgaaacatatacaattttgaaattttacaatacacagtcccttttgttgtaaatatatgaggatagataaaaccttaattcatttgcacttaagattaagattttttttatctagtacttgtttaaatgggtagttttaacccaagatattttggataggaggaattggaatggtaatttaatgtgttgcttttacatgaaaaacgagactatccatcatttattcttggagtttcactatgcaacatttctttgaagagcattgaagttttcttctggtttatccactccacatattatatctcatatttttgaaaattggattgtagggttgataaaaaaaaccaaaaaacacatcctcgtaggatcatatgctttatgttggaccgtatggttgagcaaaaatgatatgatttttgataaaacatcatctaaatcttattttagatgcatttcagggcaacatattggtttcgatcacgtgctcatgtataaaagtgtgatgaagacactaaggctgtgttcccctcctccccgacacgcaaaacgaagctcgtattattgcatgattaattaattattaactatttttttgaaaaatagattaatatggttttttaaaacaactttcgtataaaaagtttttgcataaatcacaccgtttagc

SEQ ID NO: 19380 - DNA, 1046 bp, Oryza sativa
agattttaaccctaggtgtaatacaattgaaagtatgtgtatggttttttctatattttttggtaatattttttagttggtgtgcacgtgtatacacgtgagggcctgtgtgcataggatatgttgccatatatatatatatatatatatatatatatatatatatatatatatatatatatatatatatatatatatatatatatgtatgtatgtatgtatgtatgtatgtatgtatgtatgtatgcatgctagcagtatcgagtaacatgcatatcatccgataatcatgtgctagtgagaagaaaaactgaagtctcagttgctcgcaattctgttcgctttctttgcgtagcggcattacctctaagaatttttttcggttttagatttttttaaaaaaatatttacagaaataatctatcggccaaaaaaattataaaaatagaccctgccgcccacctctggggcggcaagatgacgtggcaaacgggggaggaacgggcggtgacagagggagggtttttttgcaggaaaacccttgccgccctctggtggggcggcaaggggcccgaatgcaaaaaagccagtcggggccggttattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccaatttcaggtaatattcatagatcatatatgtgactattaagttaaatagcgtgtattctttaaaaatttgtttgaataaatgcattatatttttagtgttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 19381 - DNA, 497 bp, Oryza sativa
gagttagaaaccctagtctctctcctcatttcttctctctccccgacgccagccctagccaccgctacagtgctcctagtggcgatttcctcttccaaccatgaaaatttgattcttctccatggaatcaaccacattggtggctaggcggatcttcctgtgatcgttctacgatttactatcaaggtagcactttttgattccctctctcggttcattgtgttttttatcccgatctctaaatctgtgaacctagggagaaaaccacttggatagtcttgttcctgctaccttgtagatcaccgatctataggatttgttcacatgcactggctatttttgagacctctgttcttcatttttgccggccggaagttccggtgctcttgcacccggaacctccgggcgctgtccagccagcctgcaattcttgattctctcaaattttgcctaactattgcactccaatttgttgattcctgttgcagtaagcacta

SEQ ID NO: 19382 - DNA, 1424 bp, Oryza sativa
tatattttcttgataccaaagggttgtcatagataaaaattatttttgttttcccttcgcgaggcgaaactaaaatattacttttgttaaataatatctcacaaaataaactcatacatataatagtcaaatacaataaatttatacacttcatcaatatacttcataaatttatattttcttgatagcaaagggcaaaatggactctatggtagaaattttgtggtcaactaacagtcaactaatggaaggggtatagaagggatccaaactgaaatttaggggtatggaagggaatgagcaaatctcaaaggcatagaaaggattgtgtgaagtttcaggggtacacagggaattttctctaaatgtttcactctcctttctctcttcaatgtcagtaaagagccttctattaatattattaacagatgttgtacatgccctaaactagaggtcatgccaactttggattcctttttttcagttagtaataatgtttaaggcctcctttggaacaaaggtttttttaaagaaatttaggagaaattcaatccataacaaagagtatggaaatttttcctccatggccccttttgattaaaggaaaagccatccgaaaatcctacggaattcatttggattggctcaaaacttagaaacttcggaggaaatgtccaacctcttgaaaaaagtatactttgtgtgtgtatctccgattctagcatttttcccgtgctccatccacatggttattcttatagtttccttacatttttttcaatctataggatttgaaatgttagtgcgctccaaccctcttttttttcttatttccgtgttatgagaaattgagaatcctacgtttcaaaggagcactagttttttaggcatttataactgaaaataccaggtattatgattttagaaaaccacccaaattatgtgcaacccatttcagttattaattgggtaaattaagaaaccgtgtacaacagtccaaagcggtattgtattcaaaagggaaactattttgatctcttgaagggatgtctcctcgttatttgcatgccaatcaaatggttataaaaagaatggaaaattttgagaagatgtattaacatgtgatataacactccacaagaatgcatgttcaaattcaacttttagatctcgcaacggaaaaaacaaattaaacagcaactacataatgtattgtcatagtcaattttttcttgttgcgagatgtagaagttgaatttgaacttgcatgtttatggagtgatatatcatatgttaatacatcttctcattttttttcataaccatttgagtgacatgcaaacaatgagaggatatcccctcgagggatcaaaatatacttccatattcaaaattcccttttcataattaaaccacacttttta

SEQ ID NO: 19383 - DNA, 1501 bp, Oryza sativa
gttctggccagaacttccgggcaccgaagtttagctagatttttcctaagtattgcccagaagttcctggcacttttgcccggaacctcctggcaggtttctagttcaaacttgtgagtaacggctagatgacgtcacctagccgttatatatatggatttcgtccccagatcaccctttggccattccacttcagctctttcatgttctagggttttctagccactccccagcttcctttgcttcctccactcaaatctagagcctatcttgtgagattgagagattagattagagtttaggagtgttttggagatggcttgaaaattaggtttgattgagcactttggatatcttgtgggctgtcacttgggcttattactcttggagatcttctcctagacggttaggtgtcgcccgtgagcttcaaaagatcttgtggatgtcccgggaaagtttgtgaaggttttcctcacctccgcaaggaaatgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggactccttctgggatctttgcataagtgaggcaaggggttaatcgagacccggctctttgagcacctcaacggagagtaggatccgtgtgatccgaacttcgggaaaaaaatcgcctttgtctctcttgtgcatgatctgtgtttgaatctactggtatcttgagatctacatcttgtgcaactctgtgcctgatcatctctagctaggacctgttttacttcccctaatttcgcttttctctgttgcctggaagttcctggctcaagaactccagaagttccgggctactcatcctacccggaagttccggtgttcatcaccaggaggttccgggccctgtcaatttaaccgctgcaattgttgagaaaatttcaagaaagcctattcactcccccccctctaggctacatctctgcacattcaattatatgtacttagtctagttttcctttaaccagaaacataatatctgaaatcagcagccaataattgtgtcgcttgaattttcgcacacatcaccaccggcgataggcgtcgaaccaaaacagaatataatgttgaacagtaattgagctgtatatcagtaattcgcacagatcttgccaccgccatagccattgaagacaatttgacggagacatagatagatagatgagaaaatatctcgtcaaaacgatcaaataagtgaatctgtaaaaagaatagacataaaagttttctgaatacatgaaaaaatctcgagataagaaggaatgaactacattttaccaaaaaatattaagtccaaacttattttcatctggttgaaagaaaaaaattcacatgaatatggttatgattttgatgccacaa

SEQ ID NO: 19384 - DNA, 299 bp, Oryza sativa
ggcgctgttgtgggtacctctccccctttcttggcgagttctcattgggtgaaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggattgtgcttgtgtggttagcgtgtggttcttggaggtgccttgtgcacgtccgtacttgacaacttctgtcgtgtttttcttagt

SEQ ID NO: 19385 - DNA, 304 bp, Oryza sativa
atgctgctttgtgtaacatagtaactatcaatctatcatttatctggagatagctcttccgtggaacacaaaagttagatctgagcatgatatactcaagtttatttctatttgtgcagtggacaaatatgaacaatcttatttacaaactagaacctctcatcagtacattaacttgtttgggtgtatttttgctctgggcacaatgctgcattgcacttcataacgccagatttttgctgtttccttatcatggggccaacacttacaaacattctaatgatttgtggcagctgattatgat

SEQ ID NO: 19386 - DNA, 1501 bp, Oryza sativa
ggcccatgcatacagccgggcgactaattagtcgcccgcttgcgccctctcccctcccctctctcctccagttcaacagaaaatcctacgtggatcttctaacgcccattattgtacctgctcttaaggggcaaggaaggttgaccggagggacagaagaaggcatgcctattttaggtgcaatttaatagggtcttttctctcaaagagggtctgcttctctttttggggatatgaaaacaatatgagagtattacttaaaaaatgatgagtgatgttcataggttctacgaaaagtaagcatcactagtaacaagctcgtcaatacataccactttaatgatgcattcggcaaaaagagagaagattgtgacatgtaaccttacttgtgtagtgctaagtgaggatgggtagctgtacatggcccacatcttccaggcctttagaccagcagcaaggcccagtaggaggaaggtggccaataaaaatgattgccaaaagatgaatccaagccacagggtaaggccttctcagcctttgaaatggacctgccattagcaacttgaggaggagggccggtcttgcggttgacctcaaccagacacccttttttatcagcgaaagtaagataaaagcgttccttgtgtgcgctgcaaagcgtcaggatgagacctcaattcggcacagccgaaatgctaatgctggactgactgctgctaccttgatgactttgaatgaaaaagaaaagctggagacccaattaaacagccacatttgacccctgctctgccatcagcgcaactgcaacggagacccagaaaggagcgaaatgtcacatgctgctctaagatgattggaagaagatgttgcagtccagtctctgtttggatgaaacaataattcactgccaagaacaagaaaagacgatatgtagcattatcaagaccagcagagaaacctgcagctgagtgctcggctcaatcagagcatgcacagaacagagaacagtttccttctgctttcatgtctgcaatgagataatgcgattgacaacttttcccttgtagcaggagcagaactgttcataaccatcagctgcgcagtgcacaccactagccagtgctcactggaaccacgacttgaagacgtatcggtcaatatattgctttccgcagcaaatagatcatgtgatgtgtttttcttatacatggagataacagcaactaacttttgaacgctgcattcatggcctggccagagttgatctccagcagaccggcacctccagctctgctcatcaatgtataacggtgaacaacacacttcaacgcctcacgcgtatgctgatttatggcttatagctggagcttttgttcaaccccataactgccacaacaagggcaatatgcatctgatagtgtcttgtctaagcacaaggaaggctgagaagcacagaggttaaagggccgggccatatgcccatagcagggagaagagtttg

SEQ ID NO: 19387 - DNA, 232 bp, Oryza sativa
ttcggagtggtatttcgaattcttagttgatctggtgactaaagtacaggcattttcagctcaaaatttaagagggaactattggtgattaattgaaagttttttttttcatatgtttgtcagttctgcaatcccaccatttttttccactgcttgtttgaaacagctgttctctgttgctattaatgctccagtgcaccgcactaacactctgttcccactgatgataaga

SEQ ID NO: 19388 - DNA, 1501 bp, Oryza sativa
agatgtttcactgctgctgcatgcccccgagcatcagccatttcagccccggcccagccaaacaacacccactcgagaatttttttaaaaaaatagtacaattttaatgaaaatttataaaaatagatgttgattgtctaaaatcacagatttagcacattatcgaataaccattatttgacagggtttaaaaaaaattaggaacttaggatatgtgtgtatgcatatgagcgagctgtgagacctcgataggtcaatcaagccaattaacatgtcaaaagaccattgttcgacatgtaacttatcgaacaatggttgtttgatagataccttattgaaatatgattgttcgactggttactgaatatttgatttctatcaaccaacacctatttttacacttttttttattaaagttgtattatttctacaataaactgtccactcgatctccccttttgccctccaacttgacgcgtcaatggacaaaacaacaacaacaaaaaaaaaacaacgtggggtgtgagctctctgaacctcctagcttgcccgagacagagagaaaaagaaagcctcatctccggcccctcttcctccttgattccggtggctcgccgccggtgacgggagggagaggggtcaggctcaattgcgtctccttcgtatagtagtttagtcgggttagtctcgtagtcaagttagtctcgttctatgtccttcctgttctttgtctttggtcctctatgaagagtccagtattcccttcttcagatctgaaatattgtgggtggatcagccagggaggtcggtctttgctgtgccagacctcgatttcgtcggccctagcgacgcctgattgtggaaaattcagctacagtgccggtggccgaaagtcttcaagctttgaggtcgctggccatagtttgcggtggatctggatggcttcaaccgatttccgcgacctctttgtccatctaatccttggcgctgtgcccttcctcagcgatgcactcagccgcgtcgtgtccggtgagggtgggctcacacatgcccagatcgtcgtcatatttggtgggcttggaggtgcagagttagctgagctgttggagcagttcgtgcttgctgattcctctcatgcgagcatcccgaacattgtctcgacagacaacacctccatcaatttgctgctgtgcctaaatcaattatgcctaaatcaattatccaagcagcagcacaagtcatgggccagcaaggagcacgccatgaatcccctgcatcatacaggcaaccaacaagctacacaacaaggcaaagctggtccagcaattctgtgcatgccggcaacgaagtctccttctcaatcctcacccatgggatacatcttaagttcgtaagactttatcatcgccaccatctagcttctctaaagcttaaggtcagctgggttttggatgcatcttttatttcattcctttgcagcagtatccatgttgaggttatc

SEQ ID NO: 19389 - DNA, 1501 bp, Oryza sativa
cggtgcggcggatggtgctggagagcgtgggcgcgacggcgtcgtcggcgggggccgtggaggcgcaggcggcggcgacggcgttcaagctccggctgtcggagtacgcggcgcccggcggtggggaagatgcgaggctggggctccccgcgcaccgggacacgagcttcctcgccgtggtgacgcagaacggcgtggacggcgtcgaggtggagtgcggccgcggcgacggcggctgggctcgcccaacgctctcgccgagctccttcctcgtcttctccggcgacacgctcaaggtatctgtgcatgtgcacgcatgtcacatctctctatctctttcttctttttttttaaaaaaaaaatggattaaaagaaacctggcgatcgatctagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatggaataacaatgttattatacaatcaatttccaacaaaagattcccgccaccaactcaattaggtggtggtagctagttttgcataagactcctccctgctattaccgttggtcaattacattattttcgtgcggaacgtgacgaaacatagacataagatattaatcgaaaaccagttaatcgaaaaccagagtaccacaatatatagcaaaagtattgattttggaaaactaataagtgatgcgcgcattcacagttatatattcgaacctgagttttaaatcaacatttaacgatcagccttcttaaacagctaaatagcagggtaaatgggaaatagattttaattctttgagggaataggttcactcgttattgcatgtcctccaaatagtaaaaaaaattaaaaaaataaaaataaattaatacgtgatgcatgaccggtgatgaccggcagtctgaccagctctgcatggccggtctgaccatgcagacagggcggtctgaccggcattgcgtggccggtccgcccggtcccagagaggaagctgggggcacgttacaattgattaaaaggccggattaattgtgaatttggacatttgtgcccataagtcagaaatagattggagaatccctttgaatagaatatttgaaagatcctagtttcaggattgatcggaaaatttggcggcaagcgttcaaatacattttgcttgatagagaattatatcgccgaaaaatagatagagtacttttgaagtgcttagataatgatcaatctaagattgctatgggagaagtacacatgaagggatttgtggaactcatcaattggcccgcaagatggattggttgcttaggagagttggattctattggccgaaagtgattgatgattgtttcaagtactata

SEQ ID NO: 19390 - DNA, 784 bp, Oryza sativa
cacaaacgatcgagccgcaatgtcttctcctagaagcgtgtggctcgcctctcctctttcatggaataactgatataagtaatggagtttttgacagagcaatagcgagattgccacacggtaagatgagatcgtactgtatattgatcagcaggaacaggcaggagcccaggactcggtagattctgtattcttgacctcatgcatcagtggatcagcaaaagccctacatatccttatccacaggaagctgtgtgcggtggtcctagtggagattccgagccgattgtcagcgagatgtttcactgctgctgcatgcccccgagcatcagccatttcagccccggcccagccaaacaacacccactcgagaatttttttaaaaaaatagtacaattttaatgaaaatttataaaaatagatgttgattgtctaaaatcacagatttagcacattatcgaataaccattatttgacagggtttaaaaaaaattaggaacttaggatatgtgtgtatgcatatgagcgagctgtgagacctcgataggtcaatcaagccaattaacatgtcaaaagaccattgttcgacatgtaacttatcgaacaatggttgtttgatagataccttattgaaatatgattgttcgactggttactgaatatttgatttctatcaaccaacacctatttttacacttttttttattaaagttgtattatttctacaataaactgtccactcgatctccccttttgccctccaacttgacgcgtcaatggacaa

SEQ ID NO: 19391 - DNA, 1501 bp, Oryza sativa
tacatattatttgttagctaattggatgcctctcctgttgattttttttacaccgattgtcttgctgctggtgattcagtcgtcaggttgttcaactcggtaagcacacggctatcttatattttcgtgaagtatgcatgtatagctttttacatcatggttctttgttttactgagcttcgactgaccctacaatggtgaaaccttattgtctccttgtttatcctgccattctgcttataacgtcacactgaggctcagttactctccatatcataggatacatcaagctttccatgatacagatgtatctcatatttgtttatttttgaagacagctcttgcttgtcttcttagtttttattactgaagtacattgaagaaagaaaattttaattttactgctgtaaagcacatttaattctgtatttacctacttagcacagtgaaaatgtatatgtgaggtgctttcgaagctttatattgaatatttgatgagcttgtgttaagggaacacactcacggacatgtgcatgtaccttttccatgtaatagcaggactaataaaatagcagctatttgatgattgatttgataggcctttactttattccttccaggtaagcaaggcgcagaattgtcggaaaggtttgaacccatcaaggagtaaagacgccaaaggtgtgttggtttacttaccatgtaatccatcattctacctctaataatttaggaacctgttgtgactaggttgatagtttggattttagacttcaaaaaatcaataaatatgaaagaaatcgattctacatttatgaaaaagtaaaactactggttcagcatgtactctttattcattggatggtgcattttctttgcatccttgatggtgcattttctttgcatccttcctccctactagttagcctgataaaaacaacgagtgttggggcgttacatctaaaaaataaaaggtgggagacacacaagagtgcaagactactatcaactcaagatggtttgaataggacctctttgtttatgtgcttctgactgcatgaaatacctccttttgtttgacacaaaatgcggaagttaagcataattgaggccagctggaaacaccatgtgtcatgatcttttcattgacagcaaatactatcatatgacattgtcattctgcacaccgtacttatgttttgtattttattttgatgtatatatgcatttttttgctactaacgaaaatattctgaacattttgtgttaatcctaacagtgttggcaaaagaaacaaagcaggccttcctcacagaattaagcaaaacatctaaccaaagtcaaaagggcaaggcatcttccaacttttctaaggtagctatgataattctctctttactcaaaaacactccatttcattttatagacttctgttgctaagtatttgtgttgtatcttcaaattcaaattagttgttctcagaggcatatctggtggaact

SEQ ID NO: 19392 - DNA, 1501 bp, Oryza sativa
cggagcctaggcgcctgcctgtgctggccgggccttggctccgccgctgtcaggtattatgattttaaagtttcacaaaatatcacccttatgcactttaagcgtgaatttacttaaagttctaaaccatagatatgctggaatttatcaaaattccaataaaggttgggttttagaaaacaatgagaccataaatatgtcatatgtggttatgtgccactcgtcattaatacccgtggtttttcataactttgtcccatttctgaaatttactccaaaaataatacctgctccgtttcacaatgtaagactttctaacattgcctacattaatttagatactaataaatctaaacacatacattataaaacggagtgagtaataataataatagtaatagtaataagaataagtaataactgctattagcaacaccaaacacggcgataagcaagaaaacaaagtgaagtgcaggatgaaaaactcacgaatttctcgggacccctcgaaaccaccgtgccctcctccgctaaatcgggggcacacacagcccctcgaaaccgtggcgctggcgcggatcaacgccgccttctcggagcgagcgatggggccgattcgatccaaaagaaaaagaaaaaaagaaaaaaaaacagaatccagagagatacctgtatacaccggccgccggcggctgtacggctagctgcaggtggccggggctccgtcgcgcgcccaacaccggccggctgccgccggagcccaagaactcgatcggcgccgcggttgctggggaattggatggacaccggaagtggctgacgagtgacatgagtgagcgagcgagatggagtataaaactagagagcactagagcaggggacgccggacttcacgacttcaggggacaaagtcttcgtttttaattcagtaataattgcgtcccataatgattgcacattcaaaatttgtccaaaaaaaatcatatatactcgccctaaatataagcatttttagcatagtgacaagtcaaacattttaaactttaagtattaatagcaaaaatataaaaaagataaatcatgtaaaattgatatttctaaatttatcattaaacaaactatcataatatataacttttttttattagaacatcgatatggttaatcaaagtagcatctcggagaccgtgccagagtaaaaaaaaatgcttatattttgagatggagggaatacttatatagttcatcctcattaagtgcagttaatgtcatttctctcttatctcattaagccacatcacctcaattatttatagcctttgaatgataaatctatggttcaaattatctcttatttcttttctgataacaccatgcactcttaattatttttattttcaaaattcataagtattaatttgttttagttttaataatcgcagtaacgcagcgggatattcatctagtttacgataacatggaacacaacaaacaaatagaa

SEQ ID NO: 19393 - DNA, 1501 bp, Oryza sativa
tggcccgttggctgataagcgcttacgagtagaattataagcacgattgtttttcttaggccctctttgctgaggcttataagccaacttataagccaaaaagtataagcctaaacaaacaagcagcttattcatttgactttttttgaaaccataagccactctaacactattaagtcaaaagctaggttgaagaagcttttttgacttatgtgaggtagatgtatgactccacctctaaacttaggatattaaatccacctgcttataaatcatataagctactaagccggcttaaaagtttaagacaataagcctagacctaaacaaaagggccttagtcttggtgtcaagccaaaatatgacgataatggagggagtaaaaggcaatcgaaatttgattaaaatttgtcaaaacatggcaaaaagtttggcaaaacggtgcgaatcatttggcggaaaaatatcatactagtctagggatccggatccggcgctccgtcgaaaagctgaactggaatttcttcttctttttttgcgcgtagatggcccacatgttttttttttctttgcatcaaaacccttgtaggtttccttggcgtcctgcgtcctcctctgcacccgatctcctcgaccaagacggagatggcgaccaccgccctccccctcctccacctcctccctcggatcgtatgcgccgccttcttcgcctgcctccccggcctcgtcgccggcatacggtgagctagatcccgttcaagtttaatcttcccccaccacgttcagcattcccgaaaatgcggcgtaatttgaatttattttttcctccctgtttgctgtttggtctaaggtgcgttccgattgttgtgcgtccgtcttagctcgcacgggtgattccttgtgatatttactcggcttggcgatgatcctttttcaaatcttggcatgtatacctagccaaatcagaaagttttttttttcttttgtttctgtaatcgtgagctttatgtgttcaacgcacacatcaacctagattgggagtgaaagagtgggaaatgatggatggagctggcaaggatggagggaaaatttgggagaaatatgcttgggttaaagaggaatggtggctctgttgggttcgtgtatgtactagtgccttgctaacatccatggtttcctgatgaatgttagtaatgcccagaccttaccagtgcacaaaatgcaattttgtgcctacattttcttgctgactaatacatgacctctacaaagtgcagaatagagttatagaagtgcaggtgttcagttaaatactgtggtacgagactacgagttaacgggttgtcttatctaattgtgctttcaactgaattctggaactgggagtagcctgggacagagttcattgtatatggcatcatgtggcctttgaacccatgacccatgtgtgtcaagcttattagcgtgcccaaactgttacgccattcatgctttctttcca

SEQ ID NO: 19394 - DNA, 1501 bp, Oryza sativa
ggctttgctcaagagctacagtcaattattacaaggttcacacaaaagcaaactcacatagtatgtagccaaaggaacaaaaccaaaagtagaagcaaactaataaaaatcaaacaatgtaaagaccccacaactactaaattctattggtgaatctccacccaatgttggcaaagagctgcatgatcgtcgactcaagtttacggcacgcatcttttattagcttgatatgatcatcatgtctttataattgaacctattcccgaagccaatatgttgccctgaaaagaacctgcaaagattttgaaagtgatctatcaaaaaccatttcatttctactaagtcagagagccaacatacagcggaagctcaaacaagaataagttccttatctttttattaacatccacgagccaattcccaaacacatgagatatactatgtggaaggtataatccaaacgcgaattatatagatctccaaagaaatctggcaaaatggcaatctaggaaaagatggtaaatcgattcatttttcatacagaaacaatatctcaaactaccattccaacaatccccttaaagagataccacataaaaatcttaatcttaaaaggcatcttaagtttccaaataaacttatttatctctatatacccattattattattttttactaggaaaactgctaggactttgcccagcagtgtaattttataaatgaaagagaatatttacaaagttacagaaaaaaacagaagagaaagaaaaacatgattcctatatagtttgtatccaatcataaaccagttgcttgagaggattcttcattctgcacatatgcagaagaacttcttttttgaaaagcaatctccacgattggaaggtgggctgattattttcatacccattattaattagagccaaatacatatatcgaactcaaaattgatatcaaacccaactgttctctccatcatctaaattgtgtcaagtcacgatttcaaaacaacatacgacaaaggtacataaattcagaaaaatctatagctctaactcatgttttggatcaattgtcgatattgatttaaaatgatttgactattgatagtccatgcgtagtttgacgtaagtagtcacgaattttgagtacgtatatggattaaaataatatgtccatattcgtctctccgatcctctcacttgcttttattgtagctttattcatgtttttcgttttctctagctataatttggtgtaccttttccctcgagtagcaacgcacgggcgctttgctagtccaacagaaaaataggagtataacagagaaaaaggacttattgcgtgtccctccgcggccaaggcaggtgcacaaatctcagccgtccgatccacatcacggacggacgccacgcgtgcactccagccacagatttcgcgaaatcctcccttgatatattaatagaccggaatctgccgcgccgcgccgccgccacccacg

SEQ ID NO: 19395 - DNA, 794 bp, Oryza sativa
attatagcactgcatatgattttcgcttacatatgtgtttataaaatagaagttaatgcattaacattatttaaagtacaaagattaatgataattacttggaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgtgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 19396 - DNA, 1501 bp, Oryza sativa
gagggatggcttgggagaggtgaggaattgaggcggtggatcacgggaaggattttgatgcgtttttcggaggtggatttggccggagttgtgaaccctagttcgccggcgcagcttttcactgtagcaaggagtggggaaaatggcgagagttccggcggggaagacgaagcgtcgcttggatataggatttttcagttaagggtatcggaggtgctaatgggcctaggcctgcacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgtcatgctgtttttgcaagcttttttaggctacaaaagctgtttgggttaactaggaatgacttgtttttattatagtcatttccttggcgtgttatatgcctattttcatggtaaatagtcatggcctaggctatttgacttatttattaccataatctttataatacttgatgggtaatctttagaatttttttattcggatgcctgtcaagtgtgttcattcgtgaaccttttagagtgtaaaccactcggatttcttttatggtggctaaaaagcagtcggctagtatgcctatttaggcgccgcgtatgcttttgtcatataatgcacaattgtgttattattttgtctttcaactatatgtttagtttattaactaatcacatagttgggggctacacctaattaggtgcatctattcgatgcaccatattctttatttttttcgccctttacagtccactcggcagattttggcttgaagagtttgaagtactcggattattatctttgagaagactatgatggtcgactgcaaaggactcgggggctactgtggagattatgggtatcccatatctacacggcgatggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttccagtatataaagggggtccgggcgcctctagggatatatgctgatttttcccgaatcatacaatcaataatacactcggcggattcatccccggacaggagtagggtattacttcttttataagaaggcctgaacctgtataaatcctttgtctccaaacccatacactttccgagcttgatagccacccccttttattattgccgaaatctagtttcgacaattaaaacacgtgattaataattagttagtaatccacgtgattaatgtggctgtgtattgtctcctttcgattgatcagg

SEQ ID NO: 19397 - DNA, 1501 bp, Oryza sativa
cacattaatcacgtggattactaactaattattaatcacgtgttttaattgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatatccctagaggcgcccggaccccctttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacagtagcccccgagtcctttgcagtcgaccatcatagtcttctcaaagataataatccgagtacttcaaactcttcaagccaaaatctgccgagtggactgtaaagggcgaaaaaaataaagaatatggtgcatcgaatagatgcacctaattaggtgtagcccccaactatgtgattagttaataaactaaacatatagttgaaagacaaaataataacacaattgtgcattatatgacaaaagcatacgcggcgcctaaataggcatactagccgactgctttttagccaccataaaagaaatccgagtggtttacactctaaaaggttcacgaatgaacacacttgacaggcatccgaataaaaaaattctaaagattacccatcaagtattataaagattatggtaataaataagtcaaatagcctaggccatgactatttaccatgaaaataggcatataacacgccaaggaaatgactataataaaaacaagtcattcctagttaacccaaacagcttttgtagcctaaaaaagcttgcaaaaacagcatgacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgtgcaggcctaggcccattagcacctccgatacccttaactgaaaaatcctatatccaagcgacgcttcgtcttccccgccggaactctcgccattttccccactccttgctacagtgaaaagctgcgccggcgaactagggttcacaactccggccaaatccacctccgaaaaacgcatcaaaatccttcccgtgatccaccgcctcaattcctcacctctcccaagccatccctcgaatcaaaccagcacatttgagaaaaatcga

SEQ ID NO: 19398 - DNA, 1501 bp, Oryza sativa
ggatgtgatgtatgaccaagaagtggaagtaatgtattttggcctggcttcccctttttgtggttactaccttacatctggttctacttacagagagtgagctgtttgccgtaaaggagaagtggaagtgagatgcagtagtgacttaggctctcaggcctggttcagttcccaacttttttttcaaatttctaacttttatatcacatcaaaactttcctacacacaaactttcaacttttccgtcagaacgttccaatttcatccaaacttccaattttagcgtgaactaaacacaccctcagtgttaaaccctgaaatcagcatatcttctactcgtatatgtgatgagtggccgaagctttggttgcttaggttgtgtttagttcgtgtgccaaaattttgttgaagtatacggatacacatttgaagtattaaacgtagactaataacaaaacaaattacagattccgcctgtaaactgcgagacgaatctattaagcctaattaatccgtcatttgcaaatgtttaatgtagcaccatattatcaaatcatggcataattagactaaaagatttgtctcgcgatttacatgcaaactatgcaattgattttttttttgtccacatttaatgctccatgcatgtgtacaaacatttgatgtgataaaaaagttgtccaaacatttgatgtgatggaaaagttgaaagtttgaaggaaaaagtttgaatctaaacaagccttagttgaattgtcattgcttaatgctcatgttttacttaacagagattataaaatagtttggtattacacatcttctggacacagtcaactcaactgttccattgcaaattcagattcctggagacaaaatggaagaacagtaaccggcaagcccaactattccagagatatctgacggtggcaactactggatacggcacggcataccagctgatggatacgtgctgtaccaaacagtacaataaacacaggtccagaatacatttgtagatatcccaaccaccatgaagcatccggtggttaatcacgaacagatgcatgccagggccggtggccctatagaagtatgcagatcaacaatatgccatgcagatgagattatgctggctcattagatgcaaacataggccccagatgtagacatggtttcaaccagctcacacgaactctagacaatttcaaacaatgcatagtttaacagtgaaaaaaaaacaagcagggtacacgtccacatccaccatcatattttgctggctcatgtgacatacatggtacagtaactgcattttgtttctacttaaaaaagttttcatcagtccatcaaaattcaccagcttctgagtgcattaaataaacatccacataaaggtttaaacaaatcaggggagctgcatttcgtatacagagatgagctccatcagtttgcattatttctgtgaaagaaatcaggaaactagtgcaggatcgtcattgac

SEQ ID NO: 19399 - DNA, 1501 bp, Oryza sativa
tctgagaggagtgcgcgtagcgggtttgagctgtgggagggtggaggagggtttgcaccagtcgatgtgtgttggtggtgcgcgcatggcgacgaatctcttcttcttccgggagtagaggataggtcgaggggagaggagtaaccgatgtagagcatggaatgccgatggacagttaggaggggctccatgtccgtctcttttgcatttcgtattagttctgtagggatttctggctgtaaagtgtttacgacttgatgcttaggatcgagtttcagtttgttgcggatgtggtttcttgttatgtcgtggatactcggagcatgccgtaaattgcttggataggccattcaaaatctcatttgtgaaaaccgaaaatgaccatgcagttgcagactagttactacctctttgtattcggtattgctgatgaaaacatgtgctacactcctttgcttgattgaaatagagaacaataattcaaaagctcgtttttgaactgaagatgaccattcagttacaggcttgttgctacctctttgtattcaatattgctgatgaaaacatgtgctgcactcctttacttgattgaaacgcgaaacgatctttactctttctactatattagtgtttccctgatgccccgagcggaataccagtattgtggttatcttatttcaatagattaaacaaacatggtgcatttatgaatatgctacattctgtagggatataaatgtgtttgatattggtatttcgtggcttctcctttgggtacaactaagaacacaacaaatgatacttcacctcaaagtgatactatcttttatgcctttcgtaggcttacttagtttttactttgcatataaaaccactactacaaataggaaaatcgtattgcagatactgaaaacctgtcctttatcaggacaggtatgctctatgctgcaatgagattatcaaaaacaccaacttgctgccaactgagcatttgatcttttctcttgttacttagatacttctaaaataatgctccaacattgtaggcacctgctgggcttatatataattcatgtttcacttatgggctgatatatttgaacttgatgtatttattttggtttctaaatctgcaaaattgttcccattctattcgttgatttaccatttacctgcagcagcaagtttgagttgaaagtagagatccttgtcaccatgttctaattactctattctagttcacttaactagttaaaaactgaaggcaagagcatcagaattctgtatttctgatcatttcttgatgttcatgttgttcttaattttgcttctttcaacacttgcttggatacttagtcagctttcaaatgaagattactttagtcttttgcttttgacaagtattggcgtattgtagtaaagtaactacaaacttttttttgtcctgaatcacatctcatggatcaagctgtgataacaaattggttttttttttcttgtc

SEQ ID NO: 19400 - DNA, 1501 bp, Oryza sativa
ttggccgaccgattaaagatggtttctccaccagtgtatgtatatatgtatatgtatgtatgtatatatgtatatgcatgtatgtatgtatgtatgtatgtaatcacacacggtagcgctacatggcgcgtgtgtggcgctacgatagttagtagcgcgactctcatcactgctggcctccggattttccgttttttcccgatcccggaaaaaaaatcccaccgcatccctctcgttccacccctcttctcggtcctccagtaaaagtttttctgctattattccgttctttcctgttagaccgcgagtaaaaaaattactttggagcctacagccacgagtaaattttttattttggcgcacgctcccactcccgcttttctctccctctcgttcgattcttctttccgttcctccagtaaaaaaatcattccttgttatttcgtccctgttagaccgcgagtaaataaattactttggagcctaacacggtgagttaaaaaattacttgttttgaccctacaacagtatgtcagcccgtgagtaaataaatcactgccggtcagatattaacaatattttcttttacacacgggttctgttacattcagacacacactatacaataaacaaattacatgcttaaactcaaaagtaaaaaaattacaaaggatataaacactccaacaaaaatcatcaaagaaattcagatcagcagatcctcctcttctccacgggatccatctttgatggacgaatgttgtagtggaggcggctggctcgccaaccaaccagcgtagaacaggactgtgtggcggtagcattaggaatcaggatgggcagcccaggatcaagcatggccgctattaaacatgcagaccataaaatcagtaatgcctcaaaagattagtgcactaacaaccaacagaggtgcattattagtgattgttgaaagttatacctccggcgctagcgacaatgtttcccatgtcaccgcatgatgcatttcatcatcttcgagtccaccgggttacattgtgttcctgcaagaccaaaatttgccatatataaatgcactatgagtaggcatgccttagtggattgactcatagtatgaggctatgagcaactgagcattgcacaggacatggtgatgtttgcaggctgaaaagccaaaaattaatgcaagtgcaagctcatgggaaatcgaaatgggcatttggtggtacatatcagggataagtggcaaagcgttgataagaggcttatgaattgttgatcgtgtggattaagcttattagagaatttttggctcgtttttaccaagagaactgctgcaagctacagagttgaaagcacatagtcctaccagcgatcatatattttcagttaccatctgaatgccatggaggacatagaataacttcaattgtaacgttcagtcaaaattatttacaggaaacaattgattgtatatacaactaatcaaataaaccaaatt

SEQ ID NO: 19401 - DNA, 1409 bp, Oryza sativa
  unsure (1)..(1409): unsure at all n locations
cccgttcttctccctcctcgatgacccttatgnngtcctgtctcacccgtgtctcacggcgccgctaatcaantccctctccctccttattatgnacctcccccccccccccccccgcgcgctttgattgacactcgcatcggacaaagcaaccagaattatagtgcttcctccgctgtacaatgtaagtcattctagcattttccactattatagtacttcctttgtttcacaatataagccactctagcatttctcacattcatattgatgtcaatgaatctagataaatatatatgcctagattcattaacatcaatataaatataggaaatgctagaatgatttacattgtgaaatggagggagtactacacaaacgacgcaagaacccagccagtgttgaaacctgctcatctggggaactcaagcacatggtctctaccacaaagctctaatttttctcttgtcattttgtcattgttttgtctttacggttagatcaatagtggtccttgggttaggatgatataaagcttgtctgctcttattctgaccattggtgctactgctatcctgcatcaggtttccttccaactcccccctctctctgaagctctgggactttggattgctaacagattgcagatatgtagcagtaaaaatgcagtatagttgtattggacaaattaggagtacacatggtaggacatagagaatactggttcagaaaaaaaaaacactctgcacggcattaccgattatcatgtaccgattgtcaattatggcactataatggagaatactggttcagaacacctgcaaaggtactacaactactgtacgtctgtcacatggatcacccctcaggtgaaaactgaaaaccatcttggtactacactgtggatttttcacattttggtccttttgaaaaacttatttcgcaaatagacccctagaaaaacttatcccaaaaatggtcctttttgggacgccagagtggctggcgccgtcgtccaacaggatggcgccagcctctctggcgccgtccccttgccgatgtggcggggcgatgctgaggtggctagggagtgcgccagagtggctggcgccccccccccccgaaattttttatttttgttttatttgtttgatatttttttcacgcttagggacacacaaaaaccaaccatagaaaaattgaactcaaatggacgtaatatgtgacctgtagaatttttcctctcctctcctctctctccgaactagtgcaaaggagagatgtgcaacttttttatttttattttatttttttgatatttttttcacacttaggaactcacaggaatcaaccatgtaaaaaataaactcaaacggacgaaatatgtggcatgtggaattttccaaagt

SEQ ID NO: 19402 - DNA, 831 bp, Oryza sativa
ctagaggatcccccacttaactaagtctgaaaatagctagcataccacttagtctactttgcaccttcactaaaattagaccataattcctttagtaaaactctttgatcagcatgttaaacataatgcactctaccactatatgaaattacttaatctaattcaaaatataaccacatgaaatgacatatataagttaaacagtacatagagatgcaattttttttatttttatttcatttttttgatatttttttcacacttaggagaacataggaaccaaccgtataaaaaataaactcaaacggataaaatatgtgacttgtagaattttccaaaactctaccgaaacggacaaaatatgttatctattaaaataggcgtaactttctcatacgcactcagaatcaggcaaataatatatgcacggacatctacagaaaatgttacatccgattcttcccagctttgctgggttcggcgatattaaaacctccaaattccgcttgcaagattgtgttttcgaggagagaagtttttcggtagaactttggaaaattccacatgccacatatttcgtccgtttgagtttattttttacatggttgattcctgtgagttcctaagtgtgaaaaaaatatcaaaaaaataaaataaaaataaaaaagttgcacatctctcctttgcactagttcggagagagaggagaggagaggaaaaattctacaggtcacatattacgtccatttgagttcaatttttctatggttggtttttgtgtgtccctaagcgtgaaaaaaatatcaaacaaataaaacaaaaataaaaaat

SEQ ID NO: 19403 - DNA, 1501 bp, Oryza sativa
aatactgtctcctaactagtagctaagttctcctagctagtagctaagttctctcacaattgttaagtttattttttctagttttaagcttgtgttgagcaaaagcactcatggatgtgggtggtgtgtactagtgtatatctgttaacaacagaattttgtttcgtatgaacaatatcttccatgataaattaaaagataaagcaagatctgtgtacaaagttggaccctatgtatagtgcggctttttaatggagactttgaaccataaaaaaacaaagtaaaaaaatcttagaaacataatatacatgcatgtttcattttaatgtatatatctaaatgataaatcatttattttgtttgatagagcaaacataaacaatatgagtaaatagattggtctgtacaaaataatcccatcagaaaaataaataatgattatgggttacaattaatcccaccttgataaaaaaacattatttatgatatattgttagtccgtgttaataagcattatagaggtaacaaacagcataaccatgtcagtgtctgatggttgaactagacatcttgcaaaatattatatttaacaacaaaaaatatgaattaaattataaatttcgtagtttagtaataagtttatgcaacaaagaaacttattagaatattaaaaaacggcataataacccatattttcaatccctacattttgtcacgacgttttattgtatagtggttcacttcaatatcttgtatctcatgctatagagagttttagcaaacatatagttcggaagaaagaacaatgtaagaatatgagctatcatgcagcaaaatatgttcaatggtctatctagcttgcattgcattgagagagagagagagagagagagagagtgtgtgtgtgtgtatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattctttttttttttgaaaattcggatcactgcgctgtgttctgcatggtgagtcattttgaatgttctgcatgcatggtttgttacccgcacgcatgcacgaccgagcgaccaagagagtagttagtgtggaggttgttgtattgatactctatttaagttgacggtgatggaggacagaaaatgaggaccacaattatctttcggatttgtgaggaagaagattttgttctgcaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgcgtcgtcgccggtgagtagtagcaag

SEQ ID NO: 19404 - DNA, 1501 bp, Oryza sativa
gtaaaatatgcatttggcgttttaatcctacatggctgcacaacttttgcacattacctctgattttttttttgggaaaagttagtaattatctttaagacaagcttgccatatgaagttttaaagatataacctctattattaaatattgtttatctctggtaaaaaaaatacaagtaatcaatccgcgcactgcgacctcaaagcaaaagttttgcttcttgcctgttctcgcttttcacaaattaaattgagatctaaataaacacccagtgatttggaacatggaaaatatactcatgtatgatggagtttatatgatggctaggagagtgggagagtgccagggttccttgcaagacatattttcccttttgaaacaaaatatatctattttatatagtgcaagatatttattcagcgagttgacagaaattcagtttgctgtgaaggcttccaaatggactaattttgcactttaattaggcatttgtttttatatataaactccttttaacattctttttctgttgttgcttcggagtgacatatctcattctgagctttcagcagggcagttttgctgttatgtaagtgatatattagtgctgcagttgttaaactgttgaagcggcttgatagttctgcaaattgggtagtgtgcctttaaactattaagtctttttttgccttttttgcaagtttagttctttttttatgatattctgcaagatgttaagtcaaatccatgattattattgcacgcaattattttaagccacctcttatatctatattcaggggtatctgtgactacattttttttttgctttagtgcgatattgattacttcacattaaacatgcctactgcatgatatgatttttgtattgtgctattagtattcaatgattctagaatattggagcttggctgctgatattttatttatactagctgtatgatgtgaggtttttccagaacatgctcccacaatttcatcatatatgcctatttattcatgatgctcatgctttgtatatacatagggttctgttcagctttgttacatcttatagtgtataaacagtacgattggttgtacaatgatttaatcgtcagaccaaagggaggttcagtgcactgtaaaggaacattttctgatgcattaggcttaatgtatgtccctgcttagagtattttgtatgttacaggtcttcctcaaaagtgaagacccagcaaattgttgggagttgggaccttagttttcaaagactttgctttgcattgtgtaatgtaatatttttttacaaatatatttgagagttaaactactaatatattacagttcttctctgtttgataatagcagtagtattttaacatgaggcaatatgatgaaaagaggttactgcgtcccaaaatttggtttttagtgtttctaaacgtcttatagcaaaagtagccaaacatgcatgcatactgtggcttgtgcatttga

SEQ ID NO: 19405 - DNA, 1501 bp, Oryza sativa
gaagcgtaataccctactcctgtgttttgggagatctgtgtatgaaggagctacaaagtatgagccagccgctcccttgttctgggttccctatctggaaaatcagtcccctctctcagtgggctaggtcctccttttatatcttaaggggataccacatgcaccatttctctcttttttgtgggacttaccctaccttttcataaatggacggagatttgtatagttgccgtccgagtcatcttctgatgagacgacccacaactacctccactttcgccgggagcaggtgcgacgtggaatcgtggctgtctgctgacgacatgaccggtgtcagacccgtcacgtcggtcattcttgtgcaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgtgttacatgcggcgtgacacgctcagccaaaccgcaataaatgtggttaggtgagccccactgtgctcacctaacccatacacgcggagcaaaaacccacgaggggtcggggtgcctcggccctcggggccgaggcgggtgtggcccgaccccctcggggggactaagaggagggcgaacacatcaccctcgggcccgacgtccctcgggggtgccaggccacgtgtgcgattgtgtctgcctcaaacctctagtcatgatactcctgatcccatgttaccgacagtagcccccggcgttatgccagggcgatcgccctctttaagggaaacggtcgggcgtgacgccactcctaaggcctggtgacaggtgggaccggtctccacaattgggcagaaacccaacggtcacaaaccacgcacatcggcaatggtaactcggctgtcaacaatgagcagtctcttcaagactgccacattacttgagtagcacacgaatcttgacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgcca

SEQ ID NO: 19406 - DNA, 1501 bp, Oryza sativa
  unsure (1)..(1501): unsure at all n locations
caattctgccgcaaataggaggtacactgttaaatgtgaaaacccacggtgcaaatggaaggtccatgcaactaagaggtctagtggtacgtggaggatatcacgggtaggtaaggaacatagttgtcctactcatgttcttgcattcattttcttttaatatatgtcacattggtaactaacggtgaatttattactttttcatataggatggctgaggagggacaaccgccgacttacccagccttggaggcgtactacgaggcccgtcatcgtggggctgcgatcgaggcggggagggtatgaatcggcattgattcacttgtgcataagtgtcggtaacatgagatcaggagtatcatgactagaggtttgaggcagacacaatcgcacacgtggcctggcacccccgagggacatcgggcccgagggtgatgtgttcgccctcctcttagtccccccgagggggtcgggccgcacccgcctcggccccgagggccgaggcaccccgacccctcgtgggtttttgctccgcgtgtatgggttaggtgagcacagntgngcttacctgccttctggaatagggatgggttgagcgtgtcacgccgcatgtaacacagtgcagtgcactcgtttatccggtctatgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtgcacaagaatgaccgacgtgacgggtctgacaccggtcatgtcgtcagcagacagccacgattccacgtcgcacctgctcccggcgaaagtggaggtagttgtgggtcgtctcatcagaagatgactcggacggcaactatacaaatctccgtccatttatgaaaaggtagggtaagtccccacaaaaaagagagaaatggtgcatgtggtatccccttaagatataaaaggaggacctagcccactgagagaggggactgatttttccagatagggaacccagaacaagggagcggctggctcatactttgtagctccttcatacacagatctcccaaaacacaggagtagggtattacgcttctcagcggcccgaacctgtatacatcgcccgtgtcttgtgtgtttcctgtctcgcgaaccttccacatatagagagcttagaatctcaccctgagtccccggccgaaccggcaaaggggggcctacgcggtctcccggtgaggagccccacgctccgtcatctggcgcgccaggtagggggctctgcgagggattttctgagctctcgcactctttcgtgtgcgccaagcttttcctgttcagcccaa

SEQ ID NO: 19407 - DNA, 1501 bp, Oryza sativa
accacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggcgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgccggctcggccattgggctgaacaggaaaagcttggcgcacacgaaagagtgcgagagctcagaaaatccctcgcagagccccctacctgg

SEQ ID NO: 19408 - DNA, 1501 bp, Oryza sativa
ttttgagatgctgatatagataggcacattatgttcctctgcttgttcagaaattctatcttggcaaatttgggacaccagatcgtcagcaggtgacgcagaatgcgaatttgctacacagttcttcagtggcaaatcaaggacaagtctggaactgggatcaaataataatgtatatatcgaattcaacctgtgaagaacaaaaaactgaacataagagctggttaaaatattcaaccaaacagtcgccttgtccgcagataagatgatgtatgattgctgctgttgaatgaactcttcgtgtttgcttgctgtcttatcagccataaccagaaaagtaatttaaaaacttattttaaacttgattttgaaggtcttcttttcaacattggttgtttccctgaattagttttcaaaccattaaaaacaaagatatacaagttgtccataaactgttcatggttttatctttccacggcttatacatcaaacaatcaattacacagactgaacttgtacgtagtaaacggagacaaatcggaggttatgcttatgcttatcagctaaaatttgaattttcaatcttacatttaggggtttttttttatcaaagtttatttttagccttttcttttagatcactaaaagcatgtattatttacaaattatttttcgtttgcaaatataccgtttataagccaaacgatggggcattaactttggggctttaacctatttgccactcttacgagtagtgcttaacgatttgccactaagcccacatgttatagacacatgagagcccacatgtcattgacagggtgtggcaaatcgttaattgtcatgtcacaagagtggcaaatagttaaatttcccgttaacttcaaacaaggtgcttatcgatttttctatatatttgtcgataaattttcttccaaaaatttgacagatgtaattacagtacaatcgtagtgtaattacactgtaactatagtgtaacttatatgtaactttcaaaaatctctacataatatgttattctggtaaaatagaggttgtgggaacaaatccttacacatatgtgtgttgtggttttatttttcttcctcaccaaaacaaatcttatatgaaacttatatacaagttacgctgtagttacgtgcaagttacagtgtaattacactacgattgtactataattacatctgtcaaatttttaggagaaaatttgtcgacaaatgtataggtggtcccggtgcttatactgcgaaaaaaatacgggccgttctgtccgtgtaatgggccttccgggccagaattcggagcccaaatgggcccgtttaatgccttggtggtgaagtcccaactcccacgttgtctcgtctcgtctctcgcaccaactctctctctctctcccttctctctccccgattcctcctccgcctcgccgtcgagatctcgccgcgcccgcgcccgcctccgccggagctctcccgcgcca

SEQ ID NO: 19409 - DNA, 1501 bp, Oryza sativa
ataatcccaggtgctttcgagaagaaaaaaacatcatataaatcccaggtgaggtaaggttacgtgtgtggtggtttgtaatgtagcgttttcaccttgcgagaggttgcagtgtgatgcaacacaaatatatatttttaaaacattttctggcaagtgtgctgctcaggaaatcttctcttttctccatcccgtgctgccgtgcaacgtatgtcaacggacggtgtcaagacaaagattaattagattatgacatgcccatacccgataccaagaggcactcgcttgacctctttaatcgacttgtcttttctcacttgtcctatactgcaatttacgcaagatggaaggtcgttgtaacgtccattgtacttgattttcagtgctgtttgcagaaagccgggtcgataaaatggctgatttctctcttaaggataaaaagaagctagtaaatactatataatggaaaggaatcgatgttaattttgttacagtataagaggacggtaagcaaatgttctgaagagtcgaacgcgagactgccatttgcaccgtgcgcggtctcttgatctctctttttcatgtcgttaatttcgtcaatagattatgacacccgtgccatttcagcgttgacagctgccgacatgtgccatttggttgtaccagtttaatttcgcagctggttggcagctgtaaattttgctgtcaccataaagtccaaccgaataactgatcgaaactacaatatggagacatctcacatcctcttgtagaggggtagaaatgcacggccaactcagaacatccgtgcagcctcaacgagaggcgccgctgctgcaccggagagaattcagtagtgtgtggttttgttgcatttaactactccaaagactaatcctctcttgcatgcaattagtacaattaagtcaatagtgattcaggcaacagctagctagcagatataaagacggttctctgttcttggctgttttcttccaaccgtctcatcccgctgttatgctaatccaggaatagaccgaaattaattaaggcagtaatcacccagatgtgaaaaagaaaccaactgttccaacttccaagtggtctgttttggatcgaacagtgattggatcatgagctatgaccctttgaaaacttaatcattaaaaataattaaaaaagaaaaaaaacacaagtgtcaaggaattcagatttggcgcctcttttcatcgccatctttgaccgcgcaaacgccgtcgttcgcgaactcccccctcttaaagcccccaaccccctcgtctcgccactcgccacgacgcgacgcgacgcgacacgggagcaagcagcgcgcgcgcgctactccgaaccgaaggcccacgcggcgccatgctgctgggtgccatgagcggcggcggcgtcgtcgtcgccgtcgccgtcgcctacgccgccctggccgtggtggcgctgcggatggcgctgtcgtacaagtcggcgctgtacg

SEQ ID NO: 19410 - DNA, 1501 bp, Oryza sativa
atttctatatggactctgtcttttctttttctccgattaatgtgagaatttctagaccatgagagcgaacttggaggttcttttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctatttctttaataatataatagatcgttttactgtagacttgctcgatggttgctaaatgcactgacagtgatacagtacaaaccatactatattttagatagaaagttagggctaagcaatgaatgggttgtcaggttttgctgctgtcaattttcttcagcaagctctcccttagcctgttcaatttcaatggcatgcaagcagcttcgtatgtcagaaacgatgcaaacaaaatgctcgacggggacggtggtggaggcggcagtgcaggcgtcggaagaggcgagtgagacgaaggcggcgagggcggacgagtcatcgagggcggctaaggtggcgagtgcgaggagagagggcagcttgggttagtgagtctaaaagatgattatacccctctgtaaataattttccctggacaataatacccttctatgattcaactaccattaagtgaggtggtagtagaaataaatatgaaccattcgatcaaatgaaattaatggttcagattattttctactaccagtagagagcatatcggagtgggactcaaagagtagtggagtttcttttaaaatttggacctctcccgatgaaagcgacaacgaataaagccattactgtatattagcagtgcgtataatttcgattaggaccatgaggtggagtaatgaccaatactctgatcctaagctgagaaatcaatgtatgtgagcagaataagttcttgcatgcagaaacagctcgtgattagcagat

SEQ ID NO: 19411 - DNA, 1501 bp, Oryza sativa
ttaaggatatctgtatcgtataatttatatcattacgttgtatcttagtatactattttatctctgtggtatgttgggaataaggttcaaataaaagtttatgtgtcttttcaagtgttaaccaccccgtagcatgtcttcgtcatttctttgtgtggttgtactgcatacatatgtatccccactgttcatgacaaaaggcatcttggttttttttcacaattttgcagcccaatgattgtcttagtacctgtgctaaggacgaattatcaagtaaatatagtagttatcatatgacattcaaataagaaagataatatatgcaattgataattgtattacatcttgactctgagactaagataaagaaaatccccttgtaacccatttgtaacccatttacttatgcctctctatatactcgtgttgcacaccatcttcacatgaaggtccttattggttggcaatatctcattaattattagctcctaacaaataatttgaaagtaaaacttttatctatatgtgagtatgtccttaacgaccttaaaactaatgttgaaaacgaactacgctgaaagtattctaaaaacaacctcaaaatcaagtactaaattttaaattttggcaatgctttattttttataagggaaacaataagatcatagaactattaaaaacacatacaactcgacggccacataaataacagacgcatcgtcttctccgaatgcaaatgttctgcattcaaggcattcaagccaaccagactttctctgcatgcaaccaaacttcctctgcatgcaatgttttgcactaattatttatgaaatttcttcaaatcaattatgcgcttatcaattataaattagaggaaatacatatttttaaaaaagtaattcgataggtggccaatattcttggatcaactagtaaattacttatacacagaaatatcctttttaaggtacacggaaaatatttgacactgaaaagagaaaaggggtagtaaggcaacgaacccacaaagccgatgggcacagaggatccgcggtcgtcgggagcagagcaggctagcgtgtgccgctgcggctaccaagccggtaccacggccgaggacggctcgtacaaaaacggacggactcgccgcttcgcgggcccaccttcagccaccgtacgatccaaaccagcctcatttactaccaccctcgctggggttggtttgctgccgacatacgtgggcctacgatcctagatgggccggccccactttgacagctactcctactctcatgggcctagtacccaaccaggccaccagcccaacttatatcagaagacaagtccaccccatagcatcatcgtctccgcggaaccacgcctcgtcgccgccgccgccgccgccgccgccgcgcgacgtcctagcttcccggaccgcctccgcgtggttggatccggcgagaggggagaactgttgtgttccttggaagcgggagctgga

SEQ ID NO: 19412 - DNA, 634 bp, Oryza sativa
cacccacaaaacccatggatacccccctaagccctcccttcaattttttcatcatagttgataagataggaggtgctaaaggtcttataatagcattttagcatagtttaatactgagattatgtgtttatatcaatgtactcggtatgttgagtccccccaactttttgtttctggatccgcccctggtgtggatcaaggccggccggtgactcaaggcatgccaagagtgcaacacaagttatccacagtatcgtgtacgtgaaaccagatgtgcaatattacgcgacgtgaggcaaaaggggactgatctaatccagtggcggagccaccgtgattcccgggtattcccgggaatacccaacattttttatcagaaaacaagtatacttctagtatatacacatgtacacatatttgtacacctaaatcctcaactctttgatccaaacatagcacaactggtctcttgcgatgcctccaaccaacccgacctactccgtcatgacccatcaaacatcagttgacccacttagctagcactctttcagacagccccctctcgctctccctccgtgacccatccctccttggctcggctccctcgcgccactccccatttgcaaaccctagg

SEQ ID NO: 19413 - DNA, 1501 bp, Oryza sativa
attttgaaggaagttagtcaaagttccaaactcttgggaaaaatccattgagtctatctctttcaagtgattcttgtattttttctgcggtctactcaaactattgctcctgtatatttttttcgtgcgttatgcaattctgtaatttgcacttgcattttaattgatatctcgtatgttttatttcttcgttttttcaatgctacgtttcaaaagaatccctaattattctttcagagaaaaaaaaaatcacattcactccatctgccggcatcgatcacttacctaggcctaggagtacgtactcctacattataagtatgtgacagctaccaacttggcaaatgacaagtgtgatttgtagctagccttccctttatgctttcgaaggatagctgcctctgatcaaatttggtccattctctgatgattggattctgcataaagtactggctgtacagcatcactctaaagtctggagtaaactctaaactcatctgccaatataaaagtaggcagcgtgagaacacacactgcaatagccgtgagcaatcaacatggcaacagaggtgtggttccgttcgtgcgtcgtgtgcagaaatccatgtctacgtatgtaaataaatgattaaatagctgaatgaatcattgaataataaaaattgtttttttaaataatgaaaatattttacatcctggccttgtctatatataagacccacaacctttggtacaaatgaattaattaagaaaaatatatttaaaatagtttttaataaaaaaacgtatatagaaaattttatttaaaaatgtaccttttggaattttaggtagagtggttattcatcaatttgtatgttacaagtagaaaaagacatgcagctactaaggtcctgttagcacgtttttttaaattgttaaatgatgttttttgcaaaaaaaaatttatatataagttgttttaaaaagcaacttaaccctttttcaagtttatatttgttaatatttaattatgaaaaattttcttccaaaccaagccgaagaacgtggccttattaaggagagatgagcaaatgtgcacattttgttgggccaaaaagatgagccccgtgggcaatcttggcctcttgggccatccaatatggcgaggtataagtctattcgagtccgtcatgccttgctcctgactgattcatcttcctcaaccaaacgcggtataacaccctcctccatcttcataaaccggcataaatcacctccttcaatggattaggaaatggtttatgttgacgtgacaagttgggtgggacccacatgttagtgaccttcacctcatctcatctttctcctcacatctaaacgagtcaagtgtagtcaacttgctacatcagaaaaaaaaccacttctcaaatcatcaaaggaggcgatttacaccagttttcgaaaatgaagatgttatacctggtattgcggttgtgagggaaacgattcaatcacgagc

SEQ ID NO: 19414 - DNA, 1501 bp, Oryza sativa
caagaattcacaccaaaatattccacgaacgttttgaaaaaaccaaactgacacaggagacgatggaacttacaaacgatatgactacttttcatggaatcggatttttttttcttgaaatcaggtactttttttttttcattgcacagtgccgaaccggattattttataagcgcgggttttttttcacattgggtcagatagttttcttcagagcggtatttttataaatgactttttttttctcgcgtggggtcgaacggttttttcgatccactttttctcgtgtggattcggacttctttaatctttttttatatacaacgatttttatctcacattaagtcggacgttttctataactggtatttttataaacgacagtttttctcctcgtgttgagtcaggtgatttttacgaacagattttcttataatggcgtttttctcgctttagggtctgatttttttttccttttttaagatgatggaaacttgcccatgtgttacaataggtaaaggctttttttccagtagtacatcaactattaggagttgaggaataaattgaaaaagccttgtgtcctacctcccttcgctcggcctgcttccggatcatcccatcaaatattcttgatcactgaaaatttattgagtgattttgatccacttgatctcctcattctattttttgcaaaatcggaacgaaactgcaatacttgggattgggaaaaatcatcggtcggccatcattgacaaccgttaaatggagattaaattcggtgaattaaaaccaaattgaaaggggaaattgggaaaggatgaggacggaatagagaatcgatttttggaattaattagatgagaaaatgtatgggtagagcgttttgacctttttttttttatggactttgaattaggactttttttttacggacgagaagtccttcctttttttatacggacaagaagtcctttttctaaggaatcaaacgtttttttaaggggagccagacattcttttccttttttttaacagaatttttttctcgccgtttttttagttttatacggacggcggaaacatcttttattttgtaagtagtagagaagatatttacaataccaaattaatttcatcaatatattttgataatatgtttattttatattaaaatactactatatcacccttttttataaatttaattaaactttaattttttgacttggataaaaatcaaatgacttgtaatataaaacagaaagagtagcacgctttcctaactcacctccccattttccacgtgcacgcttttcaaactactaatccaaagaaattctttacaaaagatgctttaaaaaatcatattaatatattttttataaaaaatagtaaatacttaattaattataagaaaatgcgtcgcacagtttttgtttttgtggtggtcaacctctaatggcgctacacctacactcactcgcgtaagtacagcgcc

SEQ ID NO: 19415 - DNA, 228 bp, Oryza sativa
agtgcattatgtttaacatgctgatcaaagagttttactaaaggaattatggtctaattttagtgaaggtgcaaagtagactaagtggtatgctagctattttcagacttagttaagtggtagttcgagtttaaattttttttgtggttggttgtatcgtgatcctaagtgtgaaaaaacatccgaaaaaataaaataaaaatgacaccgttgcaactctatatagag

SEQ ID NO: 19416 - DNA, 1501 bp, Oryza sativa
actgacatgtgggccccactttttccttggtagggcccacccccgcgtcgccagtcgccactgccattcaaagctcgcacccgctcgcgagagaagaagagagaaaagagaggagagagagaggcaaacccgcaccaaaatctctctctctcccccagatttgcgccacattttcctcgccgaatcagcctcgccgccgtgggtgcagctgccgcgggatcccggcgagcgagcgccatttgagccggctgccggcgggtttgcgttctggaagctccttggtaagacctctagctccctctcctgttttctctgtgcgttttttcttttttagtttctctctctctttttcttttgtgtgtgttttttgtttgttcatctttctacttactgcttttgaatggctggacgattgggaggcagattggcagaaggttatattttttttctctctctctgtttattttgctagtatgagtctgctatagtgcattatttgatgaaaatttaagcaaattatatatatttttgaaacaagaattgtataaggaaattagtacggaattgcactcgcatttgcgtggagtggcgaggtggttagcgcaggagtatatactagcaatgatttgccaacgaacctactagaaaacatgtcccgatagtgaattgaattcatgcgcctttacttcagttttaattttcgtacgagtgccgtgtagccagaagcccagaagaactgtgcatgaattgaatagctctgctatgtctaagcttaagtttacccatgaattctgaactgtgttgtttagtttcatttgtaataaaattgcaaaggtctttcagctccaaattatttttgttgttcgcaagattagagtaactactattttttggctgatgccagctacaatgtttgaaaatttccaactgtacttgatgctacctggtgattggttaaccttttgttccccaccgatcactttaatcatacatgaacgtcctttttccctattccactgacaaatttgcactagtagtttatagctttaccatctggtactactaactgtccttcatagtggaatttaagtgtaacaattacttggtctgtagcctccaatacagatttgtaactttgagtttagtgaccagtattgtttatacttcaatacttgcgacgcatgaggtttggttaattggtttggtggtagcacttgtgtgcagctagatgatactatgatatccagcacttattttgtttgaaaccgaccagcacttgcttttgtcttatatttttattatctatggacactgcattttatttgtactctttcctttttatttttttgatggtgttgacttcccctaatgattatggatgcacattttaaacaaactataattatcgagcatttcaactaatgataatttactgtggccagctgtaaactattgaggggtaaagcctgctatttagtcaaggttgagggtgctgtataaa

SEQ ID NO: 19417 - DNA, 1501 bp, Oryza sativa
gcttatgttgtttcggactgtaaatttagtctatttgtgaaattagggcttgtttctatatgcagggatcagaatctatccatttggatggccagggattttaactgcagttttctatatctatccaaagggattggatctagtccccttccactcaagcaaagccatagtggttatttacccgttacctttcacatcagagaatcagcattactgtagattcgttaacgttatcttaagattattttggccagccatctatggaaatttggggcttgttcttttcatattgattgggattgatataacagtaaattatatagcagtacactgggggaactcacgtgtttttctctagtggtagtattcatttttcttagactttgctaaagaacaaactaagcatgggttttcttttgaaactaagcaacattaccttagctagtgttctattcttacaaggttacgcgctatatgttattttagcattctatatagagtatagatttcatgtgaccaagtgaatgttcagtattttgaagtacatgaatttattgtgatattgttgatatttgagttatcgcaattgtcatggaggaattccctgttttccctgtatgttaatattgcccacatgttattttcacagttgaggtttgagtttgaaagttgtccacttgttgccattattaaaagatggacattttaagaaaagttgtctcccaaacaatggtatttactgctggctataccacttatattaacaggctcatagtgcctgcatccagacaatcttgcaggttatatctgtacctggttttacatgctgatttggccaaaaaattcttggagtttttaatatgattttgtgctaattatgaacaccactataataagtctatctaagtttcatttatctcttataactaagtatgtaattaatactctgtcattcaaagaattatcatgagttgcccgttaccttggagcttcaacagtcgagtcctatgctttctctatataccctatgggatgagccagagaccaacactacaaaataagttagcaaattagtactccctccttcttccacaaaaagttacacctattacttttgtcaccaagaccaaagagaaattaactcatcttgcatataacaaagatcaagaagtgtatgcacgcatgcaaccaatgagtattacgatggctccttgggttttaatcaaacatttaatttacctctccatttaagttttggatgcatagacactacaaataggaacaacttatttggaaaaaaaactcaaatatgaaataggtctaactcttgtggatggagtataattttagttctcaagcactaatagaggctttgagctggattttatacccttcagacatggacaatagcgttctgctttggattggctcatgtagttttaaggtttttttcctttctacgtagagatacaaatttccatgcttactataatgagatcat

SEQ ID NO: 19418 - DNA, 1501 bp, Oryza sativa
taagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttacaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatacatatatatatatatatatatatatatatacatatatatatatatatatatatatatatatatatgtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtataaatcaaattattataactaggtatatactaataatttgaaaattttgaaaaatttgagtgattttgtgcatttgataccatggtgcccatatatggtttcgcggacaagttgaggtaccttaggtgtactttttccttctgtctccaccctcatccagcgatccaaagcccaacaca

SEQ ID NO: 19419 - DNA, 1501 bp, Oryza sativa
caacgcacgtgcgagggggaggaggaggaggaggaggaggaggagcggctgagaggagatgggccgaggagaaaatggcccacaaaaatccgagggaggcataatagactttttcggaggagattgattcgaagagaatttgaacttggaatttgacttagattttggaattgggatctggatgagaggaaggagtagacggaggattcaagatggggttttggatattttggatctggggaagtatttggcgatgattcaaagagagggatagaatttcagagtttgatttggagacttgagttggaagaggaatttcgaggaggcaatttttgatggtgacgagagggatcaaggacggatttgaattgagatcttggcacaacttagactcgcccacaaagaacggaaattttcgcatataagattttgccaaattagtttttaacgtctcacgaaaagcggagcgttacaactgtcctctcaagcctacaacatgcaaccttcataagctaaaaaaaaactatccagagtttgacacgtagaggctgttcagattatagccaatataaatcttaccaaataccaaaattttagtaagttgataatatcatcaaaattttagcatgatttcttatgtatttgccaaagtttggcaaaaaaaaaacctaaatatataggcatatctttaacaactttgccaaaaaaaattgtatggtttaaaatggcatcaatttgaacagccttgtacacatatccggattctggagttaaataagcaatacttccttttaaaatataaatagtttcattttagaacggggaagtagtaaagtagtgtcctatagaaaataaatctaggactggatatgatatattctagtgttacgaatctggacatatgtatgtctataagtattaggatgtgtcacatatgatattatgttggttttttacgggacggagggagtatatctcaatataatcagtttacttattgcatattgattgattgcctcgtcatgtcgatcatgttcaagtgattcgatccccaaaccgtgatctatagaacgttgcttgtgatctgactagcagcagcgtgcaaaggataactatatgaggacgacgtagtagcagcagcaacagcactgacgcgtgatccgtcaaattgcgtgggaaatcgatgtgaaccacaaggaatgcgagagatcttttttcagccaaagctgtccacttgcacggcgaaagccgtaaaccaaggcgctgccacgccaggtcggcgcactaagttcactgctgtagcctcgcgcgagatcccatttaggtctaccaaaccgtttggcgtaaagttatcatcaccctacactacagtttaacggttaaggtatataccgtgattttgaaaactgaaaaggttacagcgcatgataatcgcgtggtaaccgtacggtgttttatcaaccttggatctcatccatctcatgatcacctacgcctcagc

SEQ ID NO: 19420 - DNA, 1501 bp, Oryza sativa
tgatctccgtgtgcccttgttcttcgccagtacaccgtactgacaggcacgttatcccgcacaacccaaccgctgtgacgtacatagttcttggtggcttcggctggggcactaggacgtccatcttcttccacttccgttatgatgtgccgacccttaagcttcttcgctgcacctcgttgcccgcgtgccctcttctgtccaacggagggttgactaccactagcctcctcctcctggttcccctccacatccctttccacgtgcccctgctggttcccctccgcattcctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgttaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttacaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaaca

SEQ ID NO: 19421 - DNA, 952 bp, Oryza sativa
gggctcatccccgcggagtcccatgccccgtcgggtggtggagacttgtggcgtagacggtgagtttcccctttttcgtacgcacctttcccctccacgatggattatagggtttaggccttcgggggtggtgtgtgatttgggggcgaattttgcggatgcgcatttcgtgctggtttcgagacggtgcgcgcgcgtgtgcctatgggatttgtgttgatctgtgcttattccttttgcagttcacttgccgatgtgtacgatttactcctgtgtgtatgatttactgattggatgcgctattcgttataagcggggaaattgcggttgattctggtggatgcgtgtttcttccttattagtggcttactgcactagtacactacacttagatttatgtgtgattcatgtgtaattgtggcataatttgcacttcttactccgcctgtagaacgcaccgattagatgactctttagaatttgctgataaagaattactgagctctgagcagtggacgtagttctgtaaattaagaaatgttaggcatctttttgtcagtggcatatacggacacactcaaagtcaatacttgtattgtcttgaccaaataaggatctaagccattcattatatcctatgcaattaactaaaactaatgccttattgggttatgcacatgcaattattcctagagataaagggtgctgctgcttgcacttctgctcatatattcttttttcttcttttgcctagatacactttcgatattatcttttttagctgttttcttcaccatgattcatactgttatttgaattgtggtaagttgatccaaaatactttttaatggccaagctgctttccatatttcaggatgttatataaccatcaaaccagataacactcagtttagcactcaagcagccgtatagtgacttagtgcaagaagca

SEQ ID NO: 19422 - DNA, 1501 bp, Oryza sativa
tattttatacatgttttaagtataactgtttgcttatatactagtaaaccctctatgcctgcagcacgattcgccttagctgaaatcaaagatagcattttgtcgcaatatcatctatataaactctactatatatgagccatcaggacactagatacatctgaacaaattacgaatttgataatgtgattgattcgtactgtatgtcgagcatccctttgttgcttgtgcttttgttagtactgcttctaaacattgattaatggtaaaatgctgacaagtttgtttgtctcttttcagtttgggctgatgcagatacttggttcgagaggcagcagcaggaagaagaaatgcaacgccttcaggcagagcagcgtgcagcgatgcaggcagcagagaagctgcacagggagaaattggctgcagaaaaagaaggggagaaagaagaggagactgataccaatgcagaccccatggctgcagcagaagctcaggccttgaaacagagctcttaaatccttgtgtattaatgttagaacaggtagtactgcaggcatgtccatttgtcaaatgcatgctattctaaatccgtcggtgcaactaacatgctattctctgcggacttgctaagctagttgttaagttggagctttctgttcatactgcctgtgtaccactagtaacatggattttggggctatgaaaaattgatttgtgtttagctgtactgtcacattcacaggtgatttgcatgtcgtcttattctctgtacatgtatttgatagtttctcttgcaactttacaagtcaccgaaacttccaccgtcgccttatacctgtcgctaaatcaaatactagttaattcatccgtctgtaccttcaaagattatcataaaattagattacccatacacccattcagaaaaaagaaaagaaaagaaaaaactgggcaagtgtagattcatttctaccacagtaccagttgcataaagggccgcataccatcttattaccatttaagtgaaaaatatgtattgatcggtagtacacttgttatcatgacatctcaaaaacaagagtagtagtctggacctcatcagattggaggaccagtagtcgtttgatgctcggccaacatagatcccatcttcctgcacgctcgcatcatggaacattaattttttcaaaaaaaaaaaagggacattggattcaactactagcagcactactggtaggtgcttcttcgttcagaacaataattcacacaaagatatttaatgaaccgttaaggtataaactagtagtgactctgtttttatttttactacttgaagatttaccctaaaaacgcgatttatggttattgatactcagctttgatcatcattgcatttctattttttttataataatactgtcgatgtttgatgtcgcgattccggtatttgcatagtatggggatcgttggtactagagtatacgcgaaattgaggtaaaagaga

SEQ ID NO: 19423 - DNA, 1501 bp, Oryza sativa
atttggaccatagattaatcatttaagcactaactaagtgaggataaactatataagtatataggatatcataaaacataataaaaatatacattgaaatattatgtgaattatctaggatgataatttaaaatgcttatattttaaaagctcttaaattataaaaactataaaattatactcactatgtttctaaatatttgacgccgttgactttttagcacatgtttgaccgttcgtcttattcaaaaacttttgtgaaatatgtaaaactatatgtatgcatataagtatatttaacaatgaatcaaatgatagaaaaagaattaattcacatatttaattcttttttaataagacgaacggtgaaacatatttaaaaaagtcaacggcgttaattatttagaaacggagggagtagataatatagcatgtttgcataatgtttaaatgtgattattgttagtggatgatgatgtgacatcttgttaatggatgatgatgtggtatttttgcatgttaagtttaaggagttagtgggttataactttatagtaagataggatacttatataatatatatttaaataaaacctaaaaattacaatgataagaaatacaattttttcagcatttgatgtttcttttaattctgtaacaaagtaaaaaaaaaacaaaagttcaaagtaacattctgtcagtctttaaaaaaggaagttctgatacggagtactactccggggagtaatgctgtttttggtccagagaagcccaaagcgtaagccgaaacgagactgggggtacggaaaagcccatatcgcgaacaacatcgcggcggaacgggctcgccttctccttccccttctcctgtcctgtctccttcgcccgcgccgcgccgcctgcgccgatctccatcccggcgagcaccgctgccggcctcctctgctgcttccgccgcacactctcctctctgactccttgtccccccctccccccgggcttcggctcccgtctccacgagagtccgccagccgcctgcgctgatctccatcccgccgtcgccgccgccgccgccgccgccgctgacggagatatgaaccagccggtgcagaagaacacgctctatgtaggtacgtgccagtcgtgccacgagctccaagctagagctctcctcacccgtcttcttctttctcttctgtttttcttttccacgcctgccacctgctcgacgaaattcctccttcacggggttatcttttttcctggccgccggcggagtagcagtgtggtagtgagctgagctgaacccgtgcctcgtttcttggtttttgtggtgccgcaggtgggctggcggaggaggtggacgagaagatcctgcacgcggcgttcgtgcccttcggggagatcaaggacgtcaagacgccgctcgaccaggccacgcagaagcaccgctccttcggcttcgtcaccttcctcgagcgggaggacgccgccgccgcca

SEQ ID NO: 19424 - DNA, 1501 bp, Oryza sativa
gagaagtccatgggggtgggctcccccgggcaccgctcctcctcgccttccatcggatccgcgagttgctgctgctgctgcttcggctgcggcggcggcggcgagcgagcgagctaggctagggtggcgatttggttgggggagagatggatggaaatggggatcgatttggtgtgcttcttcttcttgttgcctctttgtgccccgcggtccgaattcgaactgcggatagcaacggcgaccgttgtgtgcttttgtttgtgtgtgggcatcctaccgttgcatacggtgcgctgcgcgggccggcctacccgcacatatgaggcccaattaatctgcttttcaccggatgtaataagtctattttgtgctcctcgttttcttgctcgtgattgaatcgtttccctcacaaccgcaataccaggtataacatcttcattttcgaaaactggtgtaaatcgcctcctttgatgatttgagaagtggttttttttctgatgtagcaagttgactacacttgactcgtttagatgtgaggagaaagatgagatgaggtgaaggtcactaacatgtgggtcccacccaacttgtcacgtcaacataaaccatttcctaatccattgaaggaggtgatttatgccggtttatgaagatggaggagggtgttataccgcgtttggttgaggaagatgaatcagtcaggagcaaggcatgacggactcgaatagacttatacctcgccatattggatggcccaagaggccaagattgcccacggggctcatctttttggcccaacaaaatgtgcacatttgctcatctctccttaataaggccacgttcttcggcttggtttggaagaaaatttttcataattaaatattaacaaatataaacttgaaaaagggttaagttgctttttaaaacaacttatatataaatttttttttgcaaaaaacatcatttaacaatttaaaaaaacgtgctaacaggaccttagtagctgcatgtctttttctacttgtaacatacaaattgatgaataaccactctacctaaaattccaaaaggtacatttttaaataaaattttctatatacgtttttttattaaaaactattttaaatatatttttcttaattaattcatttgtaccaaaggttgtgggtcttatatatagacaaggccaggatgtaaaatattttcattatttaaaaaaacaatttttattattcaatgattcattcagctatttaatcatttatttacatacgtagacatggatttctgcacacgacgcacgaacggaaccacacctctgttgccatgttgattgctcacggctattgcagtgtgtgttctcacgctgcctacttttatattggcagatgagtttagagtttactccagactttagagtgatgctgtacagccagtactttatgcagaatccaatcatcagagaatggaccaaatttgatcagaggcagctatccttcga

SEQ ID NO: 19425 - DNA, 1501 bp, Oryza sativa; identical to SEQ ID NO: 19057

SEQ ID NO: 19426 - DNA, 432 bp, Oryza sativa
tgaaaattgaacaatttgaattgcaaacccaaatgtgagctgatgaaataggaatatgcctgcatttgttgaagtgttttggttcaagtacggtttgtaaaatggttgtcttcttttgctgtcattgacatgtaaactagtaatactgtccacggtaaatagtgggcgtgcaattcttagcactctagcagcactgaaccaaacataatatctgatttctttttctatcattgttccttttggttagatagtatattttattgagagtaaggatttattataatttggttagcctgacttacatttactttggaaaaaatgccttgaagttatttacttgaattttatggataatacttttattatattgttttcaacttgttggagatcatgtcttactaattgatcgtttctgtctatttcttctacagg

SEQ ID NO: 19427 - DNA, 1501 bp, Oryza sativa
gaacatcagagaagccgggccatgtgagcagcatttcagtttatctttcagcaatgaattaaaagaaaaaacgagatttggagggagagacgtctctccaaacatttttttaaaaaagaaattgttagcatgttggggattgaacacggctgtcagcagtgaattgtggagcctcaggtacactctttcactcaaaattcaacaatgcggaaccacctatttccttttccctctaggttgttcgcttacaagttcgtggtcagggctccagaatcgtcaagctaggatagattctaccgcatggtgcaaacaaaagatttggccgaagagaatgccccaaagttttgtcactttctgaatcgcttgaacaaaacgagcgctagtacagcacagaccacgaacataagaacgaatcgggacagatttgtacaaccagtggctgtatcatcgcgctctccttgaccagttcatctaaattgcgtgggaaagggggcaaaaaaagatgaactttttagggatcgacacactcactccccaagaaacagacaaactgcgaactgctacaacttcacgggcaaaagagcaattgaagacagtaagatttcaaagaagtagggaaggtaataagggacgatcattacctatggatggatggatggattggatccggtttcttgcttggtgctgctgtctcagctccaacaagttcttggtgttcttggctccttcctatccttttgcttgctttctgcctgtctggttggagtgttgtgggtcacaggaagagagagagagggttccagaatgcagcagagaggtaggggaacgatgagctgtctcggtcccagcaccctactacaccaacatactcctacgtggagcaacatggctgaacctgcactactactgttaacagtgttattactgtgctacaagagcattttagaaattattatgaccaaaatttgaaagaccgagtgaatctttatcgaaatgttaaatactaagcatttttaagtattcaaattttatacccaaaataaacattcctatgagaccgattctcatacatggaaatcaagcgttttcagccaatgggctgctgaggaggagaatccacgtaatcaaaattcaaaatttaactaataaaataactttaaaaaagaataaaaattaattttaagtacttgcaaaacataaaatgctccggaggaacggacgggatattcatgaccgtagtaaaaatttctctgtttatttcttggtctaccacggtataaacagaagagtatagaaaaaaaaatccggcccagtaggatggcccaaagagtacgcttacctgggccgggcctcctagcaccgcgtctgacagttgggcccacacaaaaccggatttcgctgacaagttaagggacctcaagtgaacttattccgattaattaagcgacggcttcctcctcaactagagacgcccacagcagcagcagcacgccgcgcgcga

SEQ ID NO: 19428 - DNA, 1501 bp, Oryza sativa
atagcagtagtgatgcctattggtctgcatttgagtattgccagaagcagtcatattccttcattgttttgacgtaataggaacgaatatattgatgcttcttcttaaaaccattggtaccaaccaattttcccaactgttgaaaatttcccatcctattccaagccaggatcatcagataatgttgtctagtagtagtagcacaactgttatgcccaaatacaaaatacatttttgttttgttggcttgaccaatagtttttcgaactgcggttgctgtctcatccttaatcagctgattagctacattttttttttgactgaaaaaggtagagagcttttttttttttagctacatttcttcaacgattatggtagccgcaattctgaaattccttttggagatcaatagttgactgctatgggaaaaataaaatattcagaatatgctataaatccttgaaaattaagtaacctttggatcgccaattagacgagcaggacggaggagtggcatcgccgtccggcgccgccattgttgccgacgtctccagatccagccagggctattgcggccacttgccaccgccggccgagctcggcttcatggcggacggcatcaatcgctgccaaatcaggggagttggaggcagagcactagcctactagggcgcccaccaccggagcgccgccgccgtccgccgcccgccgacgagcagctcgccaacgccggcgaagtgggaaggagggcccgctggtagatgggctggtccgaacggagtttgcgcgtggtccttttcctatgagaaagtccattgctcatccctcatcgatgggccgagtcttattatctctctctttttttttttttttgccgggtcagccaaagaccggtgaccgaatttcattaagatttgaggggagaaaaagaaaagccgagtcggggggcatcggacggcacgggcttgtcgcggaggacgtgatgagtcttattctcatctctctcaactacaaaactaggtatataacctctctttaacatttaaaattggctcgtttttccttcctagacgatttcagtgacggttttattgtacgtgatgcctacatggcacgttggcatggtattgatacatatgttaactcagggtaatcttcaggatttgaggttccgaatgcaagcaccttgaagaagtaccaataagcctctcgtgacagaaacttcacatgaagagatcgagtttgttccaagctttgcgatcttgtctgatgggcttgtgattatgattttgcttccagctgaaatgcaacttcgtgaagaagagtacatccttctccatttgtcgtcatcaacatcctcaactagctcaacgatgaccaacaatctttcgcaaccggaatggcagctgaccagctaacaacttttctgaaattccttttttgtgctatagattctttacaattaagtacctcgatcacgagcgagaacaccttacaatct

SEQ ID NO: 19429 - DNA, 1501 bp, Oryza sativa
tacaaaatcacttaggttctgctcggctgcactacaatgcagcccttgctgctgcagctacagacacatagtactattcgaattggctgtaccacagttgaagcatgtgcagccgaacagggccttaatgattgttcggtagctcttaatagcagttgtctagactgtgttgcacatccaaccgttcagtggcagcgatttaggctaggctgcattttgaataaaattaaatacaatacttttacatatgcatatggtttgtgttggttgtagcccattgctggctgactaatatagccactatagctattgctgcagcgctgcagcagttagctcttttgaataaacccaatgtgataatgtacataaacatgtattgcatcattactagctcttcttttaatcctactcaatgtgcaggaaagtaaagccaaactgtggaaagaaaaagaagtatagtagatccttttcataacaacacaaaagcaacaaaataaagccaaactgtggaaacaaaaagagggagaatcagcaagcatctcggactcaggggcaccaaagtgaataggacatttttccggggagtagaatgaaagcagagcggaggagagcacggagcagcctcgaccgttgtagaactgtctagaagcagcaagcgacgacccaacgctttgtcgtgggcgctataaggctcttcgggccgtgggccgataggagtatgggccccaatctaatatgggcaacatgggcgccatatagcggttcggcccgtgggctgatcgatatgggctccaatctaatatggcccaaattaaaaaaaggagtaaaatcgccgttgccggggatcgaacccgggtcacccgcgtgacaggcgggaatactcaccactatactacaacgaccttgcttgattatgtaatatatcaattttaaattaaccgttaatcatttattcacagtgtagtttatacttcataaacagatgattacgaagagtaaattgcatttttgtacaggatgaaggtaaaaatactaatagttcgaccggcatggagtgtaatttattccaaggtttcactaagaggtatgatcaatcaccatgcttagatccaaacaaaagtttactatgtctagttgaaacagggtacgttgtaatgttgtagaatccggcaataaataaattagattaaacactgtcggttgtggctgtctggtggttccatcatctccagatcgaccagcatcccagcaacacaaagcaagtattattattattattcagttcgtcggtaggtgcaagtcaaacggcaacgcgcgcattgcaaaaacaatcggagtaatggggtgtcatctgctgatttgcacgatgagaactacctcctattctcaaagcaataaaaggcagcctgaatcagaagaagaagaagaagaagaagcagagattaatcaagaggaaagaactaatggtagatagatcataatcatatatcatattcaggca

SEQ ID NO: 19430 - DNA, 1501 bp, Oryza sativa
attatactgaaggccttccttacaatttcaacctcaacctacaggaagggcgatacgatctgttgttaattgaccaaaaaggttctacaatatgccaccatgaaaataatctccaccaaagaaaataagatgaacccataaataatcactttcgatgtgtcgcaaaaatgatagcttcattcacccaccttctgctaatcattctcgagattctatgatgaagtcaactttagatgccagcctcaaaagagtatagacaccagcaacagcaatagctttctccactgcatcctagcaagaaagcaaacaactaactgaattagcagtggattacaaaagaaagtagtgcaactaagacaataatgcagttcataaaagtgccagaagtatatgaactgacactgctaaatgctgacacagggaatttgacggctgatgaacaatacatgcaccacgagtgatggattgaagatctaaaaagaacattcaccttctgatatggactatagtgggtaccaaccataacacttccattgcattcaaagcatcttccacccaaaatttcttctcctttgagctcactttcagcctgcatgccaatcgtagtaataagtgcaagcaggaagatcagaaattgagaaatatagatacagaatctgactgaaagagtgtaggggggggggggggttagagtgtatctccacttgactattcacattacatagagttgtattcttgaaagaaaaaaacagtatatagatgttgaagctcatatcacctccaattggaaagtgatatcatccaggttttcttgcagtctccatactccgatacacttccaatcttattggccacaaggactggattgaaacagtgtcctgatcaatattaccagcaattaacagaactggatgcccacattttatgccattttccagaatactgatatctgcgactaagcaattggaagataataccagttagacgataatatcgtagttttcatgctcaactgatctatttttcactaactattacaaactatggagaataacccaatcaaactgcctaccatcaccaacagaggttattttcagcacataaccatgctcatagcctctgatcatgttgccaatcctatatacattgtgacatcagcaagcacattgtttcggacctgcaacaccaccagattccgataaactgaatacaattttttgtttctacaaagtagatacgagtactagagcaggataacagaatcattcataagttcacaggataacagaagaggcataaagccatctggaacagatcgacttaaattaagtgctgatgcagcacatagtgtaagcctcatactagacctaaaaccaggctggcatcaagtatgccggaagtagtcacatttgcctcacggaattaagggagtacttgggcagcaaaagttagacgattggcataaaaatatacctttaactagaggtacagatttattggt

SEQ ID NO: 19431 - DNA, 1501 bp, Oryza sativa
ggaaaaacgagccaattttaaatgttaaagagaggttatatacctagttttgtagttgagagagatgagaataagactcatcacgtcctccgcgacaagcccgtgccgtccgatgccccccgactcggcttttctttttctcccctcaaatcttaatgaaattcggtcaccggtctttggctgacccggcaaaaaaaaaaaaaaagagagagataataagactcggcccatcgatgagggatgagcaatggactttctcataggaaaaggaccacgcgcaaactccgttcggaccagcccatctaccagcgggccctccttcccacttcgccggcgttggcgagctgctcgtcggcgggcggcggacggcggcggcgctccggtggtgggcgccctagtaggctagtgctctgcctccaactcccctgatttggcagcgattgatgccgtccgccatgaagccgagctcggccggcggtggcaagtggccgcaatagccctggctggatctggagacgtcggcaacaatggcggcgccggacggcgatgccactcctccgtcctgctcgtctaattggcgatccaaaggttacttaattttcaaggatttatagcatattctgaatattttatttttcccatagcagtcaactattgatctccaaaaggaatttcagaattgcggctaccataatcgttgaagaaatgtagctaaaaaaaaaaaagctctctacctttttcagtcaaaaaaaaaatgtagctaatcagctgattaaggatgagacagcaaccgcagttcgaaaaactattggtcaagccaacaaaacaaaaatgtattttgtatttgggcataacagttgtgctactactactagacaacattatctgatgatcctggcttggaataggatgggaaattttcaacagttgggaaaattggttggtaccaatggttttaagaagaagcatcaatatattcgttcctattacgtcaaaacaatgaaggaatatgactgcttctggcaatactcaaatgcagaccaataggcatcactactgctatctttgccagctgtgctatcagcagtttccatttttatcagttttaacatgctggctttcataataaaatggtttaaacatgtattttcctcatgtttgtcaggtcattttgtctagtatgcagactgttcaactaaaaatacacgtgcttgtgaaacttgaccagagatctatggtgctgaactaaacttgtagaatttcctttgctgctgtcgtcgtctcagctatgtggtcaatcttcgacggttatattaatccaaaccgcagggaaaaatacaaacttgaattcaaacagtttacattcaaaagcatatctaggttcagacacattaaaaggtatacggtatatctatgttctgaaatgcatctctctttatggagacgtggagctactcgagtttgacgctgccttaatctctattcctattacagattttca

SEQ ID NO: 19432 - DNA, 1501 bp, Oryza sativa
caaccaatggaggggcagttttatgggggtgggatctgctagggggaccaagagagggtggacactgtttggtgttgatgagttggcctaagtccctccttcctccttggttgggctgggaggttatgacttgtgagttgtgacttcatcccttgtgatttggtgacgtttgtttttacatatggccaaatgtttatggtggtagttgcagccgtattagggtgttctttggtggttttgcgattttatgcagtgaggtgaaatactagagatattggtgtgttgtgaaaatataccaggtactcaacacgtagctcgtatatagcatattagcagcacatgagacgaaatagttcacaaggttggtatcttctagaatagtgaccaccacatatgcttgggtttttatggatcatatgcataagttcaagagtagagttggtcaatcttgtagttatcaaacgagatgagtttgaatggttggcaaaagggacatctgccctgtcttctcgtatcgattatagaagatcataaaactagtcattttaacatagctataatcacttgtgcttgttaatgattaaatataaacctattgcattaaagatatcatcaaattataatacaatatagtcatctttcatactacacaacacccctttgtattgtaaagcgcatatccttattaatcatgtctggctagctaaatttaccatacaacatgtttacatcccttataaagttataatagtatgttttgttccaggaggaaagcagtgattgttttaggggggcatggatggggacccatagcatttcctggtaaatagagacatgggcctttggatacctggcctcatttcccttgccctatctcctaggagacctgcacccaggaggggtcactggctcactgattagagaattgcaagtttttactactagctggtttacaaagaaaacagccttcttgcacttgcacctctcctcttgacctgtgtccatcactccatgcctccctggcatggagccatgggaggataagggttttacaaccatctcccctttcattttcctacccatttttttttctgtttttcctacccattttcttcatcagaacccactttctgaggccaagttttgttttccagagaaaagctttgatggatgcttaccagttagcatgcttgctgggttgtcctggcctggcgaacgaacacgcacggccctcatcagtccatgacggcgaccacctccctctcttccctgtcatgacataaaaccaagcaattatatcaaacatcgcttgcaataacatcacaagcattacattacattacgaagcaggcatgcgagtacagataaaatgttttcagttcgcatcaaaacgtattgctgcggacagcgatacgcccgtgatgcgatcatcagcatgtcaccagcaatgagccattttcatgaacaacatggatgttttagtatatactaataggagtac

SEQ ID NO: 19433 - DNA, 1501 bp, Oryza sativa
aacatccattccgttaggtcccttttactttcgtttcattacgttgagaaataacgcggcaatgtcaatactgaagaagtccaaccatatgggtcagaccatcagaaaaaaaaaaggtgaaagcaaattaaagaataatttgtgggtaaattttttatatttgtatgcttggtgattaaaaaccaatgttaaaaaaaagttaaaaccaactttataattaaattttaaaatttaaattttcaaaaaaagaaattaaaatttatattttagtaatggtttataagttataggacaaacgatgagcggtgaatgaagatacctactaattaattccaaatgcataatttattgccgatgtggtctctacaaatgtactactaccaacagtctagtgctgttatttttgcttttgttgcaagtcaatgtatagtcatgtgggaccaaagactgaattggttgaattttatgttggtggagttgaattcaacgagtgcatgtcaattgtcaaatctgtttttctactgaataccaaaagtctaaggtcatgttgtttttaagcaggacccttgtcttacgtctttaaataaccaaattagacatgatcctaatggtactactgtccttgtgaccatgtctatccagtgttttctaattacgtcctgatgatgtcatgttgattgcatctcgtatcctgtcagtttcaagctgattatattattgctctgaagcaattaaacttatgatgtcattgtgactttgtttacctcgcgtcactgaactaatgtcagccgataaaaacccagccttttcaggtcttctaaaatctcatgctctcaaaaattggcactattagtttattaataattaattcaggttcagtgttattattcttctccgagtcatagtgggttttctcctatttaggatacttctagcagctacaactacttttagaaattgcaaaatgaataaatttggacttgggttgtgtccgagttttagaaagattttacaaatgaataaatttggacttgggctgcgttcgatttttagagtgatttcacaaaatgaataaatttggacttgggttgcgttcaatttttagaaagatttgacaaaatgaataaatttggacttgggctgcgttcgatttagctcaagacgagattaagtgtaggcacataaaacaataaagtcattggcatataattaatttagttttaattgttttaaaattgaaaattgaattttatttgatatttttaaggtgtttgtatatggaattatttttttatgaaatacaccatttaacaatttgataagcatgataacaaaaaccgagataaaatttgtcttaataaaaaaagggaaaccttattggggagctttacagcctcatatttttcttattcttatacttatcagctaaaatttgaatttttaatctttgaggatctttcatcgtagtttatttttcagcctttgtttttagatcgtaaag

SEQ ID NO: 19434 - DNA, 1501 bp, Oryza sativa; identical to SEQ ID NO: 19019

SEQ ID NO: 19435 - DNA, 1501 bp, Oryza sativa
ccgtcgtcgccgtctccgtcgccgcccaccaactccgccgccctcctcctctccgcctccgatgccattaaccctacgcgcacgggcctcctggtcgccgcaggcctccgtgatgccgacgtggtggaagcgctccaagtcggcgttccagcgctcctccgccgtctcctccgccccggcctcgccggcgagggcctccacctcgtcgtgcgcggcgcccggccgccgcagcgccgccggcaggtgcgccgatgacgccgggggcctcctcctcgcgcggcgcaggcagctcacgcggcagcggaagctgcgccacgtcgacgacatcggcgtcgggctcgagagcctcggcctcgtcgtcgcgaactcctcgcctccccccagaggccgcgcctccacgtccgcggccgtcggccaccccgtctcgatcccgatcgcgaggtccgcgagctccgccgagttcagagccgtgcaccagccgccgccgagggccgccacggcggcgtcgcccgtgctgctcccgctgccgctgccgtctcccaagccggtggaatcggacacgtcggagccggatgttggtggcgagagggcgacgaggtaatgtgattatattttataattcttttcccctctgaattattggatcatgtcgaatcctgcgattgaatgaattattatgtatgtgatgatgatcaagagatttttttttgtatttaattgatgcgatgcaaggtaaaatgtgattgttttcctcaaaataaattaagtttttgttatgctgcgaagagattaagacgcataggaaggtgcaaattttgtgattgattaggcatttggatgttgggcatagcaatgttaacctgaaactgcaaatctatgttgtttcctgatgctcacttgtcttgtggttgcagggtgacaagccagattgttcaaaattttcctgataataataataatcttcctgacaatagttcaaagcgtactaccacctctagtcaccacaggaaggtgttccgagagaagttccaagataagagttcaactgaaactgccaactttcggttgaacattcctgctaaaagtgctccaagcagtgggttttcaagccccgtgtgcagccctcgaagattcagcaatgccgaatatacgacaccaactgctcaaggtccccaagcgtggtccgctccatctgtccgctcggtagattctatggcaacttcatctccgcggatttcacctgaaatatatacaggggttacagagcaatcaactttttctaactcattgagaagtcctattctaatgtcgaagaattccagtgcccctccatcacctctgcacccaaaattattcccagaaaataatatgtcacgtattgaaggcaatgggaatgtcagtttccacccattaccacgccctcctggagctataaactcaatgcagacaagcattgttaaccagtctgctccaaaagttgaaatgccctcagtggctggtc

SEQ ID NO: 19436 - DNA, 1501 bp, Oryza sativa; identical to SEQ ID NO: 18989

SEQ ID NO: 19437 - DNA, 594 bp, Oryza sativa
tgttttgatgggccaggcttttttcgtgggctaaaaaaatgaatacttggggttctctgggtcaaattctagggtagtcctgggcctacctagactacccattgggcccgcccctggacggccggacgacgcggcgggacggagagaggacgcggccgcgcgggcgctggcgcggctctgccgccacggatgggcgcgcggctggcggcctggcgggagctggccagcctggaggagcggcgggagcaccggagtcacgccggcggctagcctgacggctcgcgtcgaggtcaccgggtcatgggagcgccgtcgccgtgacgccgtcgagtgggaggggagagagcgcacgggggagacagccagactggagaggagttagggttttctttgttttgatgggctaggcttttttcgtgggccaaaaaaatgaatacctggggttctctgggccaaattctagggaggcatataattatgctagtcaagatcaaatcagtacagggagatatgaacgcagaaaggcactcaccgtggtggaacttgtgaccgcatcgctgccatatgggttctactgacacataggcgctacca

SEQ ID NO: 19438 - DNA, 1501 bp, Oryza sativa
gtatcaaatgcacaaaatcactcaaatttttcaaaattttcaaattattagtatatacctagttataataatttgatttatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttacatatatatatatatatatatatatatatatatatgtatatatatatatatatatatatatatatgtatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgtaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttaacagatgtt

SEQ ID NO: 19439 - DNA, 1501 bp, Oryza sativa
tgataatttgcattgctcggagagattttcaattgacagtatttctggagctatcgacaaagacatcatgtattttaacatcactcaacagctagataaatatcattcacacctgtaacagcgcacgaaattaccctgaagaattgcaagttaggccaatagcaaccaataactttctgctacctgcaaaactgccaaatttgccaaaataacatcgaaaaagaaacgcgaaaagagtaagctaaaaatggcgcgagaatctcctcttcctcttcgtccttggtctataagcacactcgataagcttagccacatcgagcaattcttgtagtaatcctgcagaaagagtatacaaggaatccaagaaacctgcaagcatctatctagccatggccgccgcgagagcgggcaacgccgtccggttaaccttcgccgaggaggcggcgccgccggtggcagctacttcgccgggccgccgctcgctgcctcgaccccattgccggggagaccgacggcgacgacgacgtcccttgcagccggtccaactgcgtctcctgcagctgggttatcgtctgaggacagttcagttttctcgggcgtttcttgatatgttcttttcaggtttaatcagcgagttttatgggagtttgatgagtagaaaaaagagggggcttaattagcgtgttctatggctggattaactaatcctcgatccaaattcttcatctaccaactcttctaaatcaatcataatttttctctattgaattccacatactttcttaaccatgtccaagagttttaggagatattagcaaataactagcttttatctcccctgttgctactcgaatttgaagtaagctttaattaacttatcggttttgagcgaatcagcgagtcgtactactctggtagatagataatcttctagtacctatgtaatgcgaactgttaagttataaatctttccctttttttgagaaagagaggatcacctctcccatttcaatacagaaatgagaataatactgtcagttattacaataccaaaaggaagaaccttctaccgtgatgcagcaaacaaccttctacatcatacatccaatctaacggtaagcaactatcagcggattccatacaacatcaagagacaaaaaaggcaagttaaatctacatgaatacatcaaatcaagtgggaattaattcttttgtttatgccatttcacattggattctaataagtacaattacttcagcacatgctacaagattgggtatacttaattacattaaggaacccagttaagacaacaaaaaaaaaaggacaaactggaagcatttcatctattaattataagttctacaatgatatacataaattcagctttccgtacagtggtttggctatatgaagactactaaaagaagctacgttcacaaagaaccaaatctgcacaaggtattcagctgccaacaatgtccatggcaagtcaacatc

SEQ ID NO: 19440 - DNA, 1501 bp, Oryza sativa
cgctactcagctcatggccgatgcggatccagttcattctgctgtaatacggagtcatcccgcaacagtaaactgaaattgctctacggtgattcaacgcatgaaacaattaatggcagtttaatgcagctgcgatccactgcctgatttacctgtcgggaaaatttactctattgattactgtaatgtgctttgatctgagcggtctatttcaggtctaacagtaaacaagccaccaaatgcatgcgctatcactattcactctcttactatgcgagggtaggggtttaagtggctaacccacgaacccactggttgatcaaaataaacagtttcgtagctttttgtcatctattagtaagttttacatcagaaaattagtgggtttcacgagtaagccactttcaatcttatgcggcaggatgccattacaagggaactagctaggtgggcagagctggtgtagcaggactgagttgcgggaatacaaagaacaaattcatgagcatgagtaatagtccgggttcacatttccaattgagcgccagatactgaccactaatgatccaatttcaccacatttcgatcaaattttggttgaatttgccgttccaaaattgaatccttgaaaaccatttgaaatttcattcgggatatgctttcatcccatgtcgaaacctcaaaagttcgtggtttcgatcagtttgtgtaaaaattgtcaaccttggtaagagtagacgggtgtggcaggagattggcgcgtgcaaaattgggtttttttcttgtaaatacatagagtggagcaaaactaagcccgtttggcacagctgttactccaagggtggagcggaattgaggagcggtagaaatgtcgcttcaccctcatagtataattaattttcagaaacggcataaaagctccattctttattattcaagttctcgaaagtatttgatacaactctagcttcaagagattagagtctcagagtgggagctgtaccaaacagaccctaagttaagtagttcatcgatctattgtggattagatctaccaaaattatccaagttgggacaaaagccaagtggataaccaattttggggaaaatgatgaatcctctcttgactagtacaatatctcaacaaaataatcgtgcagaataatatattaagaggagactgtatactgacctcaggcctaacccaacgccccatggatctgcaagcagtatagcaaaaatgcaaaattgagactgtcacaatggtttgctagtttttttttttctctcggagatgtctagctataattctatatatatatacatagcatcacatgagagttctgatatagtgtgtcgtgtgagttttcagttttgggtttgccgtgcatgggccatatgcccttgtttgcttctttccttccgtggaagttagcataaagcctcccttaaactatgggtttgaacttcaaatccactggcttaccctgctgtttataga

SEQ ID NO: 19441 - DNA, 1501 bp, Oryza sativa
tactcagtacaaaatttcatgaccaagacattgtttcgaacttaaagctccatttgtgctcctgcaaagcttccagactgcagactcctctgttatcgctgcagcgagttggcatggtgaccttgatttacccagactgcaggctcctctgttatccctgcagcgagttggcatggtgaccttgatttacccattgttctttatgaggaatgggataatatctatgctttggttgtagttgaatcgtgatgggactaattaagcttaagctatctgctttccacttccgtcaattgtgtgtgtaagttagcagaatgctctgctcaagcagtgctccttagggtggcctgaagtctaaacttgtgttgctaatacagaagcacaaaatttctatgtacttttgtttattacccaaacttcacaagtgaataggaagcactatgttatatttgtgcatccaaaataaatttgctttacaccttgggaatcactaggggggagcaggggagcagaatacaatgtttcctggttatttgtgtcctcatgtatcgcattcaatggcactgtgattccggaattcctgcatctaacattccgtgctgagcccaatgtggatggtgaagtctgtctacccccaatgcaatgaatcaccagaaagttggactgtctaatataaatgtgttgtgtcatgtttccactattttatttgcagaaattagagttatgcaagcgtctctgagtcctcgttatttttcttgtcattctaatgagtgttacaatcctttgaaaaaaatcaaagtttttagcacctgaaagtgcaaatacatgtgttctctaagcaggtgttatggacttccttaggcaccattctagacaggttaaggattgggaaaccagtatcattttgaaactttgttatcatttgaaagttagatcctatgtcctgattaaaatgacattattactgtgttctttctggtatattcaaaagttttgtttatttaaattaattcggacaagatagctaaaatggagtttttctgggtgcttttagaaacccttagtttgttctgtgtatgacactcgattttcatatgtacccaaataagtttacatcttattgtgcgatatctgtatattatacatggaattcagctcaagtttctcatgcaacgagaataattactagtgcatcagaacttttctgcatatcacatagacatagtaacaccagttatcaaatttaaggtttgttcactttattaccattttcaaccctaccaaattttggtagggcaacataccaaacaaattcttgccattgctaccataccacattttggaaaatttggaagcttccactcttaaaaacactacccatatttggtaaatctttaaactaaacgcttcggacactaccaaaatttagtaacattaaaatatgccaaaatttggtactaccaaatgttggtaaggtcgaaaatggtaataacaaagtgaa

SEQ ID NO: 19442 - DNA, 575 bp, Oryza sativa
gtgtccaggactgtcacacctggagttttcccttcccttaggttccaaatcactaataaatggcttcaagaatttgctttggttaaccaagagaaaaccccagttaacaatacattaaataatcggaattgtcctggagaattttttttaattctctttgctatgaaaatcactaacatgacttaaagagtcaagctaataatttcttcctttgcctttggtcatgaattgttcccaattcactcccctctcagtccgcggtttcgttttgcatgacgaaccgtatccgtttcagttcacggaaccgtttccgttcttttcctaaaacggcaccgcattgtttttcctttttgggaaagtcctagtctcccccttgtttcctttttccctccccctccccagccggccgtgcgcccctcctccccctctctcgtgcgcgccccctctccccctcttgttcgactccctcccctcctcccaatcctactccctctaggactccacctttccaagtctagtcctctcctatataagtgatccctcccctgtttcttttccttttcctcctcaatagc

SEQ ID NO: 19443 - DNA, 758 bp, Oryza sativa
gggggcgtggtggaaaccggcggcggcgcgatgggcgggtgaaacgggagaggaggaacgcgggcaggcatgggtgcggagtcgagccgttgaattcgacgattctggaccgtcggatttgatgaatgaggtttgcatgagtgtagttggtgaattatagggtagaagatgttatgttaccctggggactctgaagattaattgctagtatgtgttgattggcaatcgtctctgtacccttaaaactgatcgtaaacattcaggccgaatttgaccatagatgggatgaaattataaaacgcgcaagtgggccaaatttacatgcactcggccaattgtgcgcacacctgggccaaattcaggcagggaacttacaaatcgggcgctctaccagataaaatgttttactgttaaaaaaatatttcaccttgttaaaatattaaaacacattcaaatcacgactgagacatttcattcacactgatgaaacatcgaatttcatttggtgaaacataacaaatccgtttgcattaaagggcaagttatgaaacacctctcgaattccagatccgtctacccctgccacaaggcacaagctagtaacacaaacttctacgcaacgatttagctttgctcctctaagctttcgtgggccccacatgtcatggactaacccgccgattccccacgtctccttaccttcccccttctgccgacgaagcgtcgccgcggcgccatggccggaggaggaggaggag

SEQ ID NO: 19444 - DNA, 1501 bp, Oryza sativa
gactactactcttgtttttgagatgtcatgataacaagtgtactaccgatcaatacatatttttcacttaaatggtaataagatggtatgcggccctttatgcaactggtactgtggtagaaatgaatctacacttgcccagttttttcttttcttttcttttttctgaatgggtgtatgggtaatctaattttatgataatctttgaaggtacagacggatgaattaactagtatttgatttagcgacaggtataaggcgacggtggaagtttcggtgacttgtaaagttgcaagagaaactatcaaatacatgtacagagaataagacgacatgcaaatcacctgtgaatgtgacagtacagctaaacacaaatcaatttttcatagccccaaaatccatgttactagtggtacacaggcagtatgaacagaaagctccaacttaacaactagcttagcaagtccgcagagaatagcatgttagttgcaccgacggatttagaatagcatgcatttgacaaatggacatgcctgcagtactacctgttctaacattaatacacaaggatttaagagctctgtttcaaggcctgagcttctgctgcagccatggggtctgcattggtatcagtctcctcttctttctccccttctttttctgcagccaatttctccctgtgcagcttctctgctgcctgcatcgctgcacgctgctctgcctgaaggcgttgcatttcttcttcctgctgctgcctctcgaaccaagtatctgcatcagcccaaactgaaaagagacaaacaaacttgtcagcattttaccattaatcaatgtttagaagcagtactaacaaaagcacaagcaacaaagggatgctcgacatacagtacgaatcaatcacattatcaaattcgtaatttgttcagatgtatctagtgtcctgatggctcatatatagtagagtttatatagatgatattgcgacaaaatgctatctttgatttcagctaaggcgaatcgtgctgcaggcatagagggtttactagtatataagcaaacagttatacttaaaacatgtataaaataccttgacatcatttttaccctctgatccagatcagaaagtatacctggtagaatcatctatgaaaacatagtaatatggtagaagttcttagcagttagcagtgttccacaatacataatttatcagctgctttctgctacaatcattttaagccttagaaaaaacaaatggtataggcataatgctttcagggacttaagggtttcagtggcaaaaccaggcacaccattatatggtaagaaaataattttcccaacttttggcaaagtaagtgttttcacccctctattagtgaggactaacgtggtaaaaactaaaaagcttgtatgctaccatgaatataggtggtaggagctgaataattccacacaaccattggtatttcaatttccaaaaataatgtcttgatttgaa

SEQ ID NO: 19445 - DNA, 1501 bp, Oryza sativa
cttccatgagaatatgatatctaagatgaaccttgctcagcaatactgagcaggattctagtcgtactgccgaagcatctctccctgttgtgtcctacttttttcttgcatcagattactcaagaaagatgaggcgagtggcgatacgcgtgtgagtgattcccattgcaaatcttcatagatgaactcgcatgaataatatatccccctgatcggcacagttcatcgtggccccgcttgtcggtgactgttcacgggcattttcgtttcgcagagagaatttttctagcttctaatccacagagttgaagaggactaccatgatggttatggttttacatgtgcaaaatctaggacaggataggccaacaaaatgcttttaggaattaattcttactgaatacttcctaatcatacacaattccttttttatgcatatgtagcagccaacccaaatgatgtgttatatgtgatctcaagagtgttccttttttctttcctttctttcttttttcttcaattggccacctgaagaaaagattggctccacacatttgaactgtgcccttttctgatgcttttgcatgataggtcactctcattgttcacaccaaagctcaactaaattattagtttaatggagatcaactaaattaaactagcttttctctttgcttttgatcttgctttggacacgagccaggagatcttaccgaaatctagagcggccgaatccaccaccatcaccactgattagtttggaatctgcaagcttaagctagcattgtacaataattctccaaagccctaatcatggcgtccacacccagcatgaacccctctacccttctacccttaagaggggcccctgaaaacagcgtgaagacgggttttcagtgacggtgaccggtacggtctccggaccaccatggtcgtcatcgtcttcgcaccctttttattttttcggttgggtgataaggtgatgatcaggggggagattggagaagattgtgctacaaaagtggcagcttcactttgtgtcgctggaggaggcatggcaccctggggtctaatcagccatcattccatcctcaatttttcttaagttgggagcattttgcatcactcttttgagcttttgggtggaaaaaggaggagaaaggagaggggaggaggaaattcacctttgtttatgtcaaccctcctgttgcgtaatcgcgccttcctgcactgttttaaggatggatgaatagatcagttgtttctaagaaaagatagaagaaaaccgagcgaaagaaaaggcgaaaaagggagtctctttgagcaaatggtttggtcatggattttcaaaagatggatgtatggtttatttcttgccaggtgagtgtagatactcactcctccccaaggggaatcacccaatgattgacagaatgatcattgataggcaaagcagaaagaatgaggggcacaatcccatcggattggcatcatataaagc

SEQ ID NO: 19446 - DNA, 1501 bp, Oryza sativa
cctgtggttatatgttacatgcaaaaatcttcatggtctcgtgaatttgtacataataggtagtgttttacggaatttactcttttattttatcatactcatccactccaaaggcccaagtccatctttgctaccattgaataaaaaaaagatcagtctatcaactatagttgaaaagtaactctctaacaagggggatttataattatgacactgcaaacataaacctttgctataatgaccctggacccacatttcatagacatagatgggcccatttgtcatccactcgaagtgtcaaaacaatgaagccccaatgtttgcagtcccaatattgcaaaattagcttaagggtgtgttcagatgcccctcttcccaacccctctccctcgttttccacgcgcacgcttttcaaactactaaatgatgtgtttttttaaaagtttatatacaaaagttgcttaaaaaattcaaattaatcctttttgaaaaaaaattagcaaatatttaattaatcacgtgctaatggaccgctccgtttgccgtgcgcaactgtgcacgttcccatcccatctactctctatttctcagctaccgtgaggcaagaaataaagtttgatgactttgctatgtttaatttagattataaagcagaccattgttatagattatctattggattatagatataaattaaacatttcaaaaattcgatgaataacttgaaaaaatcagagcctttttaatgcattactacaatatatcatattagccacttcctgatcaaaccattatacttcctccgttttatattaaaagactttttagtattgtacatattcatatatatgttaataaatctagacacggcaatgctataaagtcttttaacctataacggaggaagtattatttacttcaatccaagatcagtctaacctgatctcgctccgtcaacagtgccacccttgcacccacactcaatggccaggtgcccatagtttcttcattatgtgtttgattgatctgatcctaccgcttccgctgtgcggtttcgatctcacgagttgctggtagaagaacttgttctgggaggaggttgggggggaaaggggggggggggggggggatcgatagatgcaaagtcgggaggagtggggggctcaagtcgtgcggccgaaggcgcgtccttgtgaagatggatgaatttttagaacagaagcgatgtcatgcaaggcaagcgcgtgcagggaaacaaagtcgaacgaaaagctagctcagagtagaagttttcttccagagcaacagatgtaataacagacgatgagtacaaagttatctttaatttttataatataggtaatgataataaaattatttttggtggccttttgtttcgaaagaattacaatcaatcttccggatattgcaggtcgaattactgcgaattgaataaaaacgacttagattactagtctaaaagcaaagatacaacctccat

SEQ ID NO: 19447 - DNA, 1229 bp, Oryza sativa
ccccccccccccccccgaccatccctccccctccccaatcccgcaccgccggcttccactgctctcctggccatctctcccacgccaccatcgtcgccgtatccccgtcgccgccgctacaccatcgccgagaatccccttcgccgccgtctgcgggccgcgagctcctcccctccccctcagccgccgccgatgcgacggcctctggcttccaacacgcttcgaagcctctgcttccgtcaccacgcggcctgcccgtccgccggcatgaatcaaccgcgatctcagccctagaagggcgtgcaatgaagcagccgctgctgcttggcgcacatatcggcccgtacgcttgcactacaccggtgcccgcactaggtaagatcctctttgagatttccttatggtacgaatcctgctgaggagtttagaaccattttaagcctcttaatcattttatctgctcaaatcctctcttttgtttggaagatcaatgtggtttatttttgctatgttggaacaattaagcgaatgaaatctacttgttggtactatggcattaacctgctgtttgtaccgtttttatttctggttgaatcttgtgattttgctgaaatcttatcacctaacgtgaatgtatgctttcagtccattcagttgaaaatctatttaatatcattttctttttagtcttggtagcacggttgacaataattatcggtcagtccttggttttgtggtgatgagtcgtgagtcaaatagcatctataaaaggattctacctaataattttcagagtgatgccctgctctaatatttacccccatttttttttatctcaggtttgacctctgtatttcagtgccgtctataattcattaagctacttttgcttacccttgtctgtctcttttcattgctgaaagttgatgtcttttttaaggctaagaaagagctcattctatcttctgtaaattttacaggctcactgaatgatgccaagatatatgacaaggtatggtctctaagtggcttcctgaatttacaactgaaccctgtccacatctctccattaactgagtcagtctaatgggatagaagcactacaatactgtattggtgatggacgtcctgcaggccctggtaaacaaggcaatctcagctggcgccatgtgcgggatgggaggcaggctgcggccaccagcgatttctttgtatgcaaaacttcttcg

SEQ ID NO: 19448 - DNA, 1501 bp, Oryza sativa
tgctctgacacgaccattccaaacatatcgaaatagcaaaacccttgtgtcgccttccctccccggcaaacccctcccgccgaccccctcgtctcgcaagtctcgcaatccacctaacctaacctagggtttggatttcctctcgcctccgccgctcccgaattccccaccgcgccaccgcctcggccccatcacctcgtcgccggccggcttcaacgccacgatccacctcccctgctcccggatcccccgccgtcacgcccggggtctctcctcctgattcggcaccacgatccacctccgggattgccgccgcgccacctcctccggctccatcagctcgtcacgaccggcgtctctccctcctgcttgcttcgacgacgccacgatccgcatccccatccgcgatcgccgcctcctggacccgggtcttcaccgcctctcgacttcgtctcccagtacgcatatgcagctgccatgccgactgctacaggtggggaagcgccggcttcggcgcaggagtgcacttccgtgggtttgggggctagattggtccgccttgatggcaacgccattaccacagtggccgaccttcagttgtccggtccaattccttctccacctccccaagacattgatacagccaccatcatctatggagaggatatcaggccgggtacctacctggttattcatgcaggagttgatatccttgacattgccagactcactttccttgaggaactaccggtggctgccaggaaagggtatcccacggaagcggaagaggagaaggacgccaaagctgtggcactggcaggcaggaaggggactcccactgaaatgggagaggaggagaaaggggtggtggcaacgccccatcaagagaaaaacatggagaaactggaagaaaagaataaagaagctgagaggttgggaatggaggaaagagaggaagaagaggggaacgaaagattgcgggaggaaaaaccatggcacaaccaactgtggggcgaaacagtgcgggaagaaaagaattggcacaatcaattgtggggtgaatcagttgaggaggaagaccattggcacaatcaattgtggggcaaaacagtgcgggaaggaaagcattggcacaatcaattgtggggcaaatcactgcaggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacaatcaat

SEQ ID NO: 19449 - DNA, 1501 bp, Oryza sativa
tggattttgtaggtttagatttgtaatatctaataattactaaatttaaatatgaagtcgtatccatcttagacttttcaatatttattttattattagcttaggccgtgtttagttgttttggtaaaaaaaaaatttcgtatacggacacctatttgactattaaacgtagactaataacaaaataaattattgattccgcctgtaaactacgagacgaatctattaagcctaattaatccgtcattagtaaatgcttactgtagcaccacattgtcaaatcatgcataattaggctcaaaagatccgtctcacaatttacatgcaaactgtttaattggttttttttccacatttaatgctccatgcatgtgtccaaatatttgatgggacggaaaagttggaagtttaaagggaactaaacacagcctcacaactaattttttgctgaagtatacgaacacacatttgaagtattaaacatagactaataacaaaacaaattatagattccgcctgtaaactgtgagacgaatttattaagcctaattaatccgtcatagcaaatatttactgtaccaccacattgtcaaatcatgacgtaattagactcaaaagattcgtctcgcaatttacatgcaaactgtgtaattggttattttcgtccacatttaatactccatggatgtgtccaaacatatgatgtgacagaatttttgaaaatttgaagggaactaaacacacacagccttaattgaaaaacttaagacaacccacgaataatgattaatttggattattcttttcatgtaagccatagtaagaaaacacattcaacatataactaaattaattgatgttcatgacacgtgtcgataaatagccgtgcaacgtaccggtgacggctagtcaagataattaatcactaattagtggcaagggtgtgtgtgctgtcggtctcgctggttgagcaagctagaccgaccgctcggtctcccagctatttacacaaataagattaaatccccgatatttctgagaaaaagaaaaataaataatatattttcaatttttttctccaacaactagtcaaccagtaagggaggaaggctacttgacttgagaatctgaacaaggctccattcttccatatctacttgccccctgggtacgttgatttagaaaggtgatgacttccatatttgcttaattgacttgagaatctcatgtttcgagtctcgactccaaccttgtttggattagaccagagaactaatcatgtaagtgttccatccatgttgctttcacttatcttacgatcgttgaatttttttttccaagtccaatgtgcaactaaatgtggtacggtagtaagcactgtaccatatagacttacaagctgatcatggacagtagcagtcaacactgtccagtataagaacaacacagaccaaccttagcttgagcaaagtcctctactctacccaagccatggatccct

SEQ ID NO: 19450 - DNA, 1501 bp, Oryza sativa
ctccacgcaagcgaaatcggtgatcggtgggagggggatcatggccagtgtgacagggttgtgaagcacgagattggagagatcattcgccaaaaccagccagccgtgagaggccccgtagcacgcaacaaaggagccctttggaaaactgacactatagatcttgtcgactgcatcatcagggtggtagaggttgcaggtcaccgccgagcggcgcctttcgtccagccttttatcaacgtggttaccccaagacatgatccatggagtgcgagaacgtgggacaccggcagccgtggcggcggaactccatgtagtgcagactgcggcgaaggcaagtgcatgaggaagctccagtcgttccaggatgattaggaggagatcaatagaggtcggaccagctggggcttgcacaaggtcctgctgcagcaaacatttgcatattgtgaattatattcaatacaaataagataatctacatgcgaactgtatttgttactagttcatatataagaacgaacaaatcaaattcatccatagttcggacaaggaatcccttctggtaagcagggtctcccaaattggaaagggacatcggatccaattcggacacgaagaacacaacgattttgcacaaagattggggcagtcagaattagaatcagactaccagtcttctggaaaacgatccgcatcacacaactcatgatttggacggattaaacgcctaaagatagcagtttttttttctacccgtgagattgtacaaaatttgttgcattcttgagaaggtacatgcgaaatttacgaaacaaaattgcttttttttagaagctatatgtgagattttagggggaaaaattgcatctttatcacagaaaggagacaacaaacactcattttggaaggattgagaaatccgatatagtcgctgtgtatcgtagtgtgatttgattgcaaggttaaataaaagcaggcttattattactcacccaagggcgacatggcagggagaaatcggatccgtttggagggattcctccaattattttactgaatgaatcggatccagtcaccgggaatccacgttggcccaagaggggagggcgacgagctcacccttggcctgaagatgcgccggatctggccggtggatccccgtccaagcagaggggatgaagggggaagcacggccaccgatgaagttgatgccgacctcgtctagactagacctcgccgcgaagcttgtggaggtcgatctgcccacggatgaagtcgccgccgacgatacacctctcggacgggtcgtggctcgttcaatttggagctaggacgagattaggggtctgtttggttactacctgaacctgaagcagtatttatttaggtctcaactaacgcataataagcctgaaacttttgctactttgtttggttcaagcctgagaaggcgctggacgcagggcaagtcgactcaggctcaggcgtagtctgtatcgaa

SEQ ID NO: 19451 - DNA, 1501 bp, Oryza sativa
acaatttataatttagagttgtaataggtattagaactagagtatgagtcaaacttgtcacctagcaactatggcatccctgttggattcgagacacgtggccacgcacaaatcttggaacaacttcatcttctaccttcccttcctctaatcacccggcaaagaatcaggtttcgaacgcttctcctaattaccccgcatggaaccgctcatccatctcttcttcttatctaattaatgatctaatccaccggcacaaaatcgagggaacgcgttgctctcgtcctacaactacaacacaggcgatactagtagtccatcgccgcagatcatgaacctgttacctgtccagccggcctcattcatcaaaaacagattgtttctccattacttccaatgaactacgaaaatacatgtgaccaaaacgctaggtaattagtttaatcacccgaacttaatatactattcaaagctagtcatttaatctccgattaatcaagtaacggtgtaaatatgaactctattgttgatctgcaaaagaaagttctgataattcacttcgtatatgtgtaaggtgatttaatttggtgcaaatgaaagttctgataattcttcgtgcaagaagagacaaggtataactcacttcatcgttgtatggtagattaatagatttcacggtaggggatgaagatgaagatgagatggtttcgagattcgtatagccacgtgtcttaaatccaacaggggtgccatagttgctaggtggcacccggtgccatataactttttttcccagacgctatcctaggatctctcataaatagatagacgtgtctattgtaactgtatggcgacttagcatagcgagagggagtggctgccggcggcgactgaccatgagtcgttgtaactctgatatgctgtaatatgctggatcgaggaggagcgcccgtaatcagtgccccggagatgtaggctacaggtgaactccgttaccaaatatcgtgcctcggtgtcgtcatcgtgtttggatctcctatggcgttttcttccgcggtttggtttccgatgtgatttcggggctggttttataacacagatttggtggcctctcactcaagcagctatgttaaaaaaaattgattacgttgggttatgatattctgactattcccttcctccagagaaaacctaatctagctaggaatgaaacactattctcactacttaaaaaatacgtagtggtgatggtgaagccagcgcagacacgcgatccaacatagaaacgtacatcaacacgttcagagcgaaaaaatagtgcacactcctcctccgaaacgaaaaaaaaaataatccgacccacgccccgtgcagccctcaaccgccgacacgggagcaggaggtcgacgcgtgatagactccaaggggacgccacggcattctccctctcccgcgtggtccttctcatcaccgctgaggtgctgcctcctcgccgccatcg

SEQ ID NO: 19452 - DNA, 152 bp, Oryza sativa
aatttaaggaccgccaatgtactttactcttttagttttttgtgaagatactagtactttctgcacttccagaattttgtttatgttggtctccgcttcaatttatgttaccttatgtcatgtatgtgaaagtaaacatgtcgactcttaca

SEQ ID NO: 19453 - DNA, 1501 bp, Oryza sativa
cagccaaccccatctagagctacgtccaagtattaaaaaaaagggcagtatgacacttgctgagaaaaatgttgtcaagacatgcataagccataatgccatatatttacaacatatatcagtaattcaatatcaattcaaatcacaacctagggtagggaatctagccaaataaaatagcaaatcaagcctaggtgtgacaaagcatgaaaatgcagactgtagtccacaatttccttagtaactctgtattatataagcaaattaaggatagtttttagcttttacctgcggattactagaataaatatctgttgccagctccaaccttcttatactagtgctcattctcagaacatggaatacgctgggaccaatggcatgtccacttgccaatacagtaaggcccaggaacataatgtcagggagcattgtcatttcttccatcaagtattcattttcaaggtcatttagttcctgttgtagaaagtaaaacatataaggacagaaagatctcacttgaaaaaagttattagcacaaaccaatcagttgccatacgttaacactttaattttcattttcttgtatacaatctggagattctgaatctagaaaagaggggatcatatataacagttggagtagagaaacatatcctttggggaagtgattaggggtcattacaagctaacaatttcatttggatttgtaaaaaaaaaaaggtctggacactgtaagttataagtctggccaagtcagaaaagtgcattggttattcccatgagcatactgcatatctcaattttagaatggcaatgataatatatagtgcacaagtacaaatattgtctgtactcggttcacattcccttgattattgaggtatcatgttcccttcaataaataataaactagtactgtattgcatagtgctagcatatgctagttctcatggtaaagtggaaaatgtagcaccatcaattaacagtaagatctagtgggaaagaataaaattttagtgtgatcaaacatgatgtatgggcttgactcttgagcaatgcaaaacatacatgttagtacctcaacagcatttactaaatttcatatgtcttgaccaaatattaagatattatgcaaatgagtatggtgagataatcatctatgaaccaccttgatttgttcgctgcagtgaatacacggtaatgcacagtgctctcatctatgatgctagtagaggaattgaactcaccgacatataggcaagcgtgagggaaagacggtcgagggcatcaaactgaaagcgctgcaacagccttaaacaatcgccattgtggccgaagtcctcttgtccaaatgcaagataaaagtgagttcccagacacttgacatttgccatgttgccaaaccggacggagcttggatcgaaagcatcctcccagtggagagtctccagctgaggggctgagatgtcggccaccggttgactcatagccagaggat

SEQ ID NO: 19454 - DNA, 342 bp, Oryza sativa
cttactctccattcaaacaatatttatgcgggacccaatgatgagtgagggtgatatgtgggcccgagtggcatttgggaatgaaattttgggagagtggcatttgggcactggcatttggcaaatagtaaattctcccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaacca

SEQ ID NO: 19455 - DNA, 1501 bp, Oryza sativa
ggtataaacatttcatgctcattttcatcttcctaattatgcgcaccacttctgtctgctgctgctccacttcctgattcttgctctccatgcttcacccaacatgtatagccctccatgaatcctcgttgtatcagatgaccgtgtacgtcctttccgctatcaaacatattctcgttcttgcaatctgcacatggacaacacatgtaatcactgtttctttttatccgatcctcctccgcggcgttcataaattttattatgccctttcggtactctgtagaatgacgtttcaaatttttggcatacatccaacttcgatcaattgctaaaaaaaacaaattagaggcacatattataagatcagtattgcaaaagtaagacgtgatgaaattgctcaattaatgatttatattactcacttgattgatccattttgattacttttgggaatttaatttctgttttccttggaaaaaggacaaaaattcgccccctacagcctcccaccaaaatagtgaactgtgggatacagttacactaggtggtggggagtatttatactgtgcaacaaatatctgtaacggccctaaaacaatcaaccgtgatgggcatacaagtaatctctatcgggccttaataaaaggccaatcaaaaaagagtgtcatctgtgacgggcaataaacttatctcaatcgggcctctagttggagcccatcacagatgaccctcatctgtgacgggcttcttttagggcccgattgagatatggaaccctcatctcaatcgggcctcaactatagcccatcacagataagtgtcatccgtgacgggttttagttttatgccgatataccatggctgtgcgaccatatctcaatcgggcgaaattttggcccgattgagattacttccttgtgacggcccgcaaattccagtcttgttatgggccgtcacaaatggaaggatctgtactagtgatctgtgtttatcagtacttaccatgaaacaaacaaatgatgtgaaacgtgttaataagtatatgttaaatattataaaaatgatagatagatttgttaaaatattatgtaaatgatgtgaggggtgatgattagatatgcttgcatgttgatttgtataattaaataaactgtagatgatgttgtatgcttgcatgaagttaaatatataattattgctagtgagtgatgacgtggtatggttacgtgttgagctttagacttagtatgctagtttactggatatagatttggctagtttccatgctctctaaggaagctgtatcaatttatatattacaaactgctgtaaaaaaaaagttactccctacgtttagttttatattataagtcgttttttaaatataactagatttatagaaaaaaatatagtagtattttcaatacaaaacaaacatattatcaaaatccaatgttaaatttaatgaaactaatttgatattttagatgttgctaatttt

SEQ ID NO: 19456 - DNA, 1501 bp, Oryza sativa; identical to SEQ ID NO: 19064

SEQ ID NO: 19457 - DNA, 1501 bp, Oryza sativa
acattctctaattatggattaattagacttaaaaaatttgtctcgtaaattagcttttatttatgtaattagttttgtaagtagtttatatttaatactctaaattagtgtctaaataaagagactaaagttaaggtccctcatccaaacaccagaaaagacgaggaaataaatcctgcgcatccttgatgatgtaatcctctaccagtctacagatgctcactacgatggagtataattgtgtaaggaagcattgttgcatcactcaatgtaagttccactccctctgtatcattatattataagtaatcaaatattttatagaaaaaattagcaacatctaaaatatcaaattagtttcattaaatttaacattggattttgataatatgtttgttttgtattgaaaatactactatatttttttctataaatctagttatatttaaaaaacgacttataatataaaactaaacgtagggagtaactttttttttacagcagtttgtaatatataaattgatacagcttccttagagagcatggaaactagccaaatctatatccagtaaactagcatactaagtctaaagctcaacacgtaaccataccacgtcatcactcactagcaataattatatatttaacttcatgcaagcatacaacatcatctacagtttatttaattatacaaatcaacatgcaagcatatctaatcatcacccctcacatcatttacataatattttaacaaatctatctatcatttttataatatttaacatatacttattaacacgtttcacatcatttgtttgtttcatggtaagtactgataaacacagatcactagtacagatccttccatttgtgacggcccataacaagactggaatttgcgggccgtcacaaggaagtaatctcaatcgggccaaaatttcgcccgattgagatatggtcgcacagccatggtatatcggcataaaactaaaacccgtcacggatgacacttatctgtgatgggctatagttgaggcccgattgagatgagggttccatatctcaatcgggccctaaaagaagcccgtcacagatgagggtcatctgtgatgggctccaactagaggcccgattgagataagtttattgcccgtcacagatgacactcttttttgattggccttttattaaggcccgatagagattacttgtatgcccatcacggttgattgttttagggccgttacagatatttgttgcacagtataaatactccccaccacctagtgtaactgtatcccacagttcactattttggtgggaggctgtagggggcgaatttttgtcctttttccaaggaaaacagaaattaaattcccaaaagtaatcaaaatggatcaatcaagtgagtaatataaatcattaattgagcaatttcatcacgtcttacttttgcaatactgatcttataatatgtgcctctaatttgttttttttagca

SEQ ID NO: 19458 - DNA, 1501 bp, Oryza sativa
ccttattaccttccctacttctttgaaatcttactgtcttcaattgctcttttgcccgtgaagttgtagcagttcgcagtttgtctgtttcttggggagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaa

SEQ ID NO: 19459 - DNA, 1501 bp, Oryza sativa; identical to SEQ ID NO: 19068

SEQ ID NO: 19460 - DNA, 1501 bp, Oryza sativa
atggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggtagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatca

SEQ ID NO: 19461 - DNA, 963 bp, Oryza sativa
gtttaaggtggtgcatatgtggtggaggtggtatagcttttggtttgagctccaaagcatctaggtttaaggttggtaagtttatggaaagcagccaaaagaaggcaaacaatctttcgatttaaggctacaacaggtacaaaggtaattcaaagccaaaagagaccaaagtcagttatcattatgctttaaacaacattaggtgaaaatgaggcttcactaggtgcctactagcaaaggcggtaaatctaatcaaatttaattggtctaatagttttagcgcacttgagccatcagaaaattctcttcgacaaaacaatagaagaataaatacaatattttgtagtatagctgaaaaaacaggggcatggagttcaaattctcttataactaaataagctaaaattattcacatgatttggcacaatgtaaccaagctgtaaatagctaactgctctgtaactaggctgtaactggtctgtaactaagttgtaagtgcttgtagctgctctataactagcctaaaagtaactaatttctctattatgagaccatttagaaatatgcaactctcctatcaatatatatattgtaacacaaggactgttatgcccattagatttgtaccaaatgttgtattctaccttttaaatttaattttagatatttcttggattgtctcattattgctacatatagaattaatattgttgtacactcaatgtgttatagataagcctagtatgacagaggtaaaatacttactcatttgcatttgtgtatatggtatacctatgcctagaagtttacttgatatacgcaatattgcaagggcaagatttaacatatttattatctataaaagttttatcaatactatagaacatagttattatcagtcctcatgatcatcgttgttgcgtcgttgttgtcgccatgatgtcttcgcggtcctggcgatca

SEQ ID NO: 19462 - DNA, 1501 bp, Oryza sativa
aaaactattgcgctccatcagttctcgtcgagagagaggttaaaaggcagtcactgaacatggggcccacatgtcagttagaacccaagaggagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtac

SEQ ID NO: 19463 - DNA, 1208 bp, Oryza sativa
cctgcagccaaattttagtccctctcacaaaagcataagtctctatgagaggaactaaaatttttgtgagagggactaaactttagtccctcctttccaaacaccaccttagctgactgcattgcagtgcagaggttgcataggtagaatggatgtgcatttgctacgatagaaaaagagaaaaaaacataaactagcagagtgagctgcacggaataccagttagcaagttatcccttgcttccatatataactataccttgttcaggttgaagcctaacttgcaatttccatgattaaattatacttttaccattttatgtaatcttgagctttttaggcttcaaaacctaattaacctcattaatatgaatttttagcagcctgtttatagattcttttttaaaaagaatactatttactatttactagttaaggaaacgtgcgcgcgggagataatagagtggaggttaataaccatagcttaagaacacaacctaaaactgctagtaatacttattcagaaagcgaacaaaaatcgaacacacttcttgaaatgctgaatcatctgagcaactctcatgctcctactgtcctcatttgaacacatgtacactactaatcctcgttctggaaatttaatcatcatccatcggaatattctaatccccgtcccaaaataagtgcagttttacactattcacattcaacgtttgactgttcttttatttgaaaaaatttttattagtatttttattgctattagatgataaacataaatagtactttatgtgtgactaaatatttttaaatttttcgtaaattttttaaataagacggacggttaaacattagacacggatatccacggctgcactgaggtagtactagatttatttatcaatgcttcccatacctaacagcatggagcattcatgacgtcagctaccacgagctcacctcccattggctcatccctccacctcactcgcccacgtggcgggacgcatctggccccacattctgccaccctcccctcacaccccaccctttccctggaccgggtgcaccaacaccgctgagcctgagtctcctggtccacgtacacccgtggaccgggtccacggtgcaccgcgtcttcttccacctccgctttatatgagaagagaatagaagagaagaaggccacctcaccactaaaggaggag

SEQ ID NO: 19464 - DNA, 546 bp, Oryza sativa
ttcctgcagcccttggaaatataaattgaagatgttttcgcggtccgttatccgtgtttgagtcggttataaaaattggaaatgtttccgtggttcgtcatccgtgtttgagtcggttttaattttatgttttggttttaatctatatttcttctctatctctatctctactattataaaaattgaagatgtttttgctggtattttggtacatcatccgtgtatgagtcagtttttaagttcgtttgcttttggcaatacatagccatatttgagttggtttttaatatcgttcgcttttgataatacagaaggaattatataagaaatctgttttaaaaaaactcgtatgctaacttgagatgatcggactcctaactgcaactcatgattttctaaaagtatatatccaagcgaactcacacagtgaatttcatcttaactaaatcatattataataataataagattaaaatagacttcacccgttgcaatgcacgggtattttttctttttctactaaaataagaagataaagataagcga

SEQ ID NO: 19465 - DNA, 1501 bp, Oryza sativa
aacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctagaagataccaaccttgtgaactatttcgtctcatgtgctgctaatatgctatatacgagctacgtgttgagtacctggtatattttcacaacacaccaatatctctagtatttcacctcactgcataaaatcgcaaaaccaccaaagaacaccctaatacggctgcaactaccaccataaacatttggccatatgtaaaaacaaacgtcaccaaatcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccacctttttttccccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgaggaggaggcgcaa

SEQ ID NO: 19466 - DNA, 1501 bp, Oryza sativa; identical to SEQ ID NO: 19012

SEQ ID NO: 19467 - DNA, 1501 bp, Oryza sativa
acaccgcgaccaccaagtcgacgccctgatgctcctaggcagctgtgctcagtcggaagttctgacggagcgccgctgcttcgcacgccatcgccgcttgtacgacggaacaagatagaaaattggagaagacaaagtgaaaaaaaaaaaaaaagaggaaagggcaaaaagagaaaaaaagagagtttttttttaatgtgggtcccatttgtcagccaaagtagaggtattgataataccacatcagcgtctatgtgacataccacgtcagcaccatgtaagatgccggaacggtgatggctatgttggaccggaatgtcacactttggcaagttccagggtttgaatatgcatttttagggttcggggacctagatgacacaacgattcaagtttagagaccgggtctgtagtttactcttttacttaacataaacattaaaatattacatagctactatcgtagatattaacattaattgtattattccttcaacttttacaagcttaaagatttacaaattatattgctaattatatttttatgtggaatcacatattggtcggcacatattaaaaaatttatatgaacaatatgttgataacacgtgcaaatatgtgcccaaagccatcaataagaaatttttatcgtcgaattttttattggattgtgactccatgccaatatcaaacacaactcactattctcgctattgatttgttgtcgaattaaaaattattaaatggtgaaaaaaatataattaagactctctcttgatacttagtaattcataatttctaaactaaattaataaaaaaactccaaaaaaaacaacagtaaggctttagcgtgaattaaaatcagaatacaaagaaaaacataatgcttataaaattaatagcaatagcccgtgcaacgcatgggttgtcggctagtataattagcaatagattgggagcccatacattcccgattactcgttgttcttcttgcatcggcggtggaccttcccgattactctaggagcaggtacaatagaattgttttattagatgcaaaaataccatgttagattgtttggtgctttcaaagagagaagagagagaaggaatgcaggccacaaaataagcgccaactacaacacattcctccacacctggtgagcctcattccatgctcagctcttcgtgattggtgaaaccgtgctagcctgcgcacaggataggaggggagagagaaaaggtaggaaggagagaggaggttagacccactttatagtaaattatttttatagtcaagagattagggccatgtttctttcagcttgggattattataatctagattattgagtcagattattataagctagattgttataatctatagtagaataagcggttagttgtttctttcctagattattagagcagattattggtttgcaagtctaaagagggagtggggtggcatggtgggtaatttttcacccaataatct

SEQ ID NO: 19468 - DNA, 1501 bp, Oryza sativa
tggatatgcatcccactcgatttgagaggaaatatagggattaaactctggctaaaaaacaatgaaaaaaagaaaaggagacctaatggaactgccgctaccctctctttagtcccgtttagtcccggttggtgttaccaaccgggattaaagatccatctttagtcccggttatttcaaccgggactaaagatctttaggcccatctttagtcccggttggaaaaccgggactaaagggggttgccaaccgggagtataaatggtttctccaccagtgctaccactacgaagctgtccagatttgttgtactacctcctatccagattcgtaggactagataatatcacatcctatactaggtagttacattttgggacggagaaagtaatatgtttactaatcgacccctccgtaagacattgcacgttttataaggctgagttctttctcataggttcccaactccactctctcgttttccgcgcgcacgcttttcaaactactaaacggtgcgtttttacaaaaaaaattctatatgaaagttactttttttaaaaaaatcaaattaatctatttttttttaaaaaaatactaatacttaattaaccacgcgctaatagacccctcgtgcataggacatgtgttcctaaccgaaactagcgaacacagccttaggccctatttgggggagcttgtcccagctgcagctttttacaaaagctgcttctgctagaagctaccccaaacaatgcacagcttctgagaatatgtagttacagattctaaaaaatgaactaagaaaccagaagctggagaagctgggtttcagggcttttccagatttttagaaactggctgtcaaacaactgcttctcaaaatctaaagttccacaaacaggcccttaccctcaaccggcgagaggtgcctctcctcaaaacctcctcaaccccatcaaccatctcgctcctccatgcaggaagtcagcaacaccagttgatgacaccaacacacaagacatttgataatttaatattttttccagtgtccaatttattttaattaaaacttataggattgatactctatccgtaaaaaaaagaaaaacctaaaacacgctgtgaccaggatgtaacctctcttaatgtaacgaatttggataaatcatatccccttttagattattttttttatggaggaaatacatgagaccatctgagtgaatgaaagtgggttaaaatgtaaaacaatcgaagcccgtttcaagcagtgttaaattattaataaatgtaaaaaaaagagagaaacaaaacgaacagcccgggagaggataaaaaaacaaaaagaaagaaaaaaaaatactagtactagtagtagtactctcgtaataataacacaataggaggagcagagaggagagagccactgcaccgcgcgtccgcccgcgctccctccctctcctctcctcgcactcgccgtccctcccaatggcctccgctg

SEQ ID NO: 19469 - DNA, 325 bp, Oryza sativa
aagttttgagatttgattgcacgcattctactattattactactagtatatatatgtaagaaaaggagatagtaactgtgaagtgttcataaatcctaatgtctggagctatgtagatgtaggtctgttttgcttttgcagagattgaccaaccctctcactggtcactgcacattcctaatccttttcaggaccaccaaaagacaccccaaaaatctttgcacaagtcaattcccagacaggttatgagccagcactactgtagtacaatcctagcaaagtgcaattttccactcctttctttaagcatttgcaaggaaaaaga

SEQ ID NO: 19470 - DNA, 1501 bp, Oryza sativa
tttttttactgacagttatctcaactaaatcttcgtgacccgacacgcgaagtaaaatgttggattcgacggtaaaaacaaaaactatttggccttcaaaccgttctctttaaaagaaaaaactggacttcaaactgaagagtaaagttcagagccaagccaaataatggacttcacccaataatatattaggtcagcatgtaccacatggccctttgacaatggctccaagattagggtgaaagtgaaagaagaatcaccccaaattaattttcctcgaattatcggttgcaacacgatgccagatactacaaaacacagatttaattatcctgtactcgatattcagaaaactcccgtcagctaggttagcctttgtcatcttcctggtgtctgttgcaagctgaaaacgctgtcctagctagctgatacttaaatgataattaacgccatgaatattgcatgataaatggtgactaattatcccaggagaatcatttatggcgtattatctccctccgtttcaaaataaaagataatttttatttcattaggataagaatttaaccaacaattactctattatgatgtaatttttgtgacaactaaatttgttaaattggtgttaaaaaatacttaattatggttatgcttttctatcacattagtgaaacaaaatatgtcttgtattttcaaatggagggacattatccgaacagatgatactaaatgatagtagcaattaacaccatgaaagcatgcatgacaaatgatgaactaattaaccaggacaattaattgtttaagccatctatctagctagctatctccatcgtctgaacaaacgcagacgacacagacgcaggtagaggattgcagaaaagcaaagcctaatgacaatcaaaatcaggcgctttcctagcttgtttagtgcttatcttgctagcttttgtctctgatagcagctggttactctaatttgcttcgcttttctgggtgttttgctctccgatgctttgcttcgctttgcttttctcctcgtcaagtcagtgatgaaccccgatggcgaaatgggctacatgtgtcattcgatgcatatgcatccatgggcgtgtagatttcagattgggttatttgcgatgccgagtttccaatttaaatggatgaaaaggggaagtagctggcatgaggaaaaaaaaattccatcgttttcttcttctttttttaccgtgaaagtttaggtttcttgtatcgtgatttgcaatttaccacttgagtaagtctgtaaaaaaaaaagaagaaaattgggattgcatttctgggcatgcatgaatcctgggaagctgcctgaattcagagtgcgttgttccaaatgggaagtttcactccaaagctactactactgaagataactgaaatctgaagacagagaaaagtacatgcactgtaaaaaggtagccatactcattggatcgttctgccaagatcagtactgcatcac

SEQ ID NO: 19471 - DNA, 1501 bp, Oryza sativa
aacatttcctacatggcaatcctaaacatacataatcatatcgttgatgcctaaaaatacatatttttgtgttgtcaatgagagccggtcttctaataagttaaacacaagtaagtgatcgacaaacagattttcctcccggacaacgcataagatattatgacggttccaaattgatatgagatccacaaagatacgattttcatggccaaattgcataaaccatagggcacgtctctctgagatagctgatcaacgaaggcgtaacgaccaacgagagaaacacctaattctgtaccatttgattacctcggtaattaatttaggcaataataatattaatttgcataaggtcagtcttaattaaggtggcatgagggggccacgtgggaggggggcgaccggacgagcgtgtgtgatgatcatgtacgatgtatatatgtgtcagctaccaagcacttgtttgacttgtttgaggctggggttgatggtgatggcacacctacataatctctcttctccttctctccacacgacaagaaaacacgggctgtgtttagtttcaaatttttttcttcaaactttcaacttttccgtcacatcaaatattcggacacatgcatgaagcattaaatgtggacgaaaaaaaaccaattgtacagtttgcatataaatcgcgagacgaatcttttgagcctaattacaccatgatttgacaatatggttgtcagggttatggataccacatacctaatagtagttgactaaatctcggcaggacccaccacataccatgtcttatacggaaactgacttcacgtatggagggagttccggataaggaaagacaaccagagttctacatagaaacgacatgaactactcggattatatctatattggtttttctagttctacttggataaggggacacctatgggtataaatacaaggccccctaggaggagagagacccacaatcaacatacacaaaacaatagatcaagacagaagatcaacatacaagccaacatataccaagacaagacgccggatatcgacttcagggataagcacggctagtcccctacggtgtctccgggtactgtcaggagagacgaaagcgctatctctgatctcgccgggcacggattcgaggaggaagactaccctgttgtcgactacgagtcagaccttcagaccgtcatgtcgacaacagttagataggctaccgcaaatattgtactggtgtgattatggtgaataagagcaatatcggcttcagccaacaggatgtagggttattactgacaattaaggggcccgaacctatataaaaatccccgtctctgtctcttttacctcagtctcgcgtatatcctagtaccaacgatcctcatactatgcaaataccggaatcgcgacatcaaatgtcgacagttgcgcgccaggtaggggatcttttggtgcttcaaggtttcgatgagatgggtttaagaga

SEQ ID NO: 19472 - DNA, 1501 bp, Oryza sativa
atcctatttcacagtaggatattgattatcttgtgagcacgcatttacttgatgtcatatgttgtgactcaaaatacaggctcagtgtcatgattactaaatgaaattaggaaccaaagtactcacctccagatccttgactgcttgttctcgtgatgttgctttctgctgcctagaacgcttcaacacaccaatgcacagcacaccctacatattcatcaaagcttttagtacacataagaaaacatgtggcatgcagtataaacagggtcaaaattggattatttgttcaatgtgcattgcaagatcatcctctactacatatcattagaggcaatatctcattttatgatgctgatgcctgtatggaaaacgtctgaaaccacatttcaagtttacaacttcataatgttattagtcatttaaacaagctcaattagctactgaactaactgtccaaacaacaatgagaacaaaattgcaaggcatcaaattattctgccccagtggggaattattttctgctgaatttaatatctaggcatctgaaactaaccatgttttaaagttcagaattttaaaggctattacatggtactagtaatatttaaacacaaatgaacacccaaaattttgtagactcaccgagattatatagatcagtccacatgcaagaagcagatagctggcaatgtcttcaagcaaaatcaaatcacccctttcaacatttgggtatgcctttgtcatgacagcaacactgcaacaaaccaaatgaaaaacattaatccaccacaggaacagaatggagtacaattcaacaaggacaataattattattgaagtttttctactattcatctgttcattacactgttcacatgcaaaaacattacagttaagatgttcacgatcccaaaatttatggtgcagttggtgcatgcaacagttgtaattcatggttcatgtactgtgagtgcaaagaggccaatatggtgaatggcagttgggtgattacggttttactctttattcatggactaaacaagttctctgcagaagaatttttaaaagagactcaaatttgtacgcaaaatactactgagttgagagtatgttaatgtactaatgttttgagacctaggtaagcatgtgtgagatatttccagcaaaacttaggtgcatcctgtgttcaataagccacaaagggattcttgctgttcatcctagaatgggaaacctctggttcacagattgatgcaaatcaacatgtgagaagtacaacacactgagaggagcacagttcataatataccttatcaccttaatacagaactgttaagaggttatcactcatcaatataatgaaacataggtgctagctgggcaggcttaaccactttatatagaaatagcaccaatatggaaagagcatatcatattgtgaatttgtgatagtccattttagagccaggttctgaaggtactctgtgctcgtcatgtt

SEQ ID NO: 19473 - DNA, 1501 bp, Oryza sativa
tatcctatcttcttattgtaccagctctattttctgggactggtataggttagcaggttaatttggatcgtcttacattggtttccgtttggagctagttggggcgtgacacagacctagtccttttattgtcgtttcagatggggagttgaagtatgaagagacaagagagtagtatctgaccgtgctcggtcgagatgtttgatttcagtctgtaatgcaagtgagaaataatggctttggaagcccacttggaattgatatactgaatcctttgttcttggttcttgctcggatgagtagtgacaaggttgctctgtaaaaataaactgaattataacttgacgaaatcgtcaacacaaaaacctgagagagttgactgcattttctgtgccttaaaatgctgtaacagttcggtaaaaaaaactgctgtaacagtttcagttaatggaactggggttttaggccgtgttactcttaaatggatttgactggatgactcgtcaaggtatgaatttgttgtaaatagagtagagactagcctgcctcccatgtggaactctgtggcattagtttgtcatttgtgatcgaaccgctttgacaacacagcactttgccttttattgctgattgaagctgatactgtcgtgaaatgaaccatgtaataaactccctaaattttaatgaaatttggtcggccactctttctgccgacctggcaaaaaaaaaaagctgataatgttatgattttgattttgtgctctgctctgccttttgctcctatagcttttctgaaaacattgaaatgatgttgatacttgattggtgatatggcactagtgtctagtagactagtactccctccgtcccaaaaaaaaaaaagaggcaaactgtgggttcccgtgccaacgtttgactgtccgtcttatatgaaatttttttataattagtattttcgttgttgttagatgataaaaaatgattaatactttatgcgtgacttatctttttaaatttttttcacaattttttcaaataagacggacggtcaaacgttggacacggaaaccagggtttgtcttttttttggggacggagggagtactgatcatgagcccaacgaattggacctgaacactgctaattaattggtataagtcatctctggctccttgcaaaaataaataaatgaataaataaagagtcatcctttgctgaagaagtgtatgtattacatcggtagtggacttggtcagggactttgtgcgtcagaatttctatgcagttatcaactgcatggtcagaaaaggctggtgtataaacaagttggaatccaaagttcataacctttgcctaagcagtctgcaaagatctttatcagtacgaactctatataaacagagccccatatctcatcttccatcaccaacaatctctctaaccatttgcacacaacacatctccaaacccaaagcttctttgcctgaaactacacatccaa

SEQ ID NO: 19474 - DNA, 1501 bp, Oryza sativa; identical to SEQ ID NO: 18997

SEQ ID NO: 19475 - DNA, 1501 bp, Oryza sativa
taatacgcaaaggttttggattagctacaggagactgaaaaacttgcagtttgctgcagagtggcatcaaagcacaaaacaaatcatcaagcgaatgtgctatatccattcagtgttttcagaatagctacaggaacaggatcaaacatctcaattcaccatatttacccatctgaaaggataaaaagaaagaacccaacagaacctgctcataaagttcagagaagatgaagacgacacagttatgagttatcgacatggctcacctggcagatgggacaacccagaaccaatagaattttcaacaagttaaatcactcctagttactggcagtgtgcactagtctatcaaagcttacaattttttaagtggcctgtcccagtgttcattaaccaagttgactagggtcttgtgcaaaacagtggttttttaaaacatgaatagatacaggaatatactcatatatgtttgcaattgaatacaaaaagatggtagatgtaagatagtggctttaagcctttttacataattaatattatgagtcttgtcatcatttcttactccagcttattatagctgacctaagttcttactccccgagggcaaaagcagcggcatcgaaggtgtcagagagcccagttcccgtcttgaaggtgaccttctccggcgaggcatcggcgaggtagacctcgacgacgctgagccagagcagcagctccttggtcttcacgccggtgatcttcttcagcttccccttctcgacgaacgccgtgacctcacgggcataagacacagtctgcttgatcttcttgaaggtgtgctcgatcttcttcttcttctgcaccagccacatgaatccagtgtcccggttgtagccgaactcctcgatgtcctccaatggcaggaggcccttagggagaccgagctctcccagcagctcaatggacctcttcctgcagatggcatctccattgacgacctcagcaccggagcggtggttctcaatttgtgatgccattggatgtgtagtttcaggcaaagaagctttgggtttggagatgtgttgtgtgcaaatggttagagagattgttggtgatggaagatgagatatggggctctgtttatatagagttcgtactgataaagatctttgcagactgcttaggcaaaggttatgaactttggattccaacttgtttatacaccagccttttctgaccatgcagttgataactgcatagaaattctgacgcacaaagtccctgaccaagtccactaccgatgtaatacatacacttcttcagcaaaggatgactctttatttattcatttatttatttttgcaaggagccagagatgacttataccaattaattagcagtgttcaggtccaattcgttgggctcatgatcagtactccctccgtccccaaaaaaaagacaaaccctggtttccgtgtccaacgtttgaccgtccgtcttatttgaaaaaattgtgaaa

SEQ ID NO: 19476 - DNA, 1501 bp, Oryza sativa; identical to SEQ ID NO: 18996

SEQ ID NO: 19477 - DNA, 340 bp, Oryza sativa
caacaacatgacaaacacactcacatcttcaagggtgacttctatactgccaactgttaagatattaggggtagtttagtatttttcgcacctcttgtatacatttatatttgccctttaggactagatcaatgttactgttgaaatccccaaatctatctcttagatcaattttctgcaactgctcttgtaaactatggccactgacccagaagaaccgaacacgcttggcaggattgaacttggattttgagaaagagttactcaccttgttatctttgctattgtcttgttcatgggcatggtatctgaatctgtcaagggtgtaataccctctgct

SEQ ID NO: 19478 - DNA, 1501 bp, Oryza sativa; identical to SEQ ID NO: 18992

SEQ ID NO: 19479 - DNA, 287 bp, Oryza sativa
caattagaaacacacatgcttttgaaacttgatgagaaatctatggccctgaaccaaatctctagaattttcttacttctttggttgtcttcgctgcatggtcaatcttgtataattatacaaaagcaaattgaaagaaaaacaaaacctctaattcaataggttgacgccaaaaatttgatctaagtttcagaaaaattctacatacgtgtggaattggtttatgtaaaccacagtgcaattctagcatgtggctcagtgactgccttagtttgtgctccgcttca

SEQ ID NO: 19480 - DNA, 276 bp, Oryza sativa
ctacatggttgtgctaaatattaaaaataacgtctgaaagatgcaatttgagtatgtatgtgactaatcagtaatcactcactgtcactgacaaattattcttctaagttcccttccctgatgccatcctatcctgtagcttcacaagcatgattcttctaaatttgtgataagaattccttatggacactctactaataaactctatacttgtataccacacatattactgcaaatcaattttgtactgttacttatgggaaatgatggaacagg

SEQ ID NO: 19481 - DNA, 1501 bp, Oryza sativa
cctattcccaagaaaaatacagttgtgcaacagtattgtgtaatttccgactattgccgagtaggggttgctcatgaagaagatcagaaggttcccaaaattgacatgcaagatgtcttgtcagggagagttgcacctgatgggagatttgatgttgtgctatggagatctcacctgccgccatattacagctacatatatagctgtgagatccatgagtacaggcctgtattagctacctgcaagatggaactccggcaaaagaggaaaaaaattagattgaactagatggttttccatatgtataaatgataaagagtctgtcctattttatcactgaattcagctgtatgattaacactagattcatctttttatgctgtctcttgtaaacttatcctacaagctctattagttgctgtcttattgtttcctcatgtgaatctgtccttgataagcaggtctgttgaaggaacaggatcagccgcagttgtagttttgactgcaacttttaacttcagcagtcaccatgatccaatcattcaatactcaaccaagatcaagaggctatttcttttttcattcctttgattagtttgcaggttaagtaggcgatatgtatgaaaacatttatacatggggtaaggataattacttaattacctagttatgctcgtttgtgtcaaattggattttagattctagttcagagaaaaactagcctctactaatttcatgctgaaagagtgccctacttatatcaaattatatttatatgagtgggggagcccctcacctcataggctagtttttggggtggaaaagaccctttatgatcctacattaaacaacagtcaaatagtttttttatatagagtcttatatgaatgaattttcaaaattgtaattactaaataattaacttggaagttcagaatgaattgatttaagtgtggtaaataactataataaatactactccagtattcaagaaaggcgagaggagagatgggctgttgatctagagccattggttacatgttgggtggttggatgtagggactgctaaagttgcagtcacaactgcaactgcagtcgatcctggtgaacagatgctcactgctcatttccgatgcacataatctctcatattttttgagtgaacaatctctcatattcaactcttgagaaaaaaatatccacgaattgagttgttacacatttttaagtccatacatctgtttacatatgaaatgtttttatttgtgcgattgactacatcaaaagtccattattctttttcacacattgcatcccgaaattcaaataactacaactagatcatataaattaaaactaataatcatcccatgtattcttttctcttcttagcattcctcttatttcatctcctatatcttctcacataatttctcaacttctgtaacaatatgggtcacacaccttctctatgatatgattttggctcggcatccatcaa

SEQ ID NO: 19482 - DNA, 1501 bp, Oryza sativa
agtattggagcatggctcttgcaataatcagaaaattcagaaagctgaatctcttactctatggtgcatgtttttttgatggtccttggcagagggttgaaccggcatatgttaggagggtaaacaaaatttgtcctgagtatcttgtgcttcttgatgactataaaatatgttctggtcaaaacaacatagttcattgtcacacaaactgtgctgacaatgaagatgaagttcccaatggttagtttgcacgattttctcttcggaagggtacctcgaggtaaatttaaggttctagcttttagatcccaccttccacctcacaacaactatatgctccattgtaaggtacagaggtcatatcatatggtcaccagaaacaagagatctatgaagtttttacatgaccatcttaggagctgatgtataatgtaattatgtcgaactgtaatctgaatctgagcatttgttgaaatgctttcacctactgtctgagcggctgcgccatttgtagtccaagctcatgtgtatgtgctattttaagaggttgttgaactcaagtcgtcagaatctattaacattctgtatttgaagtttgatcatgtcaccatgcgtgaggcacaaagacacttgtccagaagtcaatgataattgacagcaactaatatattgatcctgtgtttactgtttctgaacattcattgcttgttgcagcttgcaacatacggaaagcatcctaatacaaacactccatggcattatgatcacactaattacaccagcttcagttagaggttcagtactagcatcagcactaactctcaacaaaaaaaaagaaagaaaagaagatatttctgactagcttcttcaaccctgtccagagggaaaagtgtactgatcccagagagaggaatttcagagaagtgattaaccataattctactgtttaaggataacatttgctgatctcgttttctccgttcatgccattttctctactgttccagacagacaagtagaagccaagacttaaatctaaataaaagaaatagcaataaacttgaaatttgtcctggcaggaaaagaaaaagagaaacaagactggatttgtgtattggggcctttttggcatcatcctgaggaatggatacgttggattgattattagcaataacagcggtagtgacaagaagttcagatcctttctttttctgtcaataacagtggtagaagtagatggtactgactgatgaactgaatctgtacaattctttttgttgctttcattgtctgcgccatgtggtcagtcttgtacagtcatgttaacgctaactgtagagaaaaacagacacttgaattcaaaacagttcactctgaaaaatatattccaagtacgcatggaacactgtttgtgtaaaccacagcacaatgcattttcctggagctacttgagtatgtggttgcctaatttctactctgcttcaccagatcctctaaattt

SEQ ID NO: 19483 - DNA, 1501 bp, Oryza sativa
catgcaataacccatcctacacaagttaagaatttagagtctagccaagtgtaatacacgtcccggtgctcaataaccgcgagcacggctactcgaatagatttggtttactcacactgcagtggatgtacactttacccgcactccgcgacttcccaacacatgagcctcgtcccaacacatgagatgtgtcacggcaaaacttttcgacaacctcgcattggcagtacccgctccatgaactttacatcctcatgcactctaggcgtacacggtttctagcagtgagaggagttctggcgcacccgggaaggaaagactcacacatgcattaagttataattatgtttaaattctcacatggcagtcctactgatggtgacaccactgtagacacccgcctcgcggttctaccaatggctgccccaccgtagagcccctgcctcacacatcaagaaaccactatgcatggatactgcctccgctcagctatctattctgctaggtctatacccatacgagaagtgcggttgtacgggggtcgtttcaagcttaacttcatggctcggtccttaattgaccggggacggtgctagcattttccagataccacccaaatcctccgtccgccccagccgaaaacagttgtttaattttatttctccttccacaaatcatgtcatcaacatcagggcaatgtggcgctcatgtctccacatgccgcatctcaattaccttcccaaaggtaattgcccaagcatataacatttgataaatatgagtatgcatgattctaaaatagcatttctaagcaattgtcataattgactagggactcatacgtaaacatggttacgaaggaataagggggtaaacaataatcaaggcatggcataatcgcaagtaggatgtttatcattgcatgcaatttttatttgtaaacaaaataattttgcaattggtatcaacatgttcaaggaatagtaatgacttgtctgctcaggatagtccttattcttgatataattcttgatcaaccttcacttcctggaggctgcagacgttgcctcacgactaactgatacacaatttctataataagcgagaaaaaccaatattcaaacaacaatcaaatgtgcacaacaaaatgttatattcgtgtttgctaatggattccaatcatgctaagggctaaagtttcttaatctttctattgtcatcatggtctatttaggagttaaccaacatagcatttattggatacatatatatatttggctaatcggtggtttagtctatcaaatagctatcgaaggattatggctatatatgcatatatctaaataggacggttatatattagaggttctgttgttagatggatttaggatcaatcaaataatgaatcatttgtattattatttagttgatggaggctttactttaattatgaacatattttacttgtcacaataaattataaaaggttaataattatcca

SEQ ID NO: 19484 - DNA, 736 bp, Oryza sativa
ggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtcta

SEQ ID NO: 19485 - DNA, 1501 bp, Oryza sativa
ataatgttgatgttgttgcatgagtattggatttttggacaaagttatgcatgattccagtcatagtccagttacagtccatatgcactgcagttacagttgtaatttttgttatttctcactgtaactgaatatacagttctaattttttggttaattatcactgtaatttttgtcatgcttcatgactaattttttacatacataaatttgtgctagatgaaattttctatgaagatcagatatgatgcacaataataggtaagcatgattttctaaccttcaactgtcttctttcttcttaattcttcagttgtatttcctgttacttgagactttgttctatcagcccctgcatgtaatttaaatcaagtatggttggtgcatgtaatagaaatatttaaaaagcatgttagttttatatgttctaggtaatctgactacctaacttaaatatttttggatttcatgcagtctgaaattacagtaattctaacttaaaacatacttacagtacaactcgtcaccatttacagtccagttacagtggaaatatacctaagttacagttgtaatttctgttatctctcactgtaactgactgttggtagttagattttgtaattgattgaccttgggtatattactgatttgtgtgaaaactaggacacttgtagtttgggaaccctagggactcttttttgtcagttgtgcatgcataagttagaatatgtgtacttttagtttcataaaaacaatagtgagtttgtattgcttccccttatgttgtagattttttttccagtcaatgcagtgtagggttatcatccatttttgaattaattagatgtttttactgaaattagcttgccttcttgtgccattgcaagtgtgaggccgcttcatttatgttgtctgttaatgtatgcaaccaacattaactttctttctttgtcttgcatagattctgctttgtttttgcttaacaagtgctgcccgggacataactcttatgtgtctacttattcctttcattaaaacagaaaaggagaactagccaggtaaattctatgatcgtcaaactttttcttgcagaaaaatttatggatgtatagctccatgtttttttattggttgcatttatgtggatgtcagcttcaatatatgttttctattaggaaattacccacaaaaaatatatctcttgaggcatttgaatggctgatcttaaaccttgtatcttttttgatttagttatggtatttgatgcccacttctttcatctggggatttagtttagttttcaaattgtattttcagttttgaatctttgatttaacagatgaagtcaatattttaggtttcatgcagtcctaaaacacacttacagtgcaactcacaccacttacagtggaaatataccttagttacagttgtaatttttattatttcgcactgtaactgactattggtagttagattgttaattattgatattggt

SEQ ID NO: 19486 - DNA, 1501 bp, Oryza sativa
agtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacat

SEQ ID NO: 19487 - DNA, 1501 bp, Oryza sativa
gcattatcttggacacgcttcataagttgttaaacaatacgatttatttgcaagcattcttcttattatttatttgaaaatgttttaaaaccaacttcttaattttctaatactggccttaaataattatcataaactcagtttcaaccacaatccattatatatatcaaatggaacaccaaggaccacattttagtgagaaaatagaatattttccactttaaaacttgtcgccttcaaatactagcactttttttttgttacgaggggtcctaaaatgacgagttgcgacatgaaagcatgaaaatgtacatctcttttttatatatatccatgcgacgctgaattgctgaaacaaggagattcgaattgcagagctcctggattttgtctcttgtgccaatcaacttctgaagaacaaggctgtcagaatagggatagtaggtaggagtaggatcgtttttatcataactgtatcgaattgtagaatcggattttaggatcatgatcatatcaggttaaagtacatattttcacatataatttgttagacattatattaaaaaccgaagcccataacattgatttttgataaatttaattttttgaaaacttgaatagacttattaacattattttcaattaaatgaaacttaaataatatatacatatcgtaaaaccaggatcctatataagattctaacgatcccgtaaaatcgtgtggaactcgcactaatttaaaatagtatgaaaagtaggatacatggtaagatcattatcttaacagcttgccgaagaaaagagagggacgataatctctttatctagcagtgactttcggactggctatattatttggtcgtccaaacgttgttagtatacatgacaacgctggattgctggaagcaattaatcgccttgttgcagaggattcaccaagcagccgttcaacctgctttccatctcaaccgtccaaaaccaagtctttatttggtaatcagggaaatggaaaggaaaaggagcaccgaaagtcaatggaagctctagcctgcagtgtactgagcgttgcggttgaattgaattgagcttagcttgcaaacctctataattgtctgctccgtcatgcctactacgtggtggtcacatggaggctcagataataatatcaacttcaaaaatgagtaagcagcagcattatatatgtatacagtatacccagatgttcatgttcctacctactagtagtactgatcaatcagccaaacaacaactaccagatacatgtagcagctcattctccagttctatacagttgataattcataagtggaaaggtttgagctattggagaacaacatcatgtgtgatgattcctatgctcgtttcagcttccatccatccatcaaaactcaacgatggctgtgtttagttcagcgcaaagtttagattttggttgaaattagagatgatgtgactgaaaagttacatgtgtatgacatat

SEQ ID NO: 19488 - DNA, 1501 bp, Oryza sativa
gacagtctatacctattaatagatagttccgtcatgttggttaaaaactcatggtaccagtgggtacccagtacccgacgagcatggatatggttttttttcccacccagcgaagagtattgcacatgggcggacaaggagttttcgggtctcgggtcaagcatgttcttgctccacccaaactcgaccgacccattgtcatctctaaacataagtgtccatagtatgatgatatctaaagtataataaaatattagaaagaagagataagcggttcagctatggtgtgacgaacgagtgataaatgaataaaaataaatagctgatataaacctacgtagatgctagccacgcaacaaaaactgaagacgtctaaacgaagaaaaccttacacatgtattcaacaccacgcgttatatctttgcgtcatcgtaccctgcaccgttctatccacactttagtttttttttccctttccacaaaggcccattgcaaggaagaccgtattgccattgtttgatttcttacatgctaggaaaaaaatagtcacaacaaaggcaaaaaaaaaactacgaattaaaacaccgtaaaaatactacaaattcgaaatttcaaacccattttgactatggccaagatttatctatattcttttgtgattaaaaaattttgattgtgaccaagccaaagtgtgatattgatgaggagcatacgaggatgagaggagagaggggtggtgtggtggtggtgtggtgggggtgggggtagtcgacaaagcgcccaaagtcaaacccaaccaaaagtcattggctccatcgctgcggtgggctgacagcccgtacatttttttaatccacccccgaccgtggactttgcaccatttcgccccccctttttttagaaacaaaaaacccacaaaaagtcgcccacccaaagctcgcctcgcctagcgacgatcgcgagcactcctcctcctcctcctcctccgactccgatcaaatcacaccggagaaacctcgccgtccggccacaccggcggcgcgcgctctctcgctgtcgggggggttggcggtggcgcagccgcggggcgagaaaaatctggtctcggacgcccggctttgttgactaaaaccgggcgggcggcgggcggcggcgactacttcgcacgcgatccgcgccttccttcctcttcttcccttgtttggtgcctcgcctcgtctctcctctatttcttttcgcttggtttagttggatttttgcgttcttggtggtggtggtggtagtggtcgtcgtcgtcggcaacgcgggagacttagcgttcttggtggtgttcgcgatctttgcggcgtccagtggcagtggattgcggtggtgggattggcgcggatcctgttttgctcgtttggttgtcgatcgccggcggtggattccggtggtggaggtgtttgggttgtgagctcgtcggcggcggcggcggcgcattgggtgttgggggccgaga

SEQ ID NO: 19489 - DNA, 1501 bp, Oryza sativa
caacacagcggtgaacggggctagcaaggtgaatccaccagccagccagaagccagcctaacatggtaaattccttgctataataacgccctaggacttttgtgcgcttagtttacttttgaaatgtaaatagggccacgtagataccatctattctttgcccccctttgcatttgtagctcaattcctttctgaaccaaagcactggtgaaaacattaggttagactggatacaccgtttaatcgctttgccttctctgtgatgtcttagactgatatgttccatttgttaagctggcctgagattatcatgccgccttcctgtacagcctcgcctctttctccgttggatagtttggttgattggccaaatattcagaaactatgtcattgtggcctgatcaaactgtgaagatggcacgccatgcaagttgtctctatcggctttaatttatggctttgaaaaaaacaggggatgaattctggaatggccttgtttttggctcaagattttttccatgctgcacgcattgcgacgaagatttggagtgtgatagcatttcatacactctactgcatgtactgtaattgatgatgataaccgcgtggttgatgtgtcaactgctaccgcacacagtggatgttaagacctctgtttggtgtaactgtcacacacggtggggctgcagcctggtgaccacgtgtgccgtggcagttggcattttggtcactcgtgtcttgtcaggtcgcttgctttgatcattctttgccattgcggtgacatcgtggcaactggcaatggacggacgctggcaatgctgctggttgttcgaagctgattttaagttttgccagaaatttattttaaaattagtcattttgtcgtctctaaaattgtttttgattagtaggagtaatccacaaacaggcggggccgagataacctagtacagtagagaatcttttggtcccagaataaaaatggcactattccactacagagtgctcgtcgtatgaagcatttgcccagcagttcgttcaaatgggacaatatttggatataaagaatcctacacattctttgtgaatttgtacgttacataatgccgaaattccctttgtcgccgaagtattcccttcggcatataccaatggttggggccttagggtgtgtacaatggtaattaatgagactattgattatgaatctttactaaaatggaagagatagaaagaagaaaggaaaaacatcatttctacagttaacaacaacgattatttgctctctataaaatggaagcttggctttactagggtgcttggctttactagggtgcgaaaaaggaaataacagtaataaaatagtactacctctgtttttaatagatgaccgttgactttttgtcacacgtttgatcactcatcttattaaaaaaattacataattctaatttattttgttgtgagttgtttttatcatacatatatactttaagcatga

SEQ ID NO: 19490 - DNA, 434 bp, Oryza sativa
gtgaacccaaaccaacgcgcatgcctacacaggcttggggggctctctatcccgatacggcaagttaaccgttccgttcaacaaccgcgaacggaacacggtggacggagagacgcgcacgtaccggtcgcgcgcgcgcaaagatacaaacgcgtccctttctctctcgcgcgcgcaccacggaaaattgagcggcgcgtttacgggagagaacggcgcgccgagactcggttcgcacttggcatgtacgtaccaccggccggtcagcgtcacccatctgctgctcggccgcgtggttgttagcccatgcgcgcgccgccacgcctacgcggttactcccgatcgccaattaaaccacaggtttctcttacgtgatggtcgagctaggtggaattagatggatatatatccggccggccgtacgcatgcgtgca

SEQ ID NO: 19491 - DNA, 1501 bp, Oryza sativa
ccgctcctccgcctccgcctccgcctccgcgtgctcccgtaaccgcgccgccgcagcctccgcctccgcgcggttcctcccgcaagcggcttctccgccgcgcgcgtccgtttctctcccgatccccgccgcccgggggggtgccgtgcactcgtcgccgtcgctgggcgcctgccgtgtcggcggcggccggtgggcgagattttgtcgccgcgcgcggggcgggggcacggttggttttgaggcgagattgattgccaggtagctggcgtattgtcttatctacgtttgtcctcgcttctcatctcacctaatttacatggtttgtttcggttgaattgttcatcctttgttcttgtataatgggcgacttggagaatttaggtcaaatcagtcggatgagcaatccgtggttaataccggtttgatggcactaattgtagcttacttggaggggtggagttttgggactaaagcatcttaggcgtcagatttgccgtcgaactttcaaccatggagaattatatggagcaacattaattttcctcaggcatactgttgctgcacgataggatttttgttctccgcgacctgttaggcatcatgttaattttatttattttataattgcttagttagaaccgccagcccttgttcatctaggaagggatacatcgcgagacagaaaaaaaagctaattacacagataagttgatttgccctggaacttgatttggtttgatgataaagtaacccgtacaagaagtatacgaaccatttaggacccaatgagagcaccactttgttcaacttcaatttctatatctttaatcgctatcctcaatgattaatggcaactcctaaaaatgattggttgcagtggttcacattttagttccgaaagatctgtgctgaagtggtaccgtggagtagctttgggcattttctgtggtttatcagtttcatgcgttaagttaagacctaggtttgatttaatgaatgccatgttctatttattcacaaaaatgatgtttcattaatcgtttggccaagccttcattattaatcagtttttgtgaaatttaatttgtcttgttcttggattgtaaattttaattatatagatctcattcgactgaccttggtgaagctcttcacaatatcttgcaaattgagttatgtatacaaatgtgatcatcaatttttccacacagtagaatgatattaatttatgatctcttgcaggttcacaatgaatacagaaggcctggattcttgtgtataggttctctcttctgagagacatcactgaaaattctcacagaatgttggagggtcaatcttgcttgatctcaaggtctttgccaagctcctgtgatcaagaatccagattagcatacatgacctaccacctccttgagataacgaggagtaagcgcatatcaagtactccgaggattgaacctgatagtgttgctgcagtagcagtactgaccaaacg

SEQ ID NO: 19492 - DNA, 1501 bp, Oryza sativa
tctgaagcctgaaaagcctatcttggcagtgttgcacccagtttcaacggtaagtagaataaagatagtggaatgaaattaaacttatgtttttactatatgttctttccttctttttacaacagaaaaatatattaaacaataagatttatagtctctgatctccagttcattttttatttaattttctgaaacttgcagcacgtatgtcattttcgccagtagctatagtaaaagcactgaacaaataattacataaaatttattgccgaccattttaaaatacatatcaagagcttagctgccgtatatcaccacaagcaaatagttagaacgtagctatcgacttatcgtgattcctgcagaaatgattctgggaggtgcaggaacacagctacatctctttggatgctcgaacaacatgtgaagcttaatttaccagctagctgtaacaatgggccccatcgtttcgcttattttctaataagccaaaacagtttattaggaaataaaaataaatttataggtaaaacttttatatatgtgttcttggtgacttaaaaaccaatgctaaaaaagaaactatgttgaaaatatctcaaaatcaagtttgaaaatttaaaatttggttttttctttgacttaatgggccatccgatgggagccaatgatacacgtactaatcatgccacatacggataactattctaaaatctcgagggatgttctctcattatttgtactctcgagggatatcctctcattatttgtacgtcacttaaatgattatgaaaaaaaaagaagacttattaatatgtgatatatcactccacaaacatgtaaatttaaattcaatttgtacatctcgtaacaaaaaatcaaattaaactacagctagttataacattgtcagggttatggataccacatacctaatagtagttgactaaatctcggcaggacccaccacataccatgtcttatacggaaacaaccttcggatataggaggagttccggataaggaaggacaaccagagttctacatagaaacgacaaagactactcggattgtattcatattggtctccctagttctacttggacaagggaacacctatgggtataaatacaagaccccctaggaggagaggggagagaatcaacatgcacggaacaacagaagccacaacatacaagccaacatacgccaagacaagccgccggatatcgacatcatagatatgcctggatcgaccctatccggtacctacagaggccggccgtagggatctagcgatgtctctgatctcgctgggcacgaactcgaggaggaagactaccttgttgtcgactacgagtcagaccttcagaccgccatgtcaacaacagttagataggctaccccaaatattgtactggtgtgattataatgaataagagcaacgatcggctttggccaacaggatgtagggctattacctgacaattcaggggcccga

SEQ ID NO: 19493 - DNA, 297 bp, Oryza sativa
gaaaacactccacacgcttcggagaggaaaatcaaactcgatagcaaaaagagtaaatactccgcacgcttcagagaggaaaatcaaactcgatagaaaatcgagaaaacactccgcatgcttcggagaaaagctaaactcgataacaattgagtaaatcctacgcgccaagatttaaccttcgtccgaaaacctaacgataaaacgctcgaacactcttatccgattcgagcaaaaagtggaaaatccacacgacgaggtaaagcatgttttcgacctcgtcacttctttgaaagg

SEQ ID NO: 19494 - DNA, 340 bp, Oryza sativa
ttcccgtgccaacgtttgattgtctgtcttatatgaaattttttttataaatagtattttcattattgttagatgataaaacatgattaatactttatgcgtgacttatctttttaattttttttcataatttttttaaataagacgaacgatcaaacgttggacatgaaaatcagggtttgtctttttttttaggacgaagggagtacgtatgttgctttttgtcttgtactacctataaaacatagcacgagaccttggcctgggtcagcttgcctgaatcgggagaccctgaaacaccccacccctgtgaccaagcagcaacaatgtgcaccgcagg

SEQ ID NO: 19495 - DNA, 1501 bp, Oryza sativa
gcaggaggtcgtgcgccacctggatgcgcaggagagactatagctagattccacagcaacacatgacgcacatatatacccatctatcctccttccaaagcttgctttggttatgatcaataacttatgattagggtatagaactactactactggtactaataaccgaatacctgtactgctggagtagtagtttgaagtggacaaatggtagcgccgcccggattaatgatgggctggctggcaaccagaatgtgctgctccaaacctccaaccatcaaagggcaacgctaaattactactttactcggtgtagatcaacttcctgagttgtaaattgtactatctcacggcttagtttaagtcactcttgcgtataatataagatacaccatacatgtgggatagcttgctgcatctgggtaagcttccaagctagatgcagctcggtaccatttccttgcaagtacgaatcttaacgcaggcacgacagattgaaacaaggacaaggggaaaatggcgcaagcatcccaaccacccttgtctgaccaccgagttacctgaaacactcatgcttgtttttattatacagctgcattttcattatatttacgtttcgtacatttttcagcgtttgttatccaaagaaggcataattttacttggaaaaaacgcgaaagtcgttttactctttatgatgtatatacccgttctttacgtatcaatagtaattagttatggaaaaaaataatagcaatgatagctactcctatgtgatacaccgtaaaccaacaaactagttcaaatgcaacctacacaaattgataaaaaaaggaaactaaccatgaatagtaaatttgtactatttagtgaataaattgttttcctttcttcctatgtggatcgaatttggaattgatttttttctcagcacaatagataagtgatgtattcaacacaatcattttctatatatttttaattatttgagacgtaaaaaagggaacatacccataaaggaaaaatggtagttccaaaagtaggttgtgttttaatatactcacatgttgcaaagacatagctagtcccatcatttttatagtagctgattatgagccataatatttattagcgacttaaaaagtaaatttaaattaagggtaaagttaacctttaaaatttaaattttgcctgcagcttgtaagttgagcaaacgatggatcgtaatgtggtacttaattattgatgttggtatgaaagtataatatagtattaaacttaagactgtaaaaactcttattttttttgtgtgcacgcctatacagattgctcaacagatccaacttcataatttggtagtagtagttaagctatacccacacggagaggagtaaaaaccaaactaggctgtgttattccctcattttcctaacccacctctctctcgtttttcacgtgcacgcttttcaaaccgctaaacggtgtgatttataaaaaactt

SEQ ID NO: 19496 - DNA, 544 bp, Oryza sativa
cccttattttagagatgaagggagcagtacaatctaaagtggattattggcaatttggcacgaaagggggaaagaccggatcggagggggcatggcgccgccgcctggcttgcaagatgaagcccgtcgtgcagcgctgcggacactggacagtgctccacgcctcgattcacgggcgcgcgcgcgcgtggcctctactccgtcgaccgggcacacccacagcatcatcgatgatcgataaaacagtgcccggacgtttccccgctgttacactaccgcacgcccccggtcacgtaaccctgctgcactcgcagagtcgcagggcaccggcacgccacagcccacacccatactccgcccctgctgccagcctagctactctcacgcgttgcccgccccgtccaggctgctacacccacaccacccgcccgcggcctcgcccgcgcgtgcatgtgccgcgcgcgcgcgaggcgtccaaactacgtcttctcgcgtaaaagaaccgagacacgcatgaggcctgaggcgcgcggtggcgcacagc

SEQ ID NO: 19497 - DNA, 880 bp, Oryza sativa
acgagaaggcccagctcatcgacgagatcgccaagtcgtcggagctccaggcgcacggcgtcgacttcctcaacgtcgtggtggacaacggccgcgcgggcctcatgacgcagatcgtgcgggagttcgagaacgccttcaactcgctcccggcaccgaggtggccaccgtcacctccgtcgtgcagctcgagtcgcaggacctcgcgcagatcgcgcagcaggtgcagaatctcaccggcgcgaagaacgtccgggtcaagacccgcatcgacccggagctcatcgccggcttcaccatccagtacggccgcgacgggtccagcctcatcgacatgagcgtccggaagcagatcgaggagatcacctccgagttcgagatgcccgcagtaaccctcgacgtctgatcggcatccaccaccctcccggcggcgctgccttggcccttaggtcctctcctcctgttgtctcttactcttgtgcaagtgcaacatacattgctctcatgtgattgttgaatgtttggtaagcattactgctgaaataatacatagctggattccaaaatttgcactgtttgattatcttggcctgcatattttttttagcagaatttgtagagtagcgtgtgttgcgttcactagctccatgtctcggcctcatgggggaagttttcaatagatttgctctgccaagttcagagtagaactgtagaagattgtcttgtgcgatggagcagagaaaacaatcattgaaagtagttcataagtgtgagggcattagggcaaagtggcgaaggaatttggcttttgtgatcacatgaggctgctcttataatctgcaaacctgtcaatctaatatgcaaatgcagtttaattagt

SEQ ID NO: 19498 - DNA, 1204 bp, Oryza sativa
gggtgcgtcccgggtctcgccgacgcctacgagtctgcctgtgccgggaagacgccggtgcaagctgagtagtgaccggacttgggggagaacaatggaggtgtgtatgtgtgtgtgtctcacttccattggataacttcattctactgatcaactatagcagggatggcagattcaattcatggtcattttagtgtaggtttcttgcagttgacaaggaggtggatgtgtataacaaccttgagaactgttcagttgtggttgaacaatgttcagtgggttttcatataaaatctgtgagcattacgtctcctatggtactcattttctttgttacaggcttacactctagctggcttctggcatgatcagcgatcacgatgtcctgatgtgcatcttccaattccaagttgaacgagagaaagtgaagaaccatctgagcaaagatataactagataaattgcgggactagggaagaacactctacataaggagatggaaaaggttgatctggttctcagcaaatcatcagaatgaggagtgttcctctacggcatagaacaagttgcggctgaagctttagaagaggttatttttcaagctgttcaactggataggcagaggctttcctatcgtatactagcatgtttcttggattgcatgcctactgttgcaaagcaaaaacttaggcaacccaagattagaaaaagcactactccatatacttcattcacccgtttctaaatatttgacaccgttgatttttttttaaacatgtttaaccatttatcttgttaaaaaaattaaataattattaattcttttcctatcatttgattcattgttaaatatacttttatgtagacatataatttcacatatttcacacaaattttcaaataagacaaacggttaaacatgtgctaaaaagtcaacggtgccaaatatttagaaacggagggagtaataaagagagtgaaaaaggatgccgtggagttgagtaggcccaacaaatccgggatttcatgggttacagtactttgggctaaaattgtgttccgtaggcccaagatggaactcgatcacgggccttatttcttcttcccgtgaagactgaagcccaaatctccctcaccacagggcacgataccgccgtccgttcgcggcgcgacccttcgccgccgcgccgccgcgccggcgcta

SEQ ID NO: 19499 - DNA, 291 bp, Oryza sativa
attccggccatactagcagtggcgggcatatgcgacggcgacggcaggagagggcaccggcaggtgtgggcgacggcgcgcggtggcctactccttgctcccccgcgcacggcggccccctccggcggtcgagacgcgggatctagcaggcgacggccaacccccacaccgatccggcggccgaccaccctccctcgcgcgggatctggcgcgcggcggcctccctcccgacggcggggtacgcagcccctctccttcctctccctccggcgtggtcctcgtcccaccagc

SEQ ID NO: 19500 - DNA, 1501 bp, Oryza sativa
acgccaaagatcgggttttgatgaacaattcttgcttccgtgtgggggttgaaagcgagagggcggcgactcggtgggaggagaggaagagaaggggaggaaggaaggagagaagagacgaaagacgaggagggggcacaggcacactggggcttccttcctcggtaatttaacagatacacccaacgagaagcctcaattattttttccactagcacggagacggagacggagccatccatggttgcgacctgtgaaagtgagaagcaggcggggaattctatgcccgagacgatggaatcaatcgtcggaactgcacgtcggcgacggctggtttgaccgcgtgaacctgcctcatcgttggcgtcttctcccctgtttttctcctgcgccactgctgctgcggctgagctcatgcgcatacattgctactctagctgctggcttcgctggaagtggttgtactggtacaaaagattggtttgattctgaacaaacacacacgcatgatgcatatttttagcagcttggatgagttttgcacgttatttacatctccagtcaggaaaaaaaaagttaatcttaattctttcttcttctgttgacgtcaaaatgactcctcttcctgagttttgaaagggtagcacatgaatggatttaatacagatagtaaatggatttaatacagatagtaaaagattatccttggaggttgaaatggtcggagacggaagcacggagctttttctttaaacgatggtcgttgtcacatgacagttgttgtgaaaatgtggagcaccagacgcaactctttttttctgaaaaatcttgacacgtctcttcatctaaatgtctctggttctcaagcagggtaattactgtttgcactttccggtgataaactggcacctgcaccccattagaggtcatgagtttgtgattagctagtctgagaaggttggctaatactctgacttgctaaccaatacgattagaaattagaattctcctttgacttacggatcaactaacacaattagaaaatagtagaattcccatccatacagcatctgatagttgcatgagacttgcatatggtttgtatattctcagaatctcaggtaacaatccacagacagggataaccaaacgaaggaagcacccaattattcgaggtcagctgctaaacatttcctggcaggcaaagcatctgacagctgaatctttgttaaggctgcatttgtcaggcttactactgtatcttttggtgatttggtcctcggctgaactaggaaacacgattttgcttatgtgcatatgcatacatttacaggagtgaaatctgaaaaaagtccaggctacaccaactatgacaaacctgaaatttcaagcaaaaagggaagacacgacgtggtaaccgcacagctgaacacacggacaaaacggcatacatatgcagtggttgggtttctttgttctatcgtatgatgcaatcaaaaaa

SEQ ID NO: 19501 - DNA, 1501 bp, Oryza sativa
ctaaacacaccctcactgtggaaatgaaggctgctctgtatttcgatttcgacgaattttttttatttgagttagtccatttaagtttgattaataccactccgtgtgattgattctttagcaaagtataaacgaatcgttttttttaaaaaaaacgtacggaatagtacgagatgtacgcatgcctgagtattcctggctttctacgttgtctctagagtccacagttccactctccactgtatttgtactcccaaacaacgtgtcaatttcattgcacgacatgttccgtactagtatcactgtgtatccaaatccaatcatcatatggcaaaaagagctaaccgattagacaattcccgtgtttcttaggcctcctttaatggttgagctagtgtactagctcatatgcttgtccacctcatataaaagatagcaacaagtctaactctctaataaattgtctcatagcacattgtttaaaatgttttggtttcacaattcctctcgcattttctttaggagcttagctcttgaagaagagttagtgcattctctctccttatcttctctctcttccacatcatacaaaagctgatgtggaaatttatgagctagctgactcatccttgttggaggaggccttatgctacctgtcaaacatatttttgccaatatatcgttccctggatataaaaaatcagctcccggcgcagaagaacggagcgctggcttctgcttgattacggttgtgtttagttccgtacaaagtttagattttggttgaaattagagatgatgtgactgaaaagttatgtgtgtatgacatgttgatgtgatgaaaaagcactgaagtttggattcaaactttagatctaaacacagcctaccgagagggaatggaaggaaaaaaagaccaagccaggaaagacttccgctgctctccaagactcggcacgctagctagctcttcgttccccctcgtttgctctgtacgaggcagcagctgaggtgagcgtcacatgccgctgaactcttctttttctcggtcatatggactcatgatgcggaagaccaacacgcgccgcacaaaaacagaagcgacgacgcatcacgcatactcctatagcctaggaaaacatggtccctttgttgttaggcctaacatgggtgctagtagtaagattttacgggagacggcgtgttttagcatgggtgcagcaactgtgcaagtcctaatcaccagtttgtgcttgtgcactcgactttttttgctgatgaccacgtctacgagagtccgggctatagctgtaatcagggagcgaaacggggaaagtgaaaggaaaaggggggcgaaaagagattcgccccacgcgcaggcaggcagcagctgcattgttgctgttggttgggaaaggtacaccggtcggcgccggatggctctgcttgcaaggacacgtgttgctgctacagggagagagacctttgatcatcctcggct

SEQ ID NO: 19502 - DNA, 1501 bp, Oryza sativa
ggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttaaatttggacgaattttattaaaccgtaccgcgcggtacgggtaaccgtacccccgcggtacgggcggtaaccgcgcggttaccggcggtttttcacaccctgttcctctctcgcctttgttaggccgaatgggcttctttctctctgggatttggacggtgcagaaaacggcagcccttttgggaaagctagtcctctctctttttcatcaggatgaaagtagtcgtactagtgtttagggggtgtttaagaactagagactaaactttagtccatatatccctaggagagggacttatgcttttgtgagatgggctaaagtttagcccctctctcccaaacacccccctactgtttaaccttctcaagtaaaatttctttattggagcacatatgctaacgggagtgatgctctgtttaattctgtaagagcaggtacaatagcaagctataagccaactgcaaacatattttaaggagataaatcaggagagagaagagcagcgggctacagatttgtagtcagctgtagcacggaccccaagacgcagtgtgtctatgataggtgggactatgtattaatagtatagtatgtaactattgtatgaatgagctattagattggctatagatgaattggagctagtagttggctatactattgaacttgctataagagcaggatcaataataccgcccgttgctggctataaaattcaccatgtcatttaataggctatatagtatatagatgtagcttgcgttttcttccttgggcaggccaaaagctgcatgcacaaaccgattgctgttcaatcaccatttatcctgaacagctagtacccaatcactatgcgtaagcaagggtatggccaattacagtaaattcacctagtcttggaggctacgtgcagccggcgttaatatagtcgcccgcttaagttctctgtccttgattccctccgccaactcagctttttgccatgatggatatattatagcctgcttaattctcctattgtacttgctctatgagcttaagttcctgtgccgagagatcaccagattagagcaaggctaatggtatagcccgctgctggctaatagcctactcctaaagc

SEQ ID NO: 19503 - DNA, 1501 bp, Oryza sativa
tgcttgaaatttcaggtttgtcatagttggtgtagcctggacttttttcagatttcactcctgtaaatgtatgcatatgcacataagcaaaatcgtgtttcctagttcagccgaggaccaaatcaccaaaagatacagtagtaagcctgacaaatgcagccttaacaaagattcagctgtcagatgctttgcctgccaggaaatgtttagcagctgacctcgaataattgggtgcttccttcgtttggttatccctgtctgtggattgttacctgagattctgagaatatacaaaccatatgcaagtctcatgcaactatcagatgctgtatggatgggaattctactattttctaattgtgttagttgatccgtaagtcaaaggagaattctaatttctaatcgtattggttagcaagtcagagtattagccaaccttctcagactagctaatcacaaactcatgacctctaatggggtgcaggtgccagtttatcaccggaaagtgcaaacagtaattaccctgcttgagaaccagagacatttagatgaagagacgtgtcaagatttttcagaaaaaaagagttgcgtctggtgctccacattttcacaacaactgtcatgtgacaacgaccatcgtttaaagaaaaagctccgtgcttccgtctccgaccatttcaacctccaaggataatcttttactatctgtattaaatccatttactatctgtattaaatccattcatgtgctaccctttcaaaactcaggaagaggagtcattttgacgtcaacagaagaagaaagaattaagattaactttttttttcctgactggagatgtaaataacgtgcaaaactcatccaagctgctaaaaatatgcatcatgcgtgtgtgtttgttcagaatcaaaccaatcttttgtaccagtacaaccacttccagcgaagccagcagctagagtagcaatgtatgcgcatgagctcagccgcagcagcagtggcgcaggagaaaaacaggggagaagacgccaacgatgaggcaggttcacgcggtcaaaccagccgtcgccgacgtgcagttccgacgattgattccatcgtctcgggcatagaattccccgcctgcttctcactttcacaggtcgcaaccatggatggctccgtctccgtctccgtgctagtggaaaaaataattgaggcttctcgttgggtgtatctgttaaattaccgaggaaggaagccccagtgtgcctgtgccccctcctcgtctttcgtctcttctctccttccttcctccccttctcttcctctcctcccaccgagtcgccgccctctcgctttcaacccccacacggaagcaagaattgttcatcaaaacccgatctttggcgtggccccgtggatttcttgcgatctgtttggtgctatggatttctgatccggggtttcttggatcttggggagtaggaggtggggggcggcgatctggccgggagatgg

SEQ ID NO: 19504 - DNA, 1501 bp, Oryza sativa
aaaacccagcaggagtactttgttccttggcatcttccatttcaccgagctgaaattggtggtgcatctgctgctgctcttgaaaatggatttgcaaaaagagatgacaagaagggtactgtggtctacaaccgctattaccatgtttttgttgaaggagaacttcaaaggtgaagcattcttactctgagctttagtataaaatgctcctctattctttctttttttcattttccccaattttttctatgaaaatgcgtgagttaagatatatcacattatatataagttcaccagaatatctccatttcatgttgttgactgatgatttgaaatttctattgtttggctttgagatattttcatacagtttagtagtttactagtatcagtttttgtgtttagctatgcaacaatggtatgatacacaatacttgcgattctaaagttttgcttttactccctccgattcatactataagtcgttttgacttttttcttaatcaaactttttttaggtttgaccaagtttatacaaaaatttagcatcatctacaacaccaaattagtttcattagatataacattgaatatattttgataatatgtttgttttgcgttaaaaatgttgctatatttttctataaacttggtcgaacttaaaaaagtttgactaagaaaaaaatcaaataacttataatatgaaattgagggagtatgtttgatctctggtcttttggttggaaatatctcctatctctggcacattgtctcattaatttcatttcaggttagttgctggtataaacaatgcagttgttgttgaccaattctatgacaaatcaaactggtgcatcgttcttgagaagctttgaacatgcagctaaaagtgccggggagaaactcatctggagcctgtgcccttgtatctttgtaaggactgccagttgtaggcgagcacggttttgcgctccaaatgtacgaggcctgacacaaaaaaactgcattattgaatttagcatgtcataattctctattcacttgttggtgaagatcacttttgcccgttgtcatcgcgggaatcttcaggttgatcttttcaggattgcccaattagggtcatccggatttgcagaagtttgtacttatgttctcatcgaactggtgaattttgcaggtttgcttgtctctctcttatgagagtatgatgtactgttgtctgatgtatacgctaattggacatttccgccagctttcacgcttttcctgtgtacgcaatacgcccgtaagcgtgttacagacatgttatttccgagtggcaaaattgcatcgtcaggatgcatcacctgcgcaataacgtcttaccaggttgataaactgatccatgaacgtcttaccaagttgataaactgatccatgtacaaagaaaggtaagctatcagaacatgcgcacgagatgcgaacaacaatgagaagcgatacttcagaaacctcaaggtta

SEQ ID NO: 19505 - DNA, 1501 bp, Oryza sativa
atggatatagtaccatctcaaccagattaggtctccctcactcagttttgctgtgggttgggttggctttgctcgctccatgggcgagagagccagccaagcaaagcagcgcagccaagcgtcgtcccgtgtgctcatcgcgtccccgctccatgtggccgacgcggcgtcgcctctcctgtttttcttttgtctccgtcgcctcgcggtcgcggctcgccctcgtctcgtctgggtttggatctgacgcgcacactgggcagatgtgtacatcccccgcacctcacctgactccctcccaacgcgcacacgcaccaccaccaccgcatcaaatgcgcccgcgcgccccgtacgcgacgtgccttctcgcgggcgctgttgctgcccccggccgcccgcttgggttgggttggttgcgttttttctgtgttggttccacgtcatgtgaaccgagccggaactaaaacaagtataatcaatcgtacataaatcaccacgtaaagcgtaaagcaaccgggggggagggggaggagttcagttaacccatgtttcctcgtgtgtgtgtgtgtgcgtttttttttttcttttttgggtggtggttagggactcgatctcatctcgctctcgccagtgagtcggatgccaccatttgttattattagtagagaattgcaagtaccaaattcgggagttgggttcaccccggccagtagcgattggatggaggctgaggctgctctctctctctctctctctctctctctctctctctccctgaattagctcgagaaataaaaacgggaggagagggacgatgtgctcgtcgtaactaatggcgaggcgaccgaccatgagatgatgagaatgaataatgataacaggcctgaggattgaggaatcgaagccggtggggtcccggttccttgaccctggcaactggcgagtagagtagtgtactggtactggtgctgatgctttactttcggttgtcccatgagcggccagcccatgacatctcccccgtcctaatcaatctagacgacgacttccattccgtcgtcccaagcgacgaactgacgacgacggcgacaccaccgccgagacgtctcgctccgccggccaccgcctagctcgccggccgtttgcaagggcttgcggttgaaaacttgaaaatgcgagccacaatgagacggtaaattcgatcgaaattgtgaacttaattccaagcaagcttgtcgacggctacacattgaatcactggttcagcgaatcatgggcggatctaggaaggactagaagggacttaataaagtagataagcctataccctttcttctaatgaatactccatatgacaatatattttaatgaaaagtttaatgagactcctataattctaatgccggtaataagaactcgagacccatcatccccatgacagatccatcattgcaacaaatcattttttttctttcttcagcagagatctcgcatgatttta

SEQ ID NO: 19506 - DNA, 880 bp, Oryza sativa
aataatttgtcagtgacagtgagtgattactgattagtcacatacatactcaaattgcatctttcagacgttatttttaatatttagcacaaccatgtagttgttcatttgctaatctaaaaggtgaggcatactaaatgcagatgatcatttcaattaagcagctgttctaggaagagctaagaactccagaacttataatgctgctgagatttaagcaaagagaagacccagcctgtgcaaactagacagcacagcaaagatcttcactttagtactgtcctaacagcaagcatttctgcagttgcagcttctatgaaactctgaatgtctgattggcaaaagcaggtggttctttttatcttgaacaatagactgttaactgcatcttattgcattatctgtcaaattatctaacagcatacatctgccatggtcaaacaagtctagatgtgtctatctgaatcaaataatctgttcctggtgtccagaattttacacccaaaggacaccgagacctcaaccatatccacaaagttctcctgacagcttctgatggttcaatgaatttcagctaataatcatcagagaacaaacagagggaaccacagggaaaaaggattaggaatcccagcccgacggattctgaagatttttgcgattttatctaagactcttcccagatgcataattgggagaaaacatcacctaaaaaataaactagctagggggaatcagaactaaaacaaggaaacaaagaactgcagaaggaaaaatctaactttatgaaagaaagaaaaaaagagctcactggtgactccgcaatgacggcaaggtccttgctttcccatgcctctcttctcccctcgcctccacaagc

SEQ ID NO: 19507 - DNA, 343 bp, Oryza sativa
ccacctagtaagaggctaagctaggccgggcccactaatccggatgcgtcaaccaaaccggactccgactcgagcacagcctcgccgatctggctcgaccaagccgcggaattccggaagcgactcgctctcgtcggctcgtcgcacgcgcgagcccactttgccggccaccgggatggcgccgccgcggccctcgccggcggcgaggctgctgagggagtacggtgagtgctctcctctcgctctcggcctcgcgaagcctctccaaatcagggctctgctgcggtggtgggagggtttttgggatctgatgcgtcgggggcactactctcgcttgcagggt

SEQ ID NO: 19508 - DNA, 1501 bp, Oryza sativa
aaagttcaatctcttgtgacctaaaatgtggcataattaaattagggagcaatataagcatgttgggtggcatattggcatagttttaggttatttaaaacataccagaatgaggagataaaatgcatgtttttattatgtgccgtttcattgctaaatgagaattgcccaaaaacctgaatggaatttcttttgcatagattggaatcccgtgcaattaattttacaaacaaatcaaacatgcggtgtgagacatgtgcaggttgggatttggagtgctattgttatctttatcctaccatagctgcttccaccaaaccaatgtagtagtacgctaagccgttgaaaaaagaattcctatatattcaaggggaaaagcctgaaaaatgatgctggcatgctgcggccaggagggagctgttccttttgtgtttactatttagtccctggaataatgttgggtctcatattctatattatattctagagcaccctcaatttctatcttattcccgtctcctgaaaaaaaatatacatctatttatcatataactatgaaaattgtcacaataaaagtgacttcgtaaaaagtaaatgcaggtgctcacatatgtatatagggttattgttacattaattttttttgttaattgcattcccatgtattactggaatcgaaacaaataggctatttggcgcttttgcatacttcctaccggcacacatccaaccgttcatcattatgtttttatgtggcgctatgaatcactttacgtctattaataccacatttaaatatacatgaatacattttcccgcgctttatattacatggttttataaatcggtacataccgcacctattccatcaatagatgaatgatttagaaggcatgacaaatatgatacatttcttcgataataaaaatcaatctaaacaattattatacattgtattgtgcttgttaggaacgtcgttttaacacatcaaaacaatcttttatgcatcaacctcaacattcaaccacccctctattgagcttgtgttgggtgctctacacaaacattgttgttttttttttcgtaaggggcgaaatgcaaaggtcgtaaggaaaaagattcttccaatggcaccagaaatggagggctttaaagttaatcaaattgactaattagtgctagatatgtcctgcacttctccttagtcatacccaagcaacaataatgaaatgggattgaaaccacccataatgaaaggctgaaagaaactagaggagaaaagaagtgctggcctttgctgttgtatagcccccctctccttttcctaccttgcccagttcctagttgcttctctctccctcattaataaaaagaaatttacaagcttctaaactatattttcttttggattcctccccaatggctttcacccaaagactcacccggcctttgtaaaatctcctcccttccgtctgcattccttcctccattatttctccat

SEQ ID NO: 19509 - DNA, 1232 bp, Oryza sativa
tgtacatcccccgcacctcacatgactccctcccaaggcgcacacgcaccaccacctctgcatcaaatgcgcccgcgcgccccgtacgcgacgtgccttctcgcgggcgctgttgctgcccccgccgcccgcttgggttgggttggttgcgttttttctgtgttggttccacgtcatgtgacccgagccggaactaaaacaagtataatcaatcgtacataaatccccccgtaaagcgtaaagcatccggggggagggggaggagttcagttaacccatgtttcctcgtgtgtgtgtgtgcgcgtttttttttttcttttttgggtggtggttagggactcgatctcatctcgctctcgccagtgagtcggatgccaccatttgttattattagtagagaattgcaagtaccaaattcgggagttgggttcaccccggccagtagcgattggatggaggctgaggctgctctctctctctctctctctctctctctctctctcccctgaattagctcgagaaataaaaacgggaggagagggactatgtgctcgtcgtaactaatggcgaggcgaccgtccatgagatgatgagaatgaataatgataacaggcttgaggattgaggaatcgaagccggtggggtcccggttccttgaccctggcaactggcgagtagagtagtgtactggtactggtgctgatgctttactttcggttgtcccatgagcggccagcccatgacatctcccccgtcctaatcaatctagacgacgacttccattccgtcgtcccaagcgacgaactgacgacgacggcgacaccaccgccgagacgtctcgctccgccggccaccgcctagctcgccggccgtttgcaagggcttgcggttgaaaacttgaaaatgcgagccacaatgagacggtaaattcgatcgaaattgtgaacttaattccaagcaagcttgtcgacggctacacattgaatcactggttcagcgaatcatgggcggatctaggaaggactagaagggacttaataaagtagataagcctataccctttcttctaatgaatactccatatgacaatatattttaatgaaaagtttaatgagactcctataattctaatgccggtaataagaactcgagacccatcatccccatgacagatccatcattgcaacaaatcattttttttctttcttcagcagagatctcgcatgatttta

SEQ ID NO: 19510 - DNA, 1501 bp, Oryza sativa
gaaaccatcccattacagtaatgagccgttttaacttatcttaaaaataattacaaagtcctttactacgtaagaaataaattggctacaattttcaaggtgtcataaagattttatgttaggtttttcagtttttcgaaaatttcgccaagagactttggacagataatatttgcttatggcattctagcttttgtagcaacctcataagtgggcatagtggaaagaaatattcaatccaaatgtccaaaataagcatgaatgttccaaaataccaaaatcaaattgcaaatacaattggttgatgtttttatctgttatacattatatttattttttttgaattaaataattacattgtgtttaactttttttcgaacaaaatagcaatgcaaaagataaagtatcgtatgatgtattttaaaaggaagatttgagactggattggccaagagattcatcatgtgtatcggtattttaaggttgtttagtaaatattaaagataagggaaatagttatctcagtagtcaaattttgaattttcaattgtttggattaccctcctatatacaaaatttgaatcctaaaaatgtttatgttttggaacggagtgggtagatatttaaggtttaagggaaaaggctgttcagttttttaaaaaatttcgacaatcaatttcacattagaataaaagtgtaaaatctaatagatgtgtgatatgttatgataatactttttaggaaaatccacatgtataatttattttgttttctaaactaagcatttgagaaataactcacattgatatgcaaaatttttaatttttgaccgaatctttaacataactaagcgttcgctagttctaggatatgctttcggagctatgtagctcacaataaagtggtagaagcataggcttttttttatttcaagacaaacaaaatattaagaagttgtcttaaaaatagaaatgtacttataatgtaccatctatgttttttaatacatgatgccattgacttttgacaaacgtttggtcgttcgtcgtattttttttcttcgaatatataattttgtacataatacttacaggacctgtgataaatcaagcacaaacaaaataaatgataattatacattttttctaataaaataaatggtcaaacgtgtcttaaaaagtcaacggtgtgatatattaaaaatgatggagtagctatttgatagtaagattgttcaattgtgtcattattttcttctcacttggtttagcaattatagtacaagaggtagtgactagttaaaaacaaaaaaccttgtgagactaagcgaaggtaggggtggatatcgagctggctcggctcggctcgctctagctcgttaagataacgagctggctcggctcggctcgctatcctaacgagctaaaagtctgtctcggctcgggtcaattgtaagcttgagccagctcgtttagctcgcgagctagatttggacgacgca

SEQ ID NO: 19511 - DNA, 1170 bp, Oryza sativa
ccggtcttgctcgatcagacccctctccttgagaagtttcaccacgagatggcggggcaccagcctcctctcgaggctgtacatgagcagcaccgaccgccgcgcgacgtactgcggctgcagcccgacctcgtcgatcaagaactccgcgttgcggcgcagcctctcctcggacgcgaccaggatccgcggcgccttgctcacggccaggttcacctcctcctgcgaccacccgaggctctccttcaggacggcgaccttggcgtcgatcttgtcctggccgatgcagccggcggtggagagcgcgtgccggaacatctgggagcccggggccacgccgagctggatggcacgccgcacggcgtccttgacgtaatccgggtgcatggtgacaagccgcggcgcggccacgagcagcttggaaatatcacgagcacttagcccgcattccttgaggaaggagacgttgggctcgaccaccttctcgaggtcggaggtgaggagccagtagttccagtcgctggcctggagaagcctctccgatgagccgaagagggggagccagaaccgcaccttggagacgaagctgcggcagaggaagtagcggccggtgatctgggcgaggcgggcgatctgggagggggagaggccgacggcgcggagctccgagcagatgggtgcaagggagcggtcgatgcgggcgcacaggatgcgcgggttggaggcaacaatggccgcgacctccttgggggagaggccgaagtcggcgaggaaggcgaggacggcgtcggggttggagcgggacttgaggtgggcgatgctcttggacgccttgtgggcctgtggctgggtgagattgcagttggagatgaggtattcctcgacagagaagtggttgtcgggcgcggtggtggtggtggtggtggcggaggcggcttcgggcgcggcgcgggagaggagctgcaggcggaggcggcagcgggtggggaggtggacggcggcgaggggagtggaggcgaggaggaggagaggcatgggagcgaggagcatggccgctcccatggccggggaggggagacgtggcggggagagagtgggtgatttttttgaccgaggttgtgtaatccgcagcttgggaggcgcagctccgcaggcgctcgcggtcgcgga

SEQ ID NO: 19512 - DNA, 506 bp, Oryza sativa
aacaccatgctcctgttattttatttgaactatattacacagccctccctattcctaatttatatccacactaatattttagggtgaattattatattttagaatgaaggaattacttttactcaaaaaaagttgagtgattttctcttaaaaaggacttctaatagtagatagtatttctttcggatgagtgaatattattctgcagcgcgtaacgtttctctcgaaagaacccgtcagatctcacacggtcacgcacacgactcgcacccgttcgcttctcttctccccgctccgctagtcatcaaccaccggggtccgacgaaacaaaacaccacgccatcttcacgatctccgtctcccatccccgcctcgccgcgccgcgccctcctcctcctcctcctcccaccccgccgagcactcacccgccgcctcggtttcgtgcgcctctgcagcggcaggccgggggcgcggggcagcggttggcgtcggccgcggccgtgctg

SEQ ID NO: 19513 - DNA, 1501 bp, Oryza sativa
ttcatataagacggatagtcaaacgttgacacggaaattcagggtttgactttttttttaacggagggagtacatagctccattgttcattcattccttggagagttggagctgcgatagaccttgcaaaatctacctaatataatactggaaatcaatcaaccaacaaaaaggaaaaaccgtaatttaatcaactgtcagtgacaaacagcttcgtactactggtgtagatgctacttccactgcactaaacagcagtgtgagttcagcatctgccgggatagagaaaattgacatttagccacttttaaggatgggtttcgctgtaatgccattccgccaagttgcttcgctaaaatgccatccccacgctcgcgcaacacgctgcttcgtcgtttttccaatttcaccggttaagcccgtaagtgagttgtctgctgaccaaattgcccctggggtcgttttgcgccaaatgaagcagcaagcgccgtcctaatccagcgctctctccagcgccgccacgctgtcgctctactccgtcgccgatctgccgatctactccgccgccgtgttgtgccgctttgctccaccgccgccactctactctgccgccgtcgccgtgcagtacaatccatcgactccaccttgttcctatctcatgtcagggacgacggcatccggagactgtcctcggcgtcagcgagaggggggactgcggcaaaggcggcggcgatgggtggaatggcgatggcagcgccgccgtgagctacagctgggtgagggcgagaggtgattgcggcggcgggtggaatggcgatgccgacgagatcgatctagggcgccacaatgagcaagagctgacgcatctcgatcccctttctctcactctcaatcccctttgtctcactgacctaaagaatgaccaagggcacattggtcacaacactcgtgattttgtgtgttaatccaatgaaattgaaaaaacggcgaagcagcgtgttgcgcgagcgtgggaatggcattttagcaaagtaacttggcggaatggcattacagcgcagcccatccttgaaagtggctaaatgtcaattttcttgccgggataggaccccaatcttcagtgtttacccccgtcccgtttcggtggtccaactgtgctagcaacaatcccgatcccctgtcccgatcagctccaattcggtagattaggcatatctgtcatgcgtccgttccggatccaccctgtttcggaccagggagtaaaaaattcgacctcggtctcatcaggaggacttggcaacacgcagtcacgctcacgcacagcaatactcctttttgtagctgggaagtgcagtgcactacgcaaaaacaaaaggctagcaggaatcggacaaaccaccgactactaggaaagcaggaagaagccgagctggtagatggatggatggacgcctgggcaggtgagtgctcgagcgacatgccaaccacgcgccaagcaaga

SEQ ID NO: 19514 - DNA, 404 bp, Oryza sativa
tccacacccctgcatcgctcaatcaaatcacgcagatgattgagatttaaatgcacctgtcacgaaaacacgagaatgagaaaattaaataaactcgccgtacttgtcatggagcattttaggttcctctatgatttttttttttaaaaaaaacgggggttggggttggagtccccgtcaagggaggacgcggttaaccagcagagcacaagaaatgccagtttactgccgctttcgtccgcttctgcgagctcctccgctaccacgtctgcatcagattgacttcacggtttttaaaaatgcccaatcgtcctaacgatcattgggcgtgcgaaccggttttgttagttagttagctccgcctaatgaaatcactaaccaaaccgccctctcttttgtttagt

SEQ ID NO: 19515 - DNA, 1501 bp, Oryza sativa
tgttcacataattgtcaagcaaaattttcaagagtacattgatactcatttttcttccgattatcaatgtataaatgtggacaatcaatactatttctgctacatcacatgaggaattgggctagtggagtagaatcggtagaaccatgatgacgatagaataaggggataaaatgacatgtacattagcatttactggaactttcacagtttcactcgtcgatggcatgcaaaatgcaaattagacaattgccaaggggaattttttgatgtaaaagaggcccttttgctctccaaggagtcattataatgtttacccggggcttggaacgctcaaactatcttgatctcttctgaaaatcctgcgtgacgaacttaaaattcttactggtagttacttgaatgtagcacatgttcctagatcgtcagttgctttggcacatggtacctggtcgatcgtgggccaaaactcaggaaaagaagcacggatggacgggatggtactggtaggagggggcctgtggagaccattggcagatcgggttcatccatccatacgcttttccgggaaaaaacctcgtgacaccaccgaaccaagcatggccgcgacgccaacgccaacccccggtcactgtcgagtcccccgcctagctactcctcccggcacacgctcgcagctcgctcatggaaacgtcgatgtcgacgccgctccatatccggtaaaactctcgagcagatgctcttccgattcagtagcaagccgagttggcgtgcctctgcgtgtgatgatttgatcggtgggtcgcctgctttgcacgctgcaagtcctcctcgtcgggttcacgcatttccctagttcagatggcacatcacagtctcaacagaaccttaattgtctgattgattcctcagggcatggtggaaacagaggacatgcctcatgtacgggtcaagatgcactatgtactatgtgcagtacatgtacgggtacatattgactctcgagcagtacaattcactacacttaatccaataatatctccgtcccaaaataagtgcagccgtggaaatccgtgtccaacgtttgaccatccgtcttatttaaaaaatttatgaatttttttttaaaatagtcacacataaagtactattcatattttatcatctaataacaataaaaatagtaatcataaaatttttttcataaaagacgaacggtcaaatgttgaagatgaatagtgtaaaactgcacttattttgggacggagagagtagcatagattcagagtactactgtaccagggttgctgccatccggactcatactcatggttcagttcggcgcagagcaagtaatggacgaagtcatgcaatacgctgcagaaaaatgcagaattgaaaacgttagaggctgagacgatgttgagaacaaagagtgataaccattcttgttcttcagaacgaagtcgtttcttcaattcttctacacacccagcaccgt

SEQ ID NO: 19516 - DNA, 1501 bp, Oryza sativa
tacaacttcaccgctataaacttttaaagcttccctaaattttcccattttctagcaaggaaacaacaatccatctgttctgcaatataattctaactacttagtacacatgttgtacaacgtatggaaataagccatataaaacttaacggagtagcacaataaaatatatcggcaaacattggccttagttctgatttccttacgagcctcatacagtgattgcaattttagtttaaaatttcggaaatttcagaccctccggcaagtcattatctcgcctgaaatttttggattttctcaaaaaaaaattgttgaatttgagcaaagtttattcaaatttagttaaaatttcaaataatttcaataaaaaagtaccaaaattcatgaaattttggtgccaccgaattttcatcgaaatcgaaggttgcaaattctgttcccataagattgaggtacattttttttctagcaccgccttttccattacaattagatgcgctctctcatgctggtcactttttaagataccaactaaacagtcatgaaaaactatagaaaaaataggactgataataatacaatagggatcaatcgatctcacaaaagagtagttcaaacttgatctagagaggggaaaacaaattttagttgtaaatagcgcatgcaccctattcatagcgtggatcgaatttaactttgtgtgctcactgagtattatatttgtgttaattcctaattatgtctataacttttcagattttcttataactagttcacacatagtatgaagtaactgtgttaatctataattctttaaaagatttcaatgctaattggtgaatctaacatcacctatcactgatggcatgtgagacctaaatgcttaggtggactcctcttataaacagatgtacaaatattgttcatttctcatatcattatagctccacagctccactccaaattccgcttctaaagttaaatttagaagttggagttctaccaaatggacccttgaaagcaactatgtagcttgacatacatgtacaaaaacgatgccaattattgtttacaatggaaatgttttattataaattttggggccttagagtgtacgatggggtttcctattttaaattccgttgcaacccatggacattttacctagtatggtaaaagatttctcctgacttggtataagtttggtttatgaacacactcttagggcacgttgtaaactatgttttggcttggctacctttttcattttccactagcatattttttaaactgttcaatggtgtgtttcgtgtgtaaactttctatatagaagttgctttacaaaatcaaataactttattttcaaggttttaataattaatattcaattaatcatatgctaatcacctttattgttttacgtgtggctaattactcgttttaaactacacttttgaacgagcgtttagttttttttggaaaaagtttaggaggtagc

SEQ ID NO: 19517 - DNA, 1501 bp, Oryza sativa
ttctttcccccattttcccaacctacctctctcgtttttcgcccattttcccaacccacctctctcgttttccgcacgtacgtttttcaaactgctaaacggtgtaatttatgaaaaaaaaactgtctgtatgaaagtgtttaaaaaacaataaatacttaattaatcatgcaataaaacaaatttcgttttgcgtgctaaccctctcctccgaacacaaccgacgtatgccaaaattgccaacctcatcacgaccacctttttctaccaaaagacgaaccagccaaattggactggatcaaaccaagacataaactgaacatttcaaccgtgaaatgttgggttaatttgagcacagactgcccgttacagctttgttgcaactgaaattccctatggtttcaccagtgtccgctctgtcctacatactccaagtggtcaacctgtcggtgtccaccgagaaattttctgtaggtcagttcggtcgttccgccgtaggcgtggccggggagtaatcctaacagagcatctcatcttatctcaccatccaccatctcgctttctgggctggctcgtcaggtttccaatgggcatcatcagctgatcaaagggaaaagccaaccgagcgagcactagcagcgctccaaacacaggaaaaccagtgcgcggaggggagaagagaaacgagcggagcaaagaaagaacagaggaaacggcggcaccgtccctttctttccactggcttctctcccctcaacaacaacaacaacaacagcgcagccggaacagcgccgcctcgtgtccgccacgccattttttttcttctcctcctcttcctcgtctcctcagctgaaaacgcgcacgccaaaacccatcgaaccaccaccccggccctccctcacccgtcgcccacccaatcaacccctccacggctccaccacaccgccgcgtccgggtcctcctcctcctaccaccaccaccgcctcgcctcttgccccgccgtcaaccgcgagagctcgcgccgccggccgacgtgagtccggaggcgttcgatctgctgccggcggcggggtggaccgagggccgcgtcctcagctggttccgcctcccgatccgatcgtttccagtgggggggcgccgaattcggtacgtctcgttgggtggcttcgatccgcctgatggtgctccctctcttcgtgaggtttcaatctccgtgttaggtgggcggtggctagctgattggattgctcgtcgtgtttctccctttcgccttcgcaatccgattggtgcgccgggcgtttggcattcgaaattatgctaatcgagatctgtggtgcccgtagttcgtagttgctattcctgcgctaagacttccatattcgtgattgcgtttctccttactgaaccaaacaatttagacttctatactcatctataaacacattttattatttgtatttctggagatctgttgctggtatcacctatatgctcgtctttg

SEQ ID NO: 19518 - DNA, 1501 bp, Oryza sativa
aggtaggttgggcgcacaccgaagacgcgcgcgcgcccgccgacgcgccttgcgcgtgtaacaacaaatctgagtgcgctgcagtgcacggtgagactgcacacaggagggaatcttactatgccttgtgagcagcgcgctgatggcttctgtagcacgcgtggtgcaaaggtgttcgtgcctgcgcgagtggacgacacgtggtaggtggtgtttgtcctcgcaacctgctggtttaaccatcttggatagggtttgttattactcctactgctgcaatccaaccactgaaataagtatggcttgtgttaattgtctcctagtatcttcaagcatccaagttgatgtagtttcatgtcttagagaggtgcactgcgaggttattactgtcctccgtgagcaagtaggatgtaaaatgataaatttatggctcgtctgtattattattataattattattttgtttcattgtttagaagacaaatgcatttttttagctcagtaattttcagaagaaagaccaataatatgaaagtagtagtattacctatgtccaaaataaactacggggtgtttggttcatgatcacactttatcacactatactttgtactactacaatttataggtatgtgtttgatttacttccataattgtggcttgtcacatttttttaataacatgcctcatacatcatagactcaatttccttatcaactttatcacactctatggctaacaatttatctaccataacttttgtggctgctacagcttatctaattttagttgtggtaaagtgtatccgataaccacgctatgttttttcgtttttctacaaattcatagtcaacacgtagaataaagttttcgttagatagaggtagtagaaccactttactagaatgctactagtagtcatttattaatcagtgtcatcttgagttctcaagtatggtcaagagagcacgtttcgtagcaaattcaggaaataaaaagatcagaattaagaaatagaaaagcaaatgcaggtgacgtccttactcatcatccctcgctgaaagaatcgcctttctttttgcacaatgattagtggtggtccactcttacaataacacgagatgcaaagaaaggcagccacaaggcaccaccctggcatatataaacctgcaagtatgcatttgactcgtagcaagttagcaacacaagagccagggaagccagccactagcaattctttgatctggatcctctgcacaacctgtccccttcttatccagtaaggcaaagccaagaacgtagctacaactaacagcaacaaagctgaaagctacacagatcaacgagggagaacttattctccctccactcacactcctcgcctcgcctcgcctcacttgtacccttcgattctctcccgtttcgtcgccctccagagctcgtggatctctcacttcggggcgggcgcgcgctagcacaatgttcaccggatgtggtctct

SEQ ID NO: 19519 - DNA, 1501 bp, Oryza sativa
ttttggtgggatgaggatggagaattgaggaaggaactcctttcttttcaatacctgggtaggggcagttaattgggagggaattcctccttcactttgtttaagcaaatctcagccatccgtttttattaatgacataatctctaactaaattccttatcaattttcatcacctctaccaaacaagatattgggattaaaaattaaattcccatcttaatctcatcatcaaatccctcgtgccgctagtggtaatccctgcttcctgaattctgaaggcaccagtctggccgccgtgagtctgtcagtcactccagtctgagacctcaactcctgtgcaaacaagaatacccaacccaatgatgatccactactccgtgcctccgtatgtttagtgctcgcaatacaccgaaaagcagaggggcatcgcgcaaaaacgcacggcaaggagcaaccagcgagagcgacgtggggagtggggacaagggaatcaacggtctcctctccggctctctctcccctcaaccgtgtgggaaaagggaaaacgaggaaaggaagggagggggccaaaaggaaaagccaccgtcctctacgatatcgcccaaaaacctgccagatcgtgccgtcgtggggagggcgggctgccggccgccgctgctgctcacggaacggaacctccacggcgcatcttaggaagacgggaaccccctactcgtcctccccctcgatagttaaccgacacatatatcgaccgccatggcggccgcctccaagctcggccgtcgcgccgtggcgggcactgcagggcggctcccgcttccagaagcgcgcctccgcctcggcctctagggtaggtagactcgtcgccttcaccttgtttttcttgctccctcccttgctgtggcttgagcattacggggtttctgctacttggctgctagtgcctagctcactgatgtgatattgtgatctggcagtagctcgcgatgctgccccctgcgggatatgcttaggcgttctcgggaagtagccgcgatagtcaacattggaatgagtagagtagctgctctgcttgcggggcggttgctagatttaggcctagttagtgtgcgattctactgttgcggacgacgctctaaccaccatcttaatcgtctccacgacgattgggggtccacgagaggtgcttgccttgccttctcctccacctgcaggagcaacaactcaacaccccgtggctcccctccccgcccaacgagtaggacgggttcttgaattccagtttgcctttgctgacccgtttgattattattattttggatgtgactgcttttctgtcgcttataatggtgtgattttgggctcttggcagatggtgtaggggccaggggagagggggagtgtgtgtgtgtgtgtgtgtgtgtgtagaggggtgaaatgggggcgattggcggggatgaggtggtgcagtgggacaagatggacggaggtgaggtggtca

SEQ ID NO: 19520 - DNA, 1501 bp, Oryza sativa
cttcctccccttctcgccatgcaaagggcgctttggttcttggtttcttcttccttttgcctcagaaataatcacaccggcattgatgaaccaagcatatgcaggtactacctcagagaaaaaaaaaactccttcgggtaagctagaatggaaatgaagttctgcgctagcgctgccgcggctgcactgctgctacagcagcagtgccctaacaaactatagtaaaagcttttgagctggagcaccggaaagctgaattcctagacctaacatgacctaaaggcacctaactctaattaatccaaccggaactaagataatactggaaaagaaaggggaaaaaaatccaggtacggtacaggactaatacggctggaaaaatgtacagccaccgcgggggcgcgcggggtggctagcttgctttagctagaacgacgccacggcgggcgctgcggcggcggcggcggtgaggagtccggagccgacctccttcttgcgcctcatctcgagcaccttgcggtgggagttggagtggatggcgctcacgaaggtggggctgcacgccgggcggtactcggggaggagccggccggacttgtagcggacgccgcacgcgttgcagagcgtcttggcgccctccggccccgcgcgccactgcggggtcttctgcacgccgcagtggctacagcgccggtcgcccggcgcgggggccgacgccgccgcgcccgagggatgtggtgggagctgcttcggcttgcggccacgcttcttaggcttgttcttgccgttcttaccgtgcttggacttcttccccggcggcagaaggtgatcgtccgggaggtccgacgtgccgccgagcgggtgccactcaaacttgaggagcggcgagaacgacgagaacgaagccgacgaggagcacgaggaggtggtggttgtggacgaggatgacgtggagtccgagaaaggcggtgcccccgagagagaccacgccgtggcccgagagcgcttgctgcgtttcgccttcaccggcaccagcgcctccgttgacagcgcgcagatggtcggagtccgcaccggataggacgcgggtggcagcgcgcggtaagctccgtcctgaggccgccgctgcagctgccgaggctgcggcggccgcgcggccagcgacgccacgacggacgcaggaggctgcggcggcgggggcaactcggaaagggagtcgtccatgatacgcgacacccactctagctcctcgacgtcatgcgcctgcagagaaaccatacagcacagcaagaaattaattacagggggaaaaaaaagacaaccatcgcgaaagccgcagcctttccgccgaaaggcacggtcaacgagagtctcgagaaacctcaccggcaggtcaacaatctccggaggcggcggcgggggcgccacaagctcgtacgttacgacggacgacggctgggagtcgtccttcgacttttcctcctctggcgcggcgacgagg

SEQ ID NO: 19521 - DNA, 1501 bp, Oryza sativa
gctaaaacttgttagtctatgtcacatcggatgtttgacgttaatttagagtattaaacatagactaatttaaaaattaatttcataaatgagagcttatctgtgaggcgaattttttaagcctaattaatccataattattaaaagtttactatagcatcatattgtcaaagtcatgttgtaattagacttaaaagatttgtctcgcgaattagtctaaacttatgaaatgggttttgtaattagtggatgtttaatattttaaattagtgtttaaatatctgaggtgaataagtccctgaaaaccaaacagccccttagttaggaggatgagggttgagatagcgaggggtagaagcaatcggcatcagatatagatggagatgttgcatgtttgcagaagtttgtagtactcctgtgattgagatgaggcaggaatgaaactgggaggtagggtcctttgcaagttaatccaagtctagtcttgctgatgcaagtgtgtcctcccactctgccttggtggtgggctctctgtacctggaacagaactgtttgaaaaatggaacatctactgtacacctctacacctcttggggctctccttgcctttgctcaggtacatggcctcgcgtgcgttcccagtagtgtttgtttacgcacaagctttggtgcagcagctgcagcggtagcagtgctcgctcagaacctgagacactggcttctcgtgatcaagcgctactgctagtaccgtgctagacgaagatgatggcatgggagttttgacgggcgcgcggggcgagattttttttgtttgcaccgttgtttttgtggaagtgcagggtggtggtggtgactcactcgtttggacccagctgcattttccgacctaaccagagcggtaatggcgatggtggtggtggtggtggggcaccgagaagatatgtggtggtgaccggccgtggtgaccgcgacgcgccttttcttctactgccgcctcctctgctgccggctgcctcgctgccttgcccggcctgcgcgcgcagccgcgctccacgcacgcacgcgtggctcccacttccactcccacactaaacccgtgtcttgtcttaagcaaccacgcaattgttttcgttttgttccgcgccttcgtctcccctcccctccccactccccagcttggattctttgctcctcctcctttcagttccggctgatcgtacgggctaactttcctgctccgttttcgctgatgttctgttcccaactgactgcgtatctttgcttctcgagctgtctacgaaacaggcagggcaagcgtgatgagtgccttcacgaggacggggattgcgctgtctgagagataaccactacgccaccagaaaacctgtgtcgctcaccggttgatgacaggagatttctgtagccgtgcgtcggggttcagtttaagcagccggagtgcccgggaatttcgttccgaggcagcttgttttcggtttggggg

SEQ ID NO: 19522 - DNA, 1501 bp, Oryza sativa
aagtctggggggagatgcagttaaattctactatattctagagttcagatatcttcaaattaggttgccacacacaattgaacaaattaaagcttgagacaaaacaataaacacagaacaggctaagttattattttccatacgccatacaagatagatagaaaggttactacgatttccaagctacgcctacatcagacatccatcacagtacatatgaacaactctaattaactcctaaactcgcaagccaagccagtgggcaatcaggacaagcaagaaaaccttgacaggagacacctttgcgccaccgagatttactctagggagtcaatgatgcggtcgacgagcgcttccatgagcctccgctgcgaatcgaggtgccggagtgccatctccatgcgcatctgctgcgtcttcctcgccgcctccatccgcctctgctccgcccgcaggaaaccctccccgatcgccctcagcgccttcaccacgtcgctctccccgtcatcctccgcatcggcatcggcatcgccatcaggcagcctcctcttcttgggaggcggggaggagggagcgggaggaagaggcggcggcgaggctggcggcggcggggagggggattgcgacggggacgcggaaggggaaggcccgtcgaggagatcgatcgcgtcgaggagcgggcaggggcggcggcgcttagatcggaggcggcggcggagcttctcgaccttgtggcggcactggcgcgcggtcttggtcggggtggccgcgtcggcgacggccgcccagtcggcggaggtcaggtgcgcccgtcccaccgcgaggcgtcgcgcggtgtaggcgcgggcgagcgcgagggtctcgtcgggggtccagcacggcggcggcacgcggcgggcggcggccgcggcgttggtgggggaagaagaagccatcgcaacggtggtgaggaggaggcggaggcggaggcggaggcggtggtggtggtgtggggcggaggttgggggaagggacggtgaggggggattataacggaggagtctttttagggcggcgacaggtggcggtgggcgcacgcgggcggcggtgggcggcgtcggcggcggcgccaaccgcgggttgtgggggttgacatcttgacccgacacccccgcgcggcgcagccgcgctcggcgttaaagtttcgtgtccgttttcttcttttctagctttcgtgtttcgactttttgcgtggctaaaagaagtgtttttttgttgagcccacaggttactctagccgtcagatcgaataggataattcgatttgtatcaaatcttaccatttccattctagaatatatagattttaaagttaaatacggttattatgaaaaccgataaaattaagtggtgaaaaattataataatttagtagaaaagatatatgaaaaaattaaataataaagaattataattggttgagaagaaaatatttgtgtagaagatattatatttaagataa

SEQ ID NO: 19523 - DNA, 1501 bp, Oryza sativa
tgaattccataatgtttgctcatcttatgtatgatcaggagatagagcaacttgattatccattaacaatattatttcgtccttttaatttggattcagctttgatactttgttgtaactgcgcacatgtgtgaaactactggaaataaaataaattcaatggatgagtgagatctaattacctgacagtcctttttgcttaataattttcaccaagtgtgaatggcttgtcgacacgtcggcatatgctcatgcatatgagatgtttcctactagatcatgtttatagcatctctctcgctgcctccttatagggctcatgtagatttgacctcctttgcttgtggttaggtattaatcttacctgctaaaccagttgtcatcaggagacaggaatcatatctggtctctgctgcatgcatggatttgatcaccatttacaaacagctacttgaggcatctacatgtctgtacctctgaagtctgaacctcatgccatgtgagcttcatttgttagcaagcagacaacacattagcttttgaggagccatgattacggagtaatttccatggtcacagtcacagcggactctgtttcgataatataagaggatttttacagtccaacggtaccttacggtaccgattattgaccgttggatcgagacagatcgaacggctggcgtagatcggtaccgcggggtaccagttttgtccccgaagcggtaccgagtgatgataatcggtggaagggcagtattgtaatttcgcgtgcaattgatgggtctggatcgagatcgagcggcttgaaccctagcgaagctggatgattttcgccgccgccgccgccgtgttctttttcctcgccaccgccgccgtgttcctcttccaccgccggacttgttcctcttccgccgccggacttgtttcctctcccgcgccgccgccgttccgttttttctctctcgcgccgccgccagactttatcctctcccacgtcgccagcgttcccttgttgctctgcgccgccgccgggaacgacaacgacttggacgccgctgccgccgggaacgatgactcgaaacaggtactccctcatccacccttgctcatcttttctctcccgatcctacccatcccggattcaacggttagatgtgttttggtaccgcgcggtaccagtaccgcccggtacaacctgctgtaccatagcaatcctcataatataaacatttctacgtatttttggcatttcagctcggttcatattcatcgttagaaatgcttacttatattttaaaatggaggaagaattatatagagtacagcagtatctagcagcgacctagctagctgctagcaatttctgcatgcaggagacttcagagatcagatcacttaaattttttcaactgtatatagttcagacttttagattgttcagcgttggactgggtgtacagtgttgtttcagagaagggcatttagcacaccccaactg

SEQ ID NO: 19524 - DNA, 1501 bp, Oryza sativa
gtagtgcactcctgccatgtttgctatatcggggcgtcccttttttttctcgggtagcaggagaagcattctctcaaagatacgactacctcccccaaaaaaaaaaaaaaatcaaagatatggggggtgtgtggggggagttgaaattagtaccagtcaaataacgagaccggttttgcagatcagatgaaatcatatgatgttctccatgcgactaacgtctcggcagtcggcccgatgttccttccgagcagccaccaccggtccattgtaaagtccgacgccgaagctgtcaccgaccgacggagcaacacgccatcacccctgcgcgccgggtggaatatggacgctcgccccgcggccgatacggagagcccccacgccatcacgcttcacgcaacgcagacgcgagcccagccagccggcgggcgtcacatcccgatgtgcatgcagctcacctgcacacacactcgcgagtggagtaaaatcacaggtcaaatggtggccgccatgggtgaaaagtgagaccgtgaaagcgagcgggctgcgtcgttgaaacaacacgcgcgctatagctgacaccgcgacacctcatatatacatacacatattaaacatagactaataataaaacaaattatataatacacatgtaaactacgagataaatttattaagtctaattaattcgttattaataaatatttactgtagcaccacattgtcagatcatggtacaattaagcttaaaagatttatctcgcaatttatacgcaaactgtgtaattatttttttaaaatatttaatactccgtacatgtgataaaaaacgttcgatgtgtgacttggaaaaaaaatttgccgtttgatctgaaccccctgtccgtagtaagaataggtgggtgcggataagcgcggcggcccgggggcgccgcgtcgaggcggcgtcatgcgcctcatccgcggataatcctttttctaatccatcgttacctgtagcacgcatgctcaaacgcggccacgcgggtccaaccgcgaaggggaaagggaaagaaagctgaaagtcaatggcttctgttctactccagaacagaaggggataggggagtaccagccagcgcgctggcacgcgacgtggacttccgtatccgtaaatggcgtatgcttctagttaatatcatcgttaagaatgctaaacaatcattagatcactggacacatcaaatcaaaaaaattaaaaagagaagccacagtcaaacccgtccatggtagtctggcatctggcaaaagctgctagagatgctcgacaagccgaagttagcagaggccgttgctttgcatcagaacgaaagcccattatggctgaccagctctcctccgtgctccggcccaactagaggaataacccagcaggggcacagtccggttggtccgttgcggcccataatatccgattatacgatacatggctcgtattcttgtttgctcgaacacgagtata

SEQ ID NO: 19525 - DNA, 1501 bp, Oryza sativa
tataacaaataagtaaaaaagaaaagctataagtagtaacttttatttaactatatatgtcataatcaaaggtagtagaagtgaagaaaatagtaaattttgtgccacactatatatgtcataatcaaaagatacggagagtactaggagtaggacattatacgggaactgaaaaattagacctttttatgggtacgcgcactacatctttttttttcttttctttttctcaaactggtcctcctctgctctccactacatggcctcccccacactcttgtttctctctcatggtggttccttgaatgcaaaactaactaattaactagcgttgaatgatttttccttcaaaattatttatcccttatattcactacaactaaaattttacaacaagatcaaatgcaattatattttgatgaaaaaaatacaaaacttagtcaaatattttaattaattttattaaaacatttaactaagtttcaattaattttattaattcaaatgtttcaattaattttattaaatattttagaaaaatgcaacatttaagaaatattgacagtatcactgacaccttttgcataaaacgttgagtcacaatgagtgcttcatcgcaaagaaaaaacatacgacaaatctaaatatacttttaccaataattaattatgttgaatttttttatcacaagtgaaacatcaagttgtaaatgtttagacatcataaaaactagttgaaatataaaaaataaccacgtgaaacatctacaaatgaactagtgaaatatcatgaaataattattgaaacatgcaaataaagttgtacgcaacattaaaaaaaaggcaacaacaacaaaacttttaaaaaatcaaaatataatcatataatattttgtcgtaaagatttaattataacaaatataacaatatattcaaatcgtatatcggatatcgtacaaagttgctttatcacttggaagagtagaagccaaaatggtcctcacatgtactgatccttgctaaattggggcatccagtttttctcctcgcaccaaacgtccgaggagtccaaggactaggcgtccaatgtccgatgagaactaaaattttggacgctactgtggtacgcatgccattgcttgttatattggggcatccaatttttctccttgagccggatatttgaggaaaaacattcttttagagatgacttagcgtcggacgtccgacgaaaattaaaatatcatatgctactgtagtacgcatggtggtcctcctatgctctgctccacatggcctccccccttctctctcactcatcttccatgatgtctcattaaataccaaactaactactaattaattagttttaaacaatttttcttctaaattatttattcaatatatgatttgattatgctgttgtattcgttacaattaaatctttgtaataattaaatctttataataagatattacattattacactttaatgaaagaa

SEQ ID NO: 19526 - DNA, 1501 bp, Oryza sativa
aattagtcttattaatatttagtaattttaatagtatttagtgtctatttggtttgaagtcaaattttggcatgcctaagaaaatagatcatttcaatagttaagttaggctattttggcttcaatccaaacgcaactttaccttgccaaaattagccataccaaaacttgataaaatttggcattgccaaaaattagtaagaccaatttagaccaccaaccaaaccagccctcaatgccatgtttggtctctggtggtgttggtcagtcagtgctagactgctagtgctgggacgatgccactactgtattttggcctggggtgtgtttaattcacgtcaaaattggaaatttggttaaaattgaaataatgtgaggaaaaattagaagtttatgtgtaggaaagttttgatgtgatggaaaagttggaagtttgaagaaaaattttggaactaaactcggccctggtttagtttccaaaacaattttttttatccatcacattgaatatttggagacatatatggagtattaaatatgaaaaaaaaatcaattaaacaatttgcatgtaaatagcgagacgaatcttttaagtctgacggagcttggggctcctcaccgggagaccgcgcaggcccccctttgccggttcggccgggggccctgggtgaggttctaaactccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgggccagcccccgatcgttctgggatcgttttttcccctcccctcttctaagtgggcaaggtcctccttttatatctcaaggggataccacatgcaccatctctccctctctttcttttgtggggacttatcctatcttttcataaacagacggagacttgtatggttgccgtccgaatgaccttctgatgggacggcccacacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggcatatatctgaccggaaccaacgtgccatctctaggagctaacacgccggctccggctagggacgagtgcttggaggctctcgtcctgacgggatggggcgaggcgtgcgtcagaccgcctgtcgccacctaacccacgatttgaccggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaagg

SEQ ID NO: 19527 - DNA, 1501 bp, Oryza sativa
aatttttcttcaaacttccaacttttccatcacatcaaaactttcctacacataaacttctaatttttcctcacattatttcaattttaaccaaatttccaattttgacgtgaattaaacacaccccaggccaaaatacagtagtggcatcgtcccagcactagcagtctagcactgactgaccaacaccaccagagaccaaacatggcattgagggctggtttggttggtggtctaaattggtcttactaatttttggcaatgccaaattttatcaagttttggtatggctaattttggcaaggtaaagttgcgtttggattgaagccaaaatagcctaacttaactattgaaatgatctattttcttaggcatgccaaaatttgacttcaaaccaaatagacactaaatactattaaaattactaaatattaataagactaatttaggcctcaaaacaatccagccctgaaggtagggcagagaatccggagtgagatgcagacaaaaaaaaacctgaaaccacgttcatttcagctcagggcttcaggcggtagctgggccagaaaaaagggagaaacgaaaaagggcagggcaggaccgcaggagacggtgcacttccgctgacaggtggaccacagactactggtttactcgtagtatgatgaaagaggagtagacgacgagtagttcttgacgctagtggtggtggagcctggaagattcgggcatgtgtagattctaatttttttctttaaatttttaactttttcatcacattaattttttttacatataaatctttaactttttttgtcacatcgtttcaaattctttaaacttttaattttaatgtggaactaaacacagctttcagcgagagatgagagagagcccaaagcaatggaagaaaccaagtaatattgtactagtaggaaataggaaaagcgttcgaaatttacaatctttgacccgcttcgtcctcaatcttcttgcttatacacagtcataatccctcgtactagaaattaccgtgcaaaatttccccacacacgtgctgctatggttctaaatttctaatcggctctgatgagtcaccttcccaacagatgagagaggattttctggctgagtttagcaattagcacagctctttgatcctatctttgctttcttgctccgcctacctggatggatggatcccccctccctattaatacagcacgcttcttcctcttcctcctcacgattcaagccaaacgcagccggccgacctcctcccgtgccttcctcctcgatccccggagagagaaaaaaggctccatcttttttcctctttccgtttttgggcgcgaacgcctcgtcccccccggatcgatcttgctcgcgcgcggtccgtagtcgcgtgctctgttcgaaaggcgagtccctttttttttttcttctccggccgcgggcgctaatttttttggagggcgacgcgccacctttggcccggcca

SEQ ID NO: 19528 - DNA, 401 bp, Oryza sativa
atgtaaattacttttaggttttactgaatttacttttatatatctaagaagtaacttagtgatatttaaaagtaatttagacatatcataaaagtaatttgtgatttttatcaaaatataatcatgtgagatcttgttgtaaagatttaattgttacgaatacaacggtgcaatcggatcgtagattggatgagtagtttaaaagaaaattgtatttgaaatataggtagatggtgtgctcttatagatttatagatgaagtggtagcgctgtgtagttacgtcctactggaaggcctgaggggggcgaaggtttatacgttgagaactcatctgtccacaagaaaatgaatcgtatcagaacgcgcgcggcatattccctggcggtgaacggctgaagca

SEQ ID NO: 19529 - DNA, 566 bp, Oryza sativa
attatggtagttctcatttatactgtatgcactgatatcctaagggctaaggccacaaaagttgcgtacattctaaatccctcagattcatatatcttgcattgccattttttccataaatcttgaaatttggaatgcttcataagttgtattgggacaatggtaaactttttagctgacaaaagtacttttagaatacgatagtttttaaaatacttttggtttaccaaaaattagaccgccttgagtacttatccttatactaaacacttgatctgatgcatgctgagttgctcttcccaacagctttactaggctaatgatctggcatatactttcatcatttcactcaattagcacatacaagttatcttactgtactcttaattgtaaaatttgagataacttgtatgcttcattggtaaatttgctattgtctccgtttcttcaatgactgctcattaaagtgtagtttatttatctatgttccagtatttgcagcagtgcaatgtagtttagcagtacaggattgcataataatttaataagctgaaaaaggcactatt

SEQ ID NO: 19530 - DNA, 1501 bp, Oryza sativa
tttttggcgtgcggtttaaggaaaccaacgtggagcgcatcggcaactctactttagcgtgacatgtgggaccataacaaatctggcccgcatgtcagtgacacagacaaggctgtggggggtgagctgtggagtacacggcgtagttatcctcctctcgcttttggagcaaaaaggagtactagcaatatgacatgtggggcccgggcaacctgtaccgatgtcagcgagagcccgtggtgcgatgcctcgtgcgtcggagaacgtggaccacgggatcagggcattgcgtgctcacatgagctgctcctcatcactgggttgtgagtgactgacactgaagcggttggcgttgtactcgcacaatttgtgtccctggctagtggggcccggttcatgtgcttaccgatcatgtgtacttgatctagtactagtactcctagtaccgagtgatctgtactagtactatgcacaagtatggttgggggcaaatggtatagtagtacaggaggagctaagcagaagaattaagaaactgacacagccttaacctacgttttgggtggattagttaacagtaatctcatgacctcatccgacgagcggttttgagccgttgcgagaagaggaagcaaacagtcacatgcctaatcttttcgatactctcaagtttgaatcgccacttgccccgagactgacggtggtgcagactgcagcgacctgctctgcatcacaccactcgtatacatggaggcgctactgcgctagtggtgctagctagcgctgcgctgggccccctggatccgatctgcaatctgatccattcaattgtactcgccgtactctccctctcggtcaatgctactgtagtatcgtactcttgtggccagccgctggcgtccgtggtactgtacctcgactggttgacggaagcggcgtgatgccgtgcgtagaccaacgcgccatgtttcactgtgctctccgtatactgttcacaatgccccacgcagaaagccacacccgtgaccgctccgggtgcgtccggtggtccggcggaatttcgaggggaaaccgagccgagcgctgcgccgtgccggcgtacatgcgtgtcggcgagcgggggcacgcgaggcccagcaacgggtagtggcgagatgggcctcccactcggccgctcctcgaacggccaatactgggctagagaaaggctcatctgtaacagcccacacacggaccactcaccctagccgagttaattagaggaataagttcactctgactcccttacaggatttgagatccgtgagtattcactcgagtcccgctcagtgagagattgaaaggttctgtacatctctttagcttacgttggcgacaagtaagccagccgggagggcttagtacgtgatgtcaatgatttcatgcttacttgtaactgcagactgctcatctttagttccttcccaattgctatatacaatatgctctggtcaatcgaccg

SEQ ID NO: 19531 - DNA, 1501 bp, Oryza sativa
tgtaacattttataacggagggaatattactcactacaaatttaaaaaatagtttatttttttaaaaaaatctatataaaagattttttgataaaaaatatcagtttgaaaagtatactcgtgataaacgggggagttgtaaaagcaaaatgcgctgtagaacacagccatacgtactgattagtccttttcattcagtacggtgcggcggtgcggttcttcgtgtgattagtccttttcatccagtattcgcatgatatttgctattgctacagcttgatttttactatctgctcgaggtctcgaggctatctcgcgtttgcatatgatccacagattatccatccatctctgcgcctacttgccgacgccgagatgcgtttcacgctttcatcagaggccactgttactactttccgtctttccggactcacacggtcacactgccgccccagcatatttttagaaaataggataaacccggtctctacatcggatcggatgtacacagccattgccgccccagcatacggaccgaaccgccgggaggacgcacgcgcgcgcacacgctgcggccgagggccgtggaattctgtcgtgatatctgtgtgtcgcgatcgcggtggtgggctggtggcgtgtgggcgaggcgagcacacacgcccgcagaaaacgaaagggggaagcagccaaagcccaagcggcacggccggtgtgaagcttgccgccccaaccccacctcgcgcgcgcgcgggggcacgccgcttcgcacgcgctcgcttcagttgctttgcttgcgccaggttgagaaatttgcgcatacatgccgccgcttggcatgccatggcatcatcatgcatgcatgttcttgctcgcggccagtttgcttacgtacggtcgccggtcgcgtgtgctccttagccaccgcggcgctatagccttggctcatgcagctcaggtcgtcgtcgtcgacgtcgccgtctcgtcgaggaggagaccggtacgaaggaaagcaggagtactaatactagttgtttggtacgccggcgagttaatgctttttctgttgctgtttattactgacagacgactgttaatggttcaggtcgcgagttcgttcactgtcgttttgagttttgacgaagctttcttgacagcttcgccttcgcggtctttttctcttccttcttttaccggcgtcacgtataattgcaggttggctcttagtttaaaatcgttcgatcttgctttgaaggtctgattgactgattcttctttgttgactttgtttttataacctttgtcatttcgtaagcattcagggtctgctggtttgcttgcgcgtgagtggcgggactctgcctgtgtttcttgcacggaatgttaatggaagcgattttttactgtatgttgtgccgactccctccgtccaaaaaaaaaagacaaaccctagtttccgtgtctaacgtttgactgtccgtcttatttaaaaaaaatatga

SEQ ID NO: 19532 - DNA, 1501 bp, Oryza sativa
aatattttatttctctaaatcaaaatctattgagttttttggaaaagctttccatacaaaacttttagagttggtcgtttcaaacatttatctagttcaatgtttttccaaaataccaaccattcaaactctacaaccatttgaatttcagcaaaaatcttgacttgaccattttcggcctaaacttgcttatggcgtgttaagcctttagagccaaatttctttgtgaatcttggcttgaaagtgtatctataatcctcctaaggctttacaaatgtcaaactccatcgatttcaaatttgaatgtgatttgagctctcaactcaaatttactcaccctaaaggcctacaatgctccttttgtcttatcttttgatagaaaaatgatttttaagaaattctttttggaaaagttcctcacaagtataaagatcaaatctgcaaggtttcaactcatttcgatttgatttgcaaagattttgactttttctcgttttgctcagcttgctgaaattttcagaacaaccatgtttttgggctgatttgtgatttttgtatctccaaatgggttgcaaatttgaagaagatcacaatatggcttttgatcctcaatagttgaagtttacttacaaatttactcagaattttagctggtcatttggatgccttttcaacctcattttcagtctccaaaaatctgaaaaagtctgaaattttgagttggctgaaagcttgtgagatttgtttcttcaattcggttgagatctgggaaaggaccccaaaatgaaatttttgtatttttacatgaactatctccaggatttatggcatatttttccgagcttagttacacaggtttctattgctaaaagacgtcgccattgctatgtgccttttcagctaaacatggatttcaaagttcatgtcacttcttgttgattatttgagcatggtggtgaaatataagatgtttcaaataatgagatctttgttattttgaaaacttcatgaatccttgagctatgttggatatgttccttatttgaactcttttggtttttgaaatgcccatgatacatgaaaccacctaaactcaaaagtttttttttttggacttctcaaaaccaagccttcatggatagactccaaattccaatctttgccaccaaatacaagttgatccttgctaccaaagccaactaccattccttgatcccaaattcgaattcctatacacaagtggtctctcaacaaatggtagtatcccttgatcatcttgaacccaacactagctcatcattgtcattacttgccgatatcatgcacttgagtaaaattcttccaaatagccttgaccaagctcttctcaatttttgacattcttgaaaaaaacctttgatgagaatatctcaagtgaaagttcaagtgctcaaactcaccccttctacatatgaaacatattccaaattctctatccaaagaaaagactctatgagtaagg

SEQ ID NO: 19533 - DNA, 338 bp, Oryza sativa
aagcatgaatagtacatgtggatatttttaacatgtaaatctcaattttagaaaaatttagagacttgaaccaactaaatccgagctaagatgaattaattatgaatttttgaagattaaatcggattaaatcatttatatagattttaattgaataatgacgcaataatgaattatttttgaaaaggaaaagggaattattgcgtcagcgggtcaggtttacggtggaccgggtgcacggcggctgttcacgaaaacggacggccgagatcgatctaagacgaaacgaacggccgggatcgatctaatccatcgcggtccacgggagaagacgacga

SEQ ID NO: 19534 - DNA, 1501 bp, Oryza sativa
gaaacatttaccgtgccaaccacaagccagcgtgggcaacgactttattttctgtatagtatagttcatagtagagcaccagactgtgaagtggcggagataagcccacgggggtcgctggggagtccataccttgttcataagggggtgattatgatccgggaacggtgcactgctttgaattgtattatatagagggtattgtcacaatctctattcgggtacttgtcaagtatcgcgacgcatggttgacatgatgttgatgttgtgtgttgtgggtacagtggtacacctctggccagagtttgaactattcgaatagccgtgcccgcggttatgggcgggtctaacaatgtctttcgtgattagtctcacaatttacactctaataaatgacgatgttaatgacttgattagctcctggtttggaatggttaattcctggtttggagattgaactgtacagccggggttggttgttcagtatggttgggcctatgcaagagggtgtgttatatagcgttggattaatattgtttaaatattatttaactgttttattaaattctgaaatatttattaaatgctgtttatgcaaatgagacaatattatgccatcctttgttatcctgtgcacttgcatatttgctgcgtggcttgctgagtatgtcatatactcaccttgcaatcattcatcagaggaggagttctacagtgatgccgatggagtggatgattaggcgtagccctggtcaagctgcctgtggagaggagtcgcctgcgctgtttcttttattttccgttgcttagaactttattgattgagaggaactatctacctctgtaatgacattttattcgcttattaattagagtaataattgtactctattatcaatttgttattatgtacctcggctgattcctggatgagggtttctacacatgtaagcgtttggaattttggatagaaactccgggcgtgacaaattggtatcagagcctccttgaccctaggttatgccaaatggttacctatagaagccctctaaaaatattggaaaagtagcaatgttctctcctctttctcttttaattaaatcaaactaatggcacatgcaatgcatgacctctttaattgttctcattcaaaatttatttattattcctgtgttgttactactgtacatctattaccgtactaatggcccatttaccatcaaaagttttataacattgctttatttaattttgctgcaatgaactaagcttagtataatgattttataactctcttttattttatttcttttaaaacctgttattcaaaagtgcaaagtttgtgaacctgtttctaactgtttcatcttatcttgcaagtttgttttattttatttatttacctcttactttgattttctaatttttattcaagctaacccaaaaacttgtgctattaactggataaatgacttaactccctcctttcacttgtcttaga

SEQ ID NO: 19535 - DNA, 1050 bp, Oryza sativa
gccacactgccctacttgcttcacctccctggccactccctgtctccacggcctgttgtggtcgccttcgccgtcggtgtaggaacgatgaatctggctgaggtaccgaagactggccgtccccattgctacacacggtgtcaaccagccccacgtgtttgttgccaccctcactagtgcacgcacagcctgagctggatctgcagataggagcgtccaccagcgccctgcccgctgcaagtttctgccctggtctcgttagtgccccaactgtcgtgaccacgagcaaaactaaaggatgacggctctggcaccaccatccctacagccgcctgactttgctaacggcgatgctgaggaaaggagggagaggggctgacaatggggctggtgtgttcgccgcccgtgtcgccctggagcggagtgacgcgggggtgtaagagagtgttacatacatgttgctgtgttccaggaggagataaagaagattgggaagatacataaaacgaggtgagctattaatgcatgattaattgagtattaacaattttatacttcaaaaatggattaatataattttttaaagcaattttccaatagaaaatttttgcaaaaaatacaccgtttaataatacgggaagcgtgtgcgctgaaaacaaaacaaactcactcacaatcgaaagaacacagccagcagtagagataggtgtacatgacgccggttagtcaaagatgtcacaccctaaaaatcccaaatatataaaatgttgtttaattggaattattagaatttattttaaaagcctagaagagaagatctaatttttaattaataaattccaatataaaatggggccagataaaattttattaaatactttgcttaattctatagttcctagatttttttgggatttatttgagctaaggaagtatttttaataaatgaaattgcatttcatgaaaaatttaaattgaaaaaggtttaaaaagttctcttttggctttgggccgaaagtcggcccaaacctctctctcgccctcggccca

SEQ ID NO: 19536 - DNA, 1501 bp, Oryza sativa
atggcataatattgtctcatttgcataaacagcatttaataaatatttcagaatttaataaaacagttaaataatatttaaacaatattaatccaacgctatataacacaccctcttgcataggcccaaccatactgaacaaccaaccccggctgtacagttcaatctccaaaccaggaattaaccattccaaaccaggagctaatcaagtcattaacatcgtcatttattagagtgtaaattgtgagactaatcacgaaagacattgttagacccgcccataaccgcgggcacggctattcgaatagttcaaactctggccagaggtgtaccactgtacccacaacacacaacatcaacatcatgtcaaccatgcgtcgcgatacttgacaagtacccgaatagagattgtgacaataccctctatataatacaattcaaagcagtgcaccgttcccggatcataatcacccccttatgaacaaggtatggactccccagcgacccccgtgggcttatctccgccacttcacagtctggtgctctactatgaactatactatacagaaaataaagtcgttgcccacgctggcttgtggttggcacggtaaatgtttcacaaccgaaaatcgtgaaccagtccttaattgtcatgagcacgaccatcaaaaccatgtgctcacaacccaccattatcaggttttagttggcaaattaattaattaattattcatgattaaccatcatgagctatcattaagccatcattaaataatagtgaatcataagttatccccgtagtgaactaatgtttctaagcatgactaagcaattatgtctaatatctagctgaaccatcatataaagctcaactagtcaaattataatagcccaaggtatcaaggaataaagtaatcaagaacaaaacggccataacaaacaataggttaattccacccaattacattcgaaaataaatgcaatagttgaatagaaacaatagctttaaacgggatcaacatgctcaaagggttgtttgggatttgtgtgacttgccttgctggccttggaattcctcaaattcttctcctgcaaaatcggactctcccggaacgtcggaatctaaagagaaaagaacaaaatcaccaaaccagcacataaacaagcatgaatagtacatgtggatatttttaacatgtagatctcaattttagaaaaatttagagacttgaaccaactaaatccgagctaagatgaattagttattaatttttgaagattaaatcggattaaatcatttatatagattttaattgaactatgacgcaataatgaattatttttgaaaaggaaaagggaattattgcgtcaacgggtcgggtttacggtggaccgggtgcacggcggcggttcatgaaaacggacggccgagatcgatctaagacgaaacgaacggccgggatcaatctaaaccatcacggtccacgggagaagacgacga

SEQ ID NO: 19537 - DNA, 655 bp, Oryza sativa
aaaattgctaatcggtgtcaacaattgtgaacccaattcgttccaagtgtttaagtaaaggaaaaaaatccaaattacccccattaattattactgtcgaccaaactaccttgttcaacttaaaaaccacacattttacactcaaaagctagacaaataccgcattccccctcccaaggttattccggatggtttttgtctatgtgatagtccagttagcaagttttttaaaacaaatggtcaggcccacctatcaattctctctccttatctctttgactctttcttgtcttccctacggccacaaacaacatcgctgccactcctcttcctctcttgcgtggtggataaggagctcgcgagcagcttgagctcggctcgtcgcaagctcggctcgagttcgactcggcaaggattcgagccgagctcgagcttgtctcgaagctcgcgagctctaccgagccgagctcgagctattcggcaaaagcttgaaattttcactcccgctacccatcccaatttctcccgcactccaattccaaaatcctaccaccaacagcagtccatcacctaaccatttatttcccttatatccccatcccgtatccaaaccctagctcatttgctctcttcctcgaaacatttctcttctaga

SEQ ID NO: 19538 - DNA, 273 bp, Oryza sativa
aaatctgtttcgtcgggtttgtgctcgggccgtactgggctggggtgattgggctcactggaaataagctcatttttggtccctcatgaattcatccctaaaccgaaatacagatccctcgattcacaaaaccggcccacacggacccccaccggatcacaaggtcctaggttgtactatgtccaattttagttaacatggcaagttgagtcagggtgggaaccccgtaggatccacatgttaacacccaacactttctttctccaccgtagg

SEQ ID NO: 19539 - DNA, 207 bp, Oryza sativa
ttttgcaaatcttgccgtgctctcagtctcgggagggaggatccagctgccgccgccgctgatgctgctggaggtagacgaaggaaaggaaatatgcgttcggggatactccttgcgcaagttgcaagtagctacagtgtgcatcgggaaggggaggcgtttggcctgacgcgccagagtccgtgtcacgccgcgggagagccgcca

SEQ ID NO: 19540 - DNA, 1501 bp, Oryza sativa
aatcattttgtttttaacatcttataattacgatgtaattacgtatcgcttacaatgcattaaatttatgcaataattatatttgatatgttttcattataaagctttctccatacatactcccacttgcgctgcgctgtaacagtgatcatagaacaccgaaaaaataaagatgttttagatacttccggttgaaaaatggaccccaaataacagcgaccatacagacatacagtttgcactcatacgtcaatcatagtaaccagggacacgtacgtgacacgcgcggtccacggaggggcttccacaactcacgctctccgacgtagatgccggctccaacggtagcagatttcgctcctcctagatctcacacccgcaacaacagaacacaccaaacaatgggacgtaaatacacagctggtggtccagctagctagaggcaccatccacctatattttaaatataattttctcttaaattacttatccgatctacaatccgattacactgttgtgttcgtaacaattaaatctttacaataagatctcacatgattatattttgataaaaaatcacaaattacttttatgatatgtctaaattacttttagattttactaagttacttatataaaagtaaattcagtaaaaactaaaagtaatttacttcttagatatatatgtaaattacttttagtttttactgaatttacttttatatgtctaagaaataacttcgtgaaatctaaaagtaatttagacatatcataaaagtaatttgtattttttcatcaaaatataatcatgtgagatcttgttgtaaagatttaattattatgaacacaacggtgtaatcggattgtaaatcggatgagtaatttaagagaaaattttatttgaaacataaatgataggaatatttcccctacttgctcaataaattaatagcaaccaaaactcataaaataatagcacgtgagtggtctctggttaaaactaatttaagatgcctcttcaattagatttaccgcaaacaatgacgtcctccctgcttggaccgccactcttttttttttcctcccgcgaaaatcacgtgagatcaacaagtcggcgacgctgcctcgctcgaccgttcgatcgatcggcaccgcacggcgccatctacagcggggcttcccagaaaagcgcaaaacaacacggccatcgtcgcggtggcccccgtgcagagctggaaagtgagtcgccactcacggccacaccgtacgtaacgtgcggccgtcgagcccctccaatccggagcagagcgccaccaccccccgcccgtgtccgtcccccgcgcgacgcgacgtgacgcgtccacactatccctagcatggcggctctcccgcggcgtgacacggactctggcgcgtcaggccaaacgcctccccttcccgatgcacactgtagctacttgcaacttgcgcaaggagtatccccgaacgcatatttcctttc

SEQ ID NO: 19541 - DNA, 191 bp, Oryza sativa
tcagaagaactttgtgaaagtatagtcaacacgtgcaatccaatccatgtcgttatgtctcatcttactaaccacttgatgtctcgggtatatttaatgcatccatgacactacaaagtccaccccattatttgatctttgatcagcaactcgttgaactgcatccactagctagtacagatcgatggccg

SEQ ID NO: 19542 - DNA, 683 bp, Oryza sativa
gattgatcacaatttgtatcgcaacaaatatgcgttgcccacaaatttggatctcatcggattaactgcattcccaatttagtatactcaaatatagacggcagattcctctaaaaaagatttatggatggcagataatgatcgagatccaagtttggccaaaaaaattatttcgacccaagtatggcctacaaaacttacggtaatcaagatcggcatttggcccatataacttctgatcagacaagggaaagtggcgcccatcataaatcattattgggaacagcctagatcgccaacctaaattggatttggatttgctaatcctcccgtagtcccgtggggatccttgtttccgccgcctgccggagctcctcaacgttgcgactgctaatcctcagttcacgctctgcgaaccatgatctgtctatgtagaacttctaattagtcccctcgaccacacgggtaaaatattggtgttataatttgttttttaaagtaaaattattacaatctcatagtacaaacttgtgctccagacttctggttgtagagcacaaaacagcagatagacaggttagctccagacttggtcaacaaaatgtgatgcatgcttagaattaatgaatcatacacgttccactgattacttgacgaacaaaacgcgagaaatcaactagtga

SEQ ID NO: 19543 - DNA, 1501 bp, Oryza sativa
cggcagcccccaatcttatggcaaaaataaaggaagaggcaagaatctggataatggcaggcgcaaggtgacttggagaattcctaccaacttaaccatagtgcttatgtaattttgtacagctctttttttttttgcccctaggggatatatttttttacgcctatatctaatgaaatagcacaatcttgtgatgattcctttcaaaaaaagaaaaagaaaacccacgtgcatttccttcgcccagaaaagtttttacatagaaatatattattctactaccttttacatagaggaaaaaaaggaggggtaatgagaacaactggattgtcatgtaagggataaaaaaaaggtgtttggaattcataagtttcggtcccctgaaatctagacactcccatgtgaatttcataaataagaatcaacaggaggtagataatcaaattgttttattgtgacatcccggcctaaggtttaataggattaatagaatactcatattaacaagttacaacttctttttccgaagccgatctctaaatctgaggttaagcgtgcttgggctgaagcaatttaggtatgggtgaccgatcgggaagaataatttatggatggatgaccgatctggtttgtgagggcaatctatgacctatgaaggctgtcatatgtaaacgggctcggcctgggataggcgaaacgttacatttatcctgttttttatgtgattttagtccctctaatattcactcaaagcagtgtactctaatataattcctcctcctttattcgtcatttctccttttcctaaatcctaatcttgtattggaattgtactttatgtaacattttaaatctatgaacgatctcacttgtcctcctaatggagcgattagttgaattgaagaagaaaaatggttttgaaggttctggattaggtcataattttttttagattattcttttttttactaatagataactttgggattattttgagaaagtattgagccacgtggtaatattggccggcagtgaaaaccgccagcattagtaagatagatacacaaaatgatttaaattgctccaggccaagcacgcttaaccctggagttctttggagattggcttccggaaaagaagcccttaagagagatggagattggcttccggaaaagaagtcctaggccgggatgttaccccgccgggatgttacaccctcacccccttaagagagatggagattggcttccggaaaagaagtcctaggccgggatgttacaccgccgggatgttacaccctcacccccttaagagagatggagattggcttccggaaaagaagtcctaggccgggatgttacaccctcactctcttaaaagagatagacgccaccgtcgatcaacctttaagtaaaaccgcgagagtcggctctgataccattttgtaatatcccgccttcccccaggccgggcccttaagtgaaaccgcgagagtcggctc

SEQ ID NO: 19544 - DNA, 210 bp, Oryza sativa
cacctaaggacttttagagcttaattaatctagtgctagtattaaactttgaaaattaataactcccaaatgcaaagtgataaaatagaaattccttcaccaaaaatcttatccacacagcacctaaccacactagtaaactcatgcattttaaagcattttagatttttacatgttttagcatttatcgttaccgttattccttttagg

SEQ ID NO: 19545 - DNA, 315 bp, Oryza sativa
caccccgatctaatcttcatccccgatgctgatattgccaaatttggttgttaacacatgccccccaagtccggaatatttggtaatgtttcggatttgccatatatcgatttcgagcaaaattcgctcttgccgtttcctaaccgttactccagcgctttaaatactaatcgttgcccccgagaaacctcataccgtcttcttgcgttttcaccgccgaagctaactttgtcttctctctcttcgacgatttctccgacgcataaggcgatccctaggcgacttcatctccaattagatctccgcctgcagcga

SEQ ID NO: 19546 - DNA, 161 bp, Oryza sativa
agtttttgcaacttgcgggtgtagcagtctctgtccttgcgaccactctcgctgcatgcatatagcactggagccatagcacctaacgtaacaactagtactacaaaagaagacgaaagcagttgacgtactactgcactcctctgagattgttcgttagc

SEQ ID NO: 19547 - DNA, 1501 bp, Oryza sativa
ctccacgccaccgcggcgtcgtatagagccgccgcgctgccgccgccacgaagccgccgcgccgcgccgcgccttgcggcgacgtcgccaccgtcgccgtcgccgtcgccgccgtcggtaagccgccgcccccccttgcgtccatcgtcgtcgccgcccgggagggcaagaagctgagagagagaaagagggagaaaggagccgggagggagagaagagagagaaaaagaaagagaggagaggaaaaagagagaaaagaaaagagaaaggaaagaagaaaaaaaaggggaaaaagaaaagaaagaaagagagaaaataaataggcgtttgagtaaaatttagaagtttagaaaattcaaaatagttaagaatttaatcgtaggttaattatagtcgtaaaattgcgaaagttaattataggattaatgaaaatatagttagatgaattcttactaattaaatacctaaaatactagcatttaattataggattaacgaaaatatagttagatgaattcttactaattaaatacctaaagtactagcatttaaatataggattaatgaaaatataattggatgaactcctatagattatagattatttttagtaatctccgtaagaaatcaatttcgcggtaataatttacatgtgattaagaactcaataattcgatgagtcttaggacatgactataaattacaaaatatcttagggagaagaataattccacttcgcaaataaagtagcctatatagaattcacctcccgcgctcgtttttcaattcggtcattatttggattttgtttgaattctaatcgaattcaaattgttcttacgcacgtaactatagagaccgagggagccgcggatccgggtgaaggccaagacccacaagacctagagcaaggcaagtcatcactattctttgatcacgttgatcccaattgcgcaaaaattgttttgtttacaaataaaattgcatgcaatgatgaacatcctacttgtgattatgccatgccttgattattgctaacccttaaatctttgtaaccatgtttacgtatgagtccctagtcaactatgacaattgcttagaaatgctattctagaatcatttatagtcatatttatcaaatgctatatgcttggggcaattacctttgggaaggtaattgagatgcggcatgtggagacataagcgccacattgccattatgttgatgacatgatttgtgaaaggagaaataaaattaaacaatggttttcgactggggcggacagaggatttgggtggtatctgggaaaggctagtaccgtccccggtcaattaaggactgagccatgaagttaagcatgaaacgacccccgtacaaccgtacttctcgaatgggtatagacctagcggattagatagccgagcggaggcagtatccctgcatagatggttcacccctgagtgaggcaggtgcactacggtgggacagccgttgaggtag

SEQ ID NO: 19548 - DNA, 1428 bp, Oryza sativa
acccaaaaaccaaaacttttagcggaaataaaagttaccctcaaattcgatggatcgcggtctgaccgaagtgaacgcaccggtctgaccgcctgatgaatgttggtctgaccgatgtagatcgatcggtcgaaccgacgaaatcgcctgccgctgcctgcctacgccgccggtctgaccgccggtgagatgccggttagaccgccgaaacccggtgaaacaccaatcgtaccaaatttggactccttccaaattcgactccacatcccatacgcacacaatacctccatcgtatgccatatggaatcttcaccaaccacgtgcatcaactctagccttagtatcccacatgatatctgaccaccacggacatcgtcttaccaccaagccgactcccggtccatcaccgcaaatactctcccgaggcatcgagtcacctacacatgaaacaaacaaagaaaccatattccgagaccaagctatccccaacttgactcattattagcaaacaacagtattacatacgtatagtatccatctagaagccataacgatgaaacaatcgcggatatccaaagaaacaacccgaaactgaaaccgacacagcgtcggccggtcagaccgcgggccggccggtctgaccgctcaacacaagccggtctgaccggcaactccgcccggtctgaccggtcacataaaatatcagtaaatccaaaaccactttgtgaataaattccaaatatcaaaaccaataatcacagatgccaattgttcatcacagaataagaatcaaaacacacgttgatcttacagcttcatgtctagatttgttgtaataggatgtgccacatccaaccaaaatctcctatatttatggacggagagagtagatagttttgaagttaaattttgatacattggtacatatttttagcgctgaaggaaatatcagggcattacggaaattgaggtatgtcatgacgacactgtaagtctgtaaccttgcttagagaagtaaggcaggtagaacaaagccagaatggggataatttagtatccgctttccgcggagataccaagagcagcaggcgccaacgagacacaagatggcacgctgtgcggagcaaaggagttgattcccatcgatcgatggcagctagctggttcatgtagctaacattaagtaattttatctttccaataccaatatatcattcatgatgcaaaaatcttggaaaaatttcagtgaaatcacaagcactgttgctaacatcgcccgcctggccgcctcatcttactactctcgctcgggtatattaatacaccttatacacgtgtggtactgcaagcattcacatgagctcggtaccccgcctcctttgttttgcattacgcgcgtacgagcaaccgtacaagcagtcaaagcaa

SEQ ID NO: 19549 - DNA, 1501 bp, Oryza sativa
cttggctcgctgccggcgccacgagtcgccgtccacgttgaagatgccatcacctaaggtgtcatcaaagatctcggcgaaatcgggtcccttggggtaatttgcgaagttggaggtgaagatgtgccggacattggccgagtcgcaggtgaagaagaaccgcatgttggacgacatcgttgggccgataaaccgaaaattgagctgggaggcggtgagaaacgaggtgatccagtcatggagctggtgacggttgacgagaagatcagggagcatgcccaccaacggccaacacactgggatggcagggttcttcctctttgatttgatgtggtagtagtagaaaacgctaaagcagaggaaacagagcgtgagctggagaatggaagagaaagccattgctttgactgcttgtacggttgctcgtacgcgcgtaatgcaaaacaaaggaggcggggtaccgagctcatgtgaatgcttgcagtaccacacgtgtataaggtgtattaatatacccgagcgagagtagtaagatgaggcggccaggcgggcgatgttagcaacagtgcttgtgatttcactgaaatttttccaagatttttgcatcatgaatgatatattggtattggaaagataaaattacttaatgttagctacatgaaccagctagctgccatcgatcgatgggaatcaactcctttgctccgcacagcgtgccatcttgtgtctcgttggcgcctgctgctcttggtatctccgcggaaagcggatactaaattatccccattctggctttgttctacctgccttacttctctaagcaaggttacagacttacagtgtcgtcatgacatacctcaatttccgtaatgccctgatatttccttcagcgctaaaaatatgtaccaatgtatcaaaatttaacttcaaaactatctactctctccgtccataaatataggagattttggttggatgtggcacatcctattacaacaaatctagacatgaagctgtaagatcaacgtgtgttttgattcttattctgtgatgaacaattggcatctgtgattattggttttgatatttggaatttattcacaaagtggttttggatttactgatattttatgtgaccggtcagaccgggcggagttgccggtcagaccggcttgtgttgagcggtcagaccggccggcccgcggtctgaccggccgacgctgtgtcggtttcagtttcgggttgtttctttggatatccgcgattgtttcatcgttatggcttctagatggatactatacgtatgtaatactgttgtttgctaataatgagtcaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttga

SEQ ID NO: 19550 - DNA, 348 bp, Oryza sativa
ttttggtactctcctattcctacattttggtgcacatgtgatgggtatagccattttccagatgggccattcaaggtgagatatggaaactgaaccttctgatcttcatcaaaggttcagttccctctaatcctcatttcaaatggcacatataaatatggtcctagctgctaaaacccaacactagctgccaatctgttcatgtgctgcccaactaaagtattccatcaagcaatcaacctgaaggtgagatattggagaaaaacaatctgaatattaattgtttgccacactgttgcaagcatcaaccagcaatcagtttgttttcctccaattctcacttccagt

SEQ ID NO: 19551 - DNA, 452 bp, Oryza sativa
gaatagcgattatccacagccaggcgcctcacctctatcaaaactctgaagacacattgttggtcttgtctaatatatagaagatttgaaacatgtcttgatcttgcatatttcctttcgctttggtttcataaagaaaaggtgcaggttatcctcatgttaaattgttaatatccattgttaatcttgtttaacgctataatgttttataagctggaaggagtaggatattaggatatatcttactaatgtaaattttgtttcaatgaattggagggggaaagacaggttccctcctgttaaaactgattcggccaaaacgagagaagcgcataaataaatctttacacagctccgttttgctaaataccaattctctttttctcaaatttgtcagatttacaagtgcagatcacaactctaaaaaccaattctcaatgttgcaacacagt

SEQ ID NO: 19552 - DNA, 320 bp, Oryza sativa
tcaaatgatgcctgcagttgattttacgtttgctgtaattatctagaaaaaacgttatttagtttgcttgggttgtctatttcaattgtgcagctggcaattttcttgaattttatttgtacatactactactgtatggtttctaatgctcctctatgatgtcggtttgatcgattttatgttcctcggttatcggttttgacggactggcctgcgccctgtaggaaggtatcgtatagaactgtgttgcaacattgagaattggtttttagagttgtgatctgcacttgtaaatctgacaaatttgagaaaaagagaat

SEQ ID NO: 19553 - DNA, 246 bp, Oryza sativa
acaatatgaacatgttgtaagtgttctaactatcttatcagaaaatagaccaaatttagctgaaaatatcacaaataaatatgcaagggcaagattacctcattagccttagagacaattcatcaagatggttattcaatcatctcatcatttttctccattgcagtcatagattaaagatttaaattcgtatcatttttttataaaatagctaaataccaagttcaatcattttgttttttcagg

SEQ ID NO: 19554 - DNA, 956 bp, Oryza sativa
tggctgagcttatcagcaccacgtgaaacgaggcatgccattagcgcatcgttaagtatggactattataaattacagaagtgaatttatttgatttttaataaaatatataaagtttttgcacgaaattagtggttcagaaaacgtggctcatggcaaactggccctaagacatgacaatgacaatcagtctcatttattcataatgggatgtctcataaacatcccaaattaattatttgcagttgtttgtgttaaatatgtgatccgaattttggaccaacaatatatttggattagttatctaataggactgcattataggattagtttcctattaggactttgagtctttacctattaggactcctagatttctcctatatatatatcccttgtaagccgtacagggagggtgcgacagctcaatgtatcccctgcgtttgtatctaactcctctatagtgatcattgccggtcggcgtctatagttttttccctcaagggtttttcacgtaaaatttatctccgttgtacatttattttcataacagttcggcccttcataatagaactgcgagctgaaaatatgtgagatcttgtaacagttgccctgcatgctgtgttgcagatcgttgctaagggaatggcctttaccattcccatcggaggtggctgctgtgtgtcgcgtggccgatgaatccaccgaaaagagatattgacaggtctatctcctagtgttggaagctgtgggagtatttcaaatggtaatgtactaagttccttgggtgaaaacaaataaaaggtagctgataatttccacattcaaggaaaataattaaaatgatccaactttaattagtatcaactgaatgtttgtagacttggagttctttggaacatctgttactgtagaacattgcataatgtaattcatcattcatttatcctttttga

SEQ ID NO: 19555 - DNA, 1501 bp, Oryza sativa
aatatgattatcacaagaaatatataaattattagttgagttctctctacatgatcttttcacgagataaaataaatacgatacccttggaatactctcgggtgaaatgctacaatggtatatccatgcgcttgcgaatgaactctgtaaccataatataccagaagtgtttctgcgccattgctgggaattatatttctagtaatgtcgttaagaaataccaacagcagcaccgtgagatcttcgtgctatctcctcttctgattcccaattcgattatgtttgattttatttactggctcgtattgatctctgttcgatcccaattcgaatatatccaattcgaccaggtccgtatctatccaagtgagcagagcacccctctatatatccatctctagctctccctttcttcattgaatggatgaagaacttgttcttgagtgtttgatttcgagttggatgagcgaagagaggatgaacataactacatgtgatagagagggagatcgatgaaggaagaagaaatgggcaatctgatctaaaaattttagaaaatacagtcacgagttaagtagtgccatctatcgaataacagcaaaattatagtgacatttctccaaatagacgaatagtaataaaatatttcaaaatcataaaagttataatggcatggttccaattaatcctaaacattaccagcctataatgagctagtagcccatataagtgcaatttgttggctgaagagtttggtggttgagttgatatctacaagctagctaggaaatcatgaaattttatcgttctaaccaattttaaatgcaaatttctaattacgttatgtccgttttcatatttataaaaagttcatatttctcaaaattattggttggttatgaatctacttttgactaagacgttttatacttcttttagatatttaggctgtgttcggctggctaagttcccaactggaacagtgcgcataaaaaacagagcgatccatttgcacgtggttaattaaatattagttatttttttaaaaaaatggatcaatatgcaattttcgtatagaactttttacaagaaacacaccgtttagcagttcgaaaagcgtgcacgcggaaaaggaaggagaggtgttgggaacctggatgcccgaacacggccttagtgtatcaagaatttgaaattcttaattaagacaaattcaccatctaaggacaagaaaattgttatagtatgtgtagcagtgttcttaattgtatacttgctctccctaaagttaactgtctttttgggatgtgtgcagtaccatgtttaaactttgacaattaatataatatcactttgaatattttgaattcaacttttttaaaattgtatgaatagatttctcttccaaaaatggtttcaaaatattataactttgctacacttttccatacctttttattttatactagtagtaattactatcagaaaaattcttttggtg

SEQ ID NO: 19556 - DNA, 219 bp, Oryza sativa
gtctgttagtttgagtgtttaggtttttcgcttgggggtcagtcgacggtcgatatcatgtgcctatgatatggctgtcttaataaggatttgcttgtcgttttaagtgttttaagtcaaatcagaacaattgcagtttacattcctatataataaagcttagttccggagcatctgtttttcttctttgcccccccctccgtctgctcttccttcaga

SEQ ID NO: 19557 - DNA, 1501 bp, Oryza sativa
ggaaaccctagaagaattccttgtacttaccacaagccagcgtgggcaacggctgggcttgtagtgtagctttcctctagccgacgcatccaggcaagggtgggcgtgatggagtggggcgtcccctgcgacggcctctgtcacttccggattcacctaggcacgagaggggactgcccgttgcccactggggacgggggtgaaacctgaggtgtggtgtgcttggttagagggggttatgcgaaggatcctgtcacggcctctttccggtatgtcgtggtggcatgtcggcgcacggtaacgtgttgtggggctgtgtcttgtgggtacagttgtacacctctgatcagagtaaaactattcgaatagccgtgcccgcggttatgggcggtcaaccagattcaccatgattagcttcaccctagtgtagtctgttggaactgattagttcaggtggatggttgggcctgttgcaacgtggtgtagcgttgaacagtggatggttaatattgattaattattacagctgttttactgctttcaacttctgtttataaatgctcgctttatgcaaatgaaccattatagctatcccttgataattccctgcatcatacccctattccggtatgacttgctgagtacagtgggtagtactcagtcttgctctattttccccaaaccccagaatttgagtatgcgtcagatggtggtctttccgaggagtaggcttcgcccgtgccgtcgaggatgcctgtggagtggtgttcccgctgcaagtccaagtcaaggcttagctccagttatcctttaagttttccgctgcatttttgtaagacttttataatgtttgtaagacgtggatctgtatgtcaactttgtcgtttgtgtaccccggatggtcctggacggggattttaatgcacattctgcttggaattctattcgggaatttctgggcgtgacaagttggtatcagagccgaccttgactgtaggacaagccaaatggaaaaacctaagagccctctgaatccttttcattgcatatgttctttgcaattggatttgttcctggaaaaattgggatttgttcttgtggttcaagggaaaaatcttggtcgctcgtttaagtgagatttgtcaaaacaagtcagtctagggttttagtaaaattacttgagatttattcgacagtcagtcgggatttgatgggaggaatgcattaggtcctaactcaggaatatgggttgcaaggtatttatgctcttattattattagtagtatgtaagtccatcttatttattcgccctcgtgcaaaaatgatctatgcataaaattccgctcttattcgcgtatttaattggagtcttttactgcttcatttaagtcggatttgagcatgcattgatcctacccctttgtcttctctagatggccgatcacccacccaaccatcgcggagaaggcatggatgattttgtggcagagttggctcgca

SEQ ID NO: 19558 - DNA, 1383 bp, Oryza sativa
cgcgggagctgacactggggcaggagctgggactggagctagagctgctcgagctgcgggaactgcgggcagaactggaggagctgcaggagctgcgggcggaggtgggttcctgggcgcaagctgaatgcgcacgggtgcagtcgttgacttgcggggcatgttgcggatccggactcctccgggaatggggaggcccttcaactgagcattctccttcttcaggcgtgcgatctcatccttcagagctatgatcctcatgagcttcccgtcatccgagtgcatcttgtccattcccctcatcacggcacacatatgacctaaggtggtgtcgttctcgccggctgtcggacagaaagtgctgatatcatcgccacttgctcgacgagggtggaaacggtacgctgtgttgcagaagatgtagttgtggcgctcacgtagtctagccatcatcaggtatgccgcctcctgacaggcgtgatctgcggtgcctccagatgcctcaaccaccatgttagcgaggcaggtacccacatagccatgaacctccagacgaacccggtgaggaaactcaccactgagcggcggaacagttgagtactctggcgcgttggggtagcccaccaccagtgtcatgcgagccaactctgccacaaaatcatccatgccttctccgcgatggttgggtgggtgatcggccatctagagaagacaaaggggtaggatcaatgcatgctcaaatccgacttaaatgaagcagtaaaagactccaattaaatacgcgaataagagcggaattttatgcatagatcatttttgcacgagggcgaataaataagatggacttacatactactaataataataagagcataaataccttgcaacccatattcctgagttaggacctaatgcattcctcccatcaaatcccgactgactgtcgaataaatctcaagtaattttactaaaaccctagactgacttgttttgacaaatctcacttaaacgagcgaccaagatttttcccttgaaccacaagaacaaatcccaatttttccaggaacaaatccaattgcaaagaacatatgcaatgaaaaggattcagagggctcttaggtttttccatttggcttgtcctacagtcaaggtcggctctgataccaacttgtcacgcccagaaattcccgaatagaattccaagcagaatgtgcattaaaatccccgtccaggaccatccggggtacacaaacgacaaagttgacatacagatccacgtcttacaaacattataaaagtcttacaaaaatgcagcggaaaacttaaaggataactggagctaagccttgacttggacttgcagcgggaacaccactccacagg

SEQ ID NO: 19559 - DNA, 665 bp, Oryza sativa
tcctgcagcccatatagagtagtatcagagtattagccgatacatgctagatctatctgatcggctatgctataaacatatatagtcctgttattgatatatatttcggtctaagtgattcatactgtctcggcatgatgaccgatctatcccaatcacttgatttaagtatacatcgatataaggagtatatatcgttaatatctatagccgatcgagtagatttagttcttctttacttattcatgattgtcgatcgatacacagatgacatcggctcaaagataaatgatatgccgttggcatctagccgatcggctatcatttatagatttaaccacgatttctttgtttctatttcttgttgattacaggatcgaatcaactggcacgctaacatatccgaaggtgagctttggacctgcactggagttaagcagatctcccaggccacgtgttgatctccaagtagaactcggagacatcggaccctacacgatacagtgacgaccctgttctatccgagtaggaatccttccatctgtggactccgtgatgaatttccttaacgtgtacagagaatgtccgtatatgcgtagatataccatatcgatacatgatgtatatccaagggtagagggtataccttatccgtaaccctaaca

SEQ ID NO: 19560 - DNA, 568 bp, Oryza sativa
taatcacagattgatattgtttttctaattcttcttttgcacgtccgcatatactactggcggctgagttgctctgatggacgctaactacctaacaagctgctgccgtgcaagacaaagcactccgtctactcatcatgagtccaagtcgtaagccagccacgtcttcacgggaaccatgcgacatgctgatgcttccaggctttgaccaactgctacgtgcatgtgatttaatatggatatatatgtgctctctccatgcatgcctactccatgcacaggaaagctcaggccaggacattacagctccctggaaagcatgcccgatgtgttgattcaatcaacacgcgtggattaaaatttttttatcatgctatactttaaatagatgttttctagtatatgataaagcatctatattttcctgctcactaacagagatctatatgtttgctttctttttgcatatgcgatggattcattgcaagagatcgatccggccgactctagcacgactaatgggcaactcgccttaacgccgcctcatctgccgttgattggtccttac

SEQ ID NO: 19561 - DNA, 1501 bp, Oryza sativa
ctggagtttcctccagacccgtcttgcaccgctttcgcccgcgccgtcctatgaaggatttccgtgatttccatgaaggcaggctaccaaagttttgtgaattaaaagacctcaaattcatctagttacttctcaccaagtgtcaccagcctttgccggcgctgaggcgggggagacgcgtctaaggcctaagtaaaatgagcatggtgtaaggtcaagatcttctgactacgcgataaaggaccagaaaagctcaccaatggggtaggcgccttccgacgattcccaagcacagaggagaacttcctccctctcttcggaatgttgctgccactcattgtagcagcagcagcagcagcaatgtcagatgcctccttggcaatgccctctttcaatgaggccgctgcctggtggtccacgagcggcccgatgacgtcagtcagagggagagcctgcacgcatgaagtctcagtacgatccagaaaagcagaagtaaaggagttctcaaatacactcacgatgatcgtagcctcgcgatcagccttccccttctcacaaagagggatggggacgttgcttgccgtcgtagggccgctgatcatcacctaaccgacgcggtgctccacggttttgctgtttaaacctgtaagatcgaggagtagaactcgataagtatggaggaacatgcaaataaagagtgtaatccgaaatacgagaaaaataccccgaggagaaacccaggtcgcgtcctccggcccagaatagtcaaaggctaggtgggctcgggcctagagcggctgaatccacctaccgatgaagtcggcagcgacttcataccccgataaccctcgtactcggaggtcatcgatgacatcgatgaaagactgaagggaaggggttagggcaggtttggcggcccattcggaaatcttatctggttgctcctcaggaacaacaaagactagatccgaattttctatctgaagataaaaccacctcgtccgccatttgctacgagaagaggggcactgaaaggggatgtatcgcgacttcaggccatctcgaagccggaaaccaacacaccggacacctttttaggttccatccagcgcaactcatagtagaagcgaaagagatcaagaaagggctctaccccaatgtaggcctcacaaagatgggagaaaatactgagaaaggcgatggaattggggttcaggtggagcaaagaaagaccatagatattcaagacgagaagaagaaactcggagggcggaggaagaaaaccacaaagaatatagtcctcaaccgcaaccatgcggcccaggacaggttcgggttcaatacctcctggttctctctccatggtcccgcgacaagggagagcgccgtcctcctgcagcttcttcatggacgcgctggtggaagtggacttgtcgagatcactgttagggttacggataaggtataccctctacccttggatatacatcatgtatcgata

SEQ ID NO: 19562 - DNA, 697 bp, Oryza sativa
ataatttatataacctcaaacatatacctgacaaacgagtctaattgctgcccacaaccgaatttgcagttgaagcttgatttgggacaaggataatagaattagtatcatcctcctagtatgcaacaaacaagtaaacacagattattagattgtgtatctctattaattggttagaaacatgaaaatataagaacttactaaatctgtgcttttgtggtggcctcctctaatccaactagatgtacacaccaaagcttgtactgttgatgggagtaaagagctgcgataaacactaatcactcgaccccctgtgctgaaagctgattcagatgagactgaggtgatgggaatagtaagaatatccttggccaactttgccacaattggatactttaattcattcatcctccaccactgaagtagattgaaactttttgcaggaatatcctcaacaggatcatctaagtacctctttaaatctgacttaggaagactagcagcattctttgatttcatatactcatgaaattggttagcagcagagaaatgactactagtagtgcctagagatgtactagtagattgagtggttgcatcattttcctttgatgtgctctggagttcactttcatatgatgcatgcaaagatttcaatgtggattccacatttgcaagtttcttaggaagtacagtt

SEQ ID NO: 19563 - DNA, 1240 bp, Oryza sativa
ataatatatcaaacaaaggtctaacatacttagatgcagtagtattttgatataagggcagatttaacatgtcaatagagcatatagaacaaatatagttaaatcagatacgatcggctgaaactctgatgctattctaatcggcaactagaaggcaggctagagattgatattctaagcacgacttaatagatcaaactcaactgatgcagcattaagtatgaaaagaagaacaatatctagacaatcaaaccgctagaagtctcatagaatggtagatatctcatataatctagatcaacatcaagatctaacctaatcggctgccttctgcatatagatgttagccgataataggttaggtggcgatattgctaaagattatgtaagatatatgataactcgacgaattatataaacaagattagagtatcataaagatggaagcactaatcctaagaacacaatccgtcataacgaattttacctcttgttgaagatcgaaattgatgcagctcaacccgaaagcaagaactcgtcgaaacaaaactaaagcaaaagggtggcgatgcgccaaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatctatgcgtggcaatcatcttgaagtacattaacttgaacccgatatcgcgtacaagtcatattgtcgggatcggctacatcggcttacctagcccgactcagacccagccgatcttatcgtagccgatctggactccagccgattcctgctctgttttcaaactcgatctccgcttccgactttgcttcgatctaatcttctttcccaacgctgatgttaccaagtccgcaatatttggtaatgtttcggatttgctgtaaatcgactccgagcaagtttcgcactttaccgttttctgaccgttactgccgtgctttaaatactaaccgtcaccctcgagaaacctcacaccgtgacttctgttttctctttcttctccggcgactcctccggcgcaaaggcgatttctaggcgacttcctcctcgacgagatctccgcccgcaacaa

SEQ ID NO: 19564 - DNA, 324 bp, Oryza sativa
gccttcattccaactccgatttgagaaattttggacttgttgggagcttatgtcgtcacctttcaaatgcatctggtctcatatcaaatttcatcccgagtcaatggaaaacgtccaaacaagatagtattgttactgaaactgtatttgggccttgagccttgtaatagattaggcctatttcggaagtgtctccctccatctctacgaaccaacacttaaccctagatctattttcctctataagtgtctatgtacaccctctagaacaattgatttttatttagttgaattttgccaagcgccattcaccttttctctagg

SEQ ID NO: 19565 - DNA, 629 bp, Oryza sativa
caatattaaagggaagagttggaaagtggatattttccttgactgagtttgatcttcggtatgaatcaccgaaagcgattagggacaagctatagccgattttaatgtagagcatcgtgatgattcaatcggctcggttgagatagtgccatggactttattctttgacggatcggtatgtactcatggttgtggcatcggcttagttataatttcccctaggagggcatgtttcgagtttgcttatactattaaaccatatgcgaccaataatcaagctgagtatgaagcagtgctcaaggggttgcaattactcaaggaagttgaagccgataccattgaaatcatgggcgattctttgctagtaatcagccaattggcaggagaatatgaatgcaagaacgatacattgatggtttataacgagaagtgcctggaactaatgaaagagtttcggctggttactttaaagcatgtatctcgagaacaaaatcttgaagctaatgatttagctcaaggggcatcggggtataagccaatgatcaaagatgttaaagttgaaattgcagcgatgtcagccgatgattggaggtacgatgtgcatcagtatttgagtaatccatctcaat

SEQ ID NO: 19566 - DNA, 1501 bp, Oryza sativa
cactgatgtaaatcacacgcaagacccacacacacaaccaaacttaaaacaagcaaactaacacaacgatctaagtcaacggtttgacaaggcattctaggtcttccgagcatcggagttgattgaaggctcgttcggctcgtcttcatcatcttgagtggctccccactcgatcttggaatgggtgcgcttggattcttctccttcatcatcacttacgttgacgaccggaggatccgctagggctggggtaacttctttctccaccacacggacctttggcgccaattggtagcgagggacaaatagagctctcttccttgcggtaaaacgaaccctggccttctgcggtggtgcttctcccttcaacatggctagttccttctccaaacgatccaccttgtcctctagcttgcaaatcttaccacgattccggtcttcacgatcttgagctgctaacacagtctctgcacgggtttcatcatagcccacagcatctcaaccaaatgccttgtggtagcatcattctcaattccttcagtctcaaggtagctgccacggtcacttccctgtggttgacgaggatggtagtgatactcagtgtcggccaaccgatcactgtagcgattgcggagctctcctatggcgatccttgccacctcctgacatgcatggatgtagtttcttcctccagcttcgaacatcactgaggggatatcttcactattactgttcaaggtgactttgactcggcacttctcttcgtgacgatcatgaggaatctgggcataaaaaagggcagtcccaaatcctatggcaaaggacatcgtacgcaactcctggacaaatccctcaacaccaaacaagtactcaggcttgtagcgcggcatctaaagacaagtgaaaggagggagttaagacatctatctaattaatagcacaagtttttaatttgaataaagttagaaaatcaaagtaaaaggtaagtaaataaagtaaaccaagcttgcaagataagttgaaacagttggaaacgaggtcacaaattttgtacttttgaacaaccggtttcaaaagaaataaacgaaaacatgctaaatttatttaattacagcaagattaaataaaacaatattgtaaaacttttgctagtaaataagccattagtacagtaatagatgtacggtactaataacactggaataaattttgaatgagaaccattaaaagagattatgaagtgcatgtgctattagtttggtttaattagaagagaaggggaggagaacacttctacttttccaatatttttagagggcttctatgggtaaccatttggcataacctagggtcaacctggctctgataccaacttgtcacgcccggaatttctatccaaaattccaaacgcttacatgtgtgtgaaccctcgtctaggaatcagccgaggcacacaataacaaattgataatagagtacaattattactctaattaataag

SEQ ID NO: 19567 - DNA, 838 bp, Oryza sativa
gtcgcgaggctacacggggctagagcgctaccgacggcgagagacgaaagcaaaggtggcgacgggtagcggagacaccgggggtccttttataggggttggagggcggcggtgaaggcccacggtgaccggcgacgcgaaggataggttaggattcggaggaaagaggccgatccgaatcgaactcgaatccacgaatttccaaagcgatttagacgatgtttccaaaagggaaaaggtagaggagatctcgggaaacatttcccctcaattgatttcaccggagaaggaaaggggcggccgaatttggaaggaaacggcggcacggctcggctagggttcgggcggcggcggcggcggcgcgaggttgacgacgaccctgacaggtggggcccacctgtcagcgggagagagagagagaagagcggcggctcggttgcggactgggccggcttgggccgagaaagagagagagaaggttttgggccgactttcggcccaaagccaaaagagacttttttaaaaacctttttcaatttaaattattcatgaaatgcaattttatttattaaaaatacttccttagctcaaataaatcccagaaaaatctaggaattatagaattaagcaaagtatttaatgaaattttatctggccccattttatattggaatttattaattaaaaattagatcttctcttctagacttttaaaataaattctaataattccaattaaacaacaatttatatatttaggacttttagggtgtgacaaacctagcccccttaaacagaatctcgtcctcgagattcggaagaactggcgaacagatgc

SEQ ID NO: 19568 - DNA, 677 bp, Oryza sativa
acgatacgattacgaaacgttaacgaacgcgaacgaacataatgaaacgttaacgaacgcgaacgaacgtgcacgaaacgttaacgaacgcgaacgaacatgcacgaaacgttaacgaacgcggacgaacgcgaacgaacgtgaacgatacgattacgaaacacgaacgaacttgcacgaaatgcttacgaacgtgaatgcacttgtactaaaagtgttagaacaaacgcgtttctacttatacgatttactggtaatacatatatgattatatatgtaatttggcccgtttagactaatacattttcctggtaatgttgcaaagaagacgtcggcgtcgtccctcaagccgaagtggtagctagccatcgaaggaattcgcgcaggcaagtgatgtaaataagtgattgttagagatttaatataagattgttagtcttcatatatataaatgattattacaattttaatatgagattagtagccatttaatataagattattagacttagcatatatatatatgactattacaattctaatataagattattagagattaaatataagattgttagagattcaatataagattgttagacttagcatatataaatgattattacaattttaatatgagattagtagccatttaatataagattattagacttagc

SEQ ID NO: 19569 - DNA, 966 bp, Oryza sativa
ttatatatgctaagtctcacactcttatattgaatctctgacagtctgatatttactctctaatactctcatattagaattgtgatagtcatatatatatatatgcagagtctaatactcttatataaaatggctgctactctcatataaaaattgtgatagtcatttatatatgctaagtctcacactcgtatattaaatctctcacactctcatatttaatctctcatactctcatattagaattgtaatagtcacatatatatatgctgagtctaataatcttatattaaatggctacaaatgtcatattaaaattgtaataatcatttatatatgctaagtctaacactcttatattaaatctctaacactcttatatttaatccctaatactcttatataagaattgtgatagtcatatatatatatatatatatatatatatatatatatatatatatatatatatatatatatatatatatatatatatgctaagtctaataatcttatattaaatggctactaatctcatattaaaattgtaataatcatttatatatgctaagtctaacaatcttatattgaatctctaacaatcttatatttaatctctaataatcttatattagaattgtaatagtcatatatatatatgctaagtctaataatcttatattaaatggctactaatctcatattaaaattgtaataatcatttatatatatgaagactaacaatcttatattaaatctctaacaatcacttatttacatcacttgcctgcgcgaattccttcgatggctagctaccacttcggcttgagggacgacgccgacgtcttctttgcaacattaccaggaaaatgtattagtctaaacgggccaaattacatatataatcatatatgtattaccagtaaatcgtataagtagaaacgcgtttgttctaacacttttagt

SEQ ID NO: 19570 - DNA, 1501 bp, Oryza sativa
agagccaggttgaccctaggttatgccaaatggttacccatagaagccctctaaaaatattggaaaagtagaagtgttctcctccccttctcttctaattaaaccaaactaatagcacatgcacttcataatctcttttaatggttctcattcaaaatttattccagtgttattagtaccgtacatctattactgtactaatggcttatttactagcaaaagttttacaatattgttttatttaatcttgctgtaattaaataaatttagcatgttttcgtttatttcttttgaaaccggttgttcaaaagtacaaaatttgtgacctcgtttccaactgtttcaacttatcttgcaagcttggtttactttatttacttaccttttactttgattttctaactttattcaaattaaaaacttgtgctattaattagatagatgtcttaactccctcctttcacttgtctttagatgccgcgctacaagcctgagtacttgtttggtgttgagggatttgtccaggagttgcgtacgatgtcctttgccataggatttgggactgcccttttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcaatcgctacagtgatcggttggccgacactgagtatcactaccatcctcgtcaaccacagggaagtgaccgtggcagctaccttgagactgaaggaattgagaatgatgctaccacaaggcatttggttgagatgctgtgggctatgatgaaacccgtgcagagactgtgttagcagctcaagatcgtgaagaccggaatcgtggtaagatttgcaagctagaggacaaggtggatcgtttggagaaggaactagccatgttgaagggagaagcaccaccgcagaaggccagggttcgttttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatgaagacgagccgaacgagccttcaatcaactccgatgctcggaagacctagaatgccttgtcaaaccgttgacttagatcgttgtgttagtttgcttgttttaagtttggttgtgtgtgtgggtcttgcgtgtgatttacatcagtggtgggatgtaagtgcatgcgtttgtttgctttcgagtgttaggtagttggtgagtttagtggtgtgagagtcttcagttttgtaataatgaaactcacttaagatcaataaaagtcaaattaatttgctgtcctaag

SEQ ID NO: 19571 - DNA, 181 bp, Oryza sativa
ataagtgttttaatccgaattaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttaga

SEQ ID NO: 19572 - DNA, 1501 bp, Oryza sativa
tcgtgttaacgagctgttgatgcgaaaaatacacactggcctgggagatctgcttagctccagtgcaggtccaaatcttggtgaggtgcgggcgtgccagtcagtttgatcctacaactgacaagaccagtgagctgatcgagccgatcgactgacaagccgatgaagtagtccagccgatatcgatagggttttgagctatcggctatacatccaatgtagattctgacatgatgtaaataacaatatagaggcaatcgctcggctgatactgatgtaataaaatagcaatataatcaagtagaaaccaatcggctaacaatgatatgatagaacaagtattgatctgaaggttaaagaatacatcggctggaggtccgatgtcataaaatccacatattagattaaacggtgaaatctttgttaccatcggctaaatccaacttatatgcaatccttgtaagccaatgcaacgtctagatacctcattagctgaaaccccgatgaaacccttattggctgtcagaaagcaggctagggattatggtctaaacacaacttagtagatcaaacttaattgatgcggcactaagtataaaaagaaacacaatatctagagaatcaagccgttgactgatttttagggtggtagatgccttggctaatctaatctagtaaaacaatttagccgataccggtagaaaccttaaagcgagagacaaccgatagagctaaattgagatactaagactaaattaactaagacatatgataaataggcagacacatatatcatccaaatcggagcaatccaagaggtcgaatgtactgatgtagccctgaacgatgccgacgtagatgagacaattgcttggaccaacggaacattggacttaccccttcgccggagatcgaacgccgatgcagccccgcgtcaggtgctaagtcccgccggatgataaataaaaaggtagaaaaggtaaaaggtggcgatgcgccgaattgtattgatcgtggatatattttacaatgaccacggatatacatatttatacccatgtggagatactagtcctcgtaggataagaaataaactttcctaaaagataaaaatgagaacataaagtccttataggacactaaacacactttcctaaagataaaacgaaactaacaaatactgcctaattaatagataaactgccatgccgcatcctccttgaactcgatcacttgtagataagattccttttaacatattaatttccttaaccgaatatagcaggaatccggctattggcgacgtgataattctcttaggggcttactaaatttcactgttaacatgagcgcgttggttacggaattaaacagatccgaacgttactctcgctcatatacaaactccgcagagggatggcagttcatcagttcttcccgcagactcttgcacttcaggttcctcctactcctttgttcttgtgctgctactgcttctccg

SEQ ID NO: 19573 - DNA, 1501 bp, Oryza sativa
acgcccggaatttctatccaaaattccaaacgcttacatgtgtgtgaaccctcgtccaggaatcagccgaggcacacaataacaaattgataatagagtacaattattactctaattattaagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaggataccaaaggatggcataatagggtttcatttgcataaatagcatttaataaacatttcagaatttaataaaacagttaagtaataattaaacaatattaatccaacgctatacaacataccctgttgtataggcccaaccattctgaacaaccatacccggctgtacagatctatctccaaaccaggaatataccattccaaaccaggagctaaacaaattattaccagttatagcatcttttatcattatgagaggtgtgagactaatcacgaaagacattgttagacccgcccataaccgcgggcacggctattcgaatagttttactctggctagaggtgtaccactgtacccacaagacacagcctcacaacatgtcaccatgtgcctcaataccaccacgatacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaaccaagctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattgtcgcgaccgagaaaattgcattttcccgaacgctagtgtattaatccccgtcccaggaaaagccgaggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaaggggtacaaggggtaatgatataggggttaagttttgcagaaaacagcatttaaaagt

SEQ ID NO: 19574 - DNA, 234 bp, Oryza sativa
gagttgttacgtgtgcgcaggaggtggagagcgctgttcaggctctggaagcactgggaggtttgcccgatccggtgggtgcacggtgccttttcttttcatttgtattgtctgaattatactagtatttaactaggtaattgttgggtggctagagaatatagcagtagttaatattgaattaacgattttataaggcgaagattttaggtgaggtgcatgcatctcaatagt

SEQ ID NO: 19575 - DNA, 1501 bp, Oryza sativa
actctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacatggctagtgtcctgctgctaggggctcaatcctgcctacctgtcctggaggttccggccgtaggtgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaagttcgtgcgggttaacgaccttgattaataatactgtgtagctctaggatcgtctttttaaaatggctttgggcaactaagtgacttttaaatgctgttttctgcaaaacttaacccctatatcattaccccttgtaccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtacctcggcttttcctgggacggggattaatacactagcgttcgggaaaatgcaattttctcggtcgcgacaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcttggttcattgcggagcaccagactgagaagtggcggagataagcccacgggggtcgctggggagtccatgccttgtttata

SEQ ID NO: 19576 - DNA, 1501 bp, Oryza sativa
tcaaactcctccttctgctcaggtgtgaatttctctggatcgatcggcatgacgttgtcatcaatgatgtcagtcaatcccagcttcaacgccttgcctttaacggagcctgggctagatggtggtggtggctgtttctcggccatgaggaagaactgacgtctgacttcttagaggtcccaccaggcgtgccaaaagcgtgttgacagaaaacacgtggcctgggagatctgcttaactctagtgcaggtccaaagctcgccttcggatatgttagcgtgccagttgatttgatcctgtaatcaacaagaaatagaagcaaagaaaccgtggttaaatctataaatgatagctgatcagctagatgccgatgacatatcatttatctttgagccgatgtcatctgtgtatcgatcggccgccatgaataagtaaagaagaactaaatctattcgatcggctgtagatattaacgatatatactccttatatcgatgtatacttaaatcaagtgattgggatagatcggtcatcatgccgagacagtatgaatcacttagaccgaaatatatatcaataacaggactatatatgtttatagcatagccgatcagatagatctagcatgtatcggctaatactccgatactactctatatcaggatattaaagcaagaataatatatcaaacaaaggtctaacatacttagatgcagtagtattttgatataaagggcagatttaacatgtcaatagagcatatagaacaaatatagttaaatcagatacgatcggctgaaactccgatgctattctaatcggcaactagaaggcaggctagagattgatattctaagcacgacttaatagatcaaactcaattgatgcagcattaagtatgaaaagaagaacaatatctagacaatcaaactgctagaagtctcatagaatggtagatatctcatataatctagatcaacatcaagatctaacctaatcggctgccttctgcatacaaatgttagccgataataggttaggtggcgatattgctaaagattatgtaagatatatgataactcgacgaattatataaacaagattagagtatcataaagatggaagcactaatcctaaaaacacaatcttgttgaagatcgaaagcgatgcagctcaacccgaaagcaagaactcgtcgaaacaaaactaaagcaaaagggtggtgatgcgccgaaattgtattgaacgtgtgttgttaattacatagggctcggggtctatttatacccgagaattacaagatatgcccataccggacacgactattatctctaacaaactctaagataccataagtctttgcggcagacttttgcccacatttatctataaggaatttacataagatatcctaattaatagatacaattgccttcccaggactctatccgtgcgcggcaatcatcttgaagtacattaacttgaacccgatatcgcgtac

SEQ ID NO: 19577 - DNA, 231 bp, Oryza sativa
cgatatgtcaaaaaatcaatatcatcacctattaaaaataaagatagaacttgttcatgacgtgttaaaaatcgtagttttcctttatttatcttcttgttcttaaaatgatatatgagtgcaggacccacatgtgcattaagtcaagcaataaaccatttgagtgtaaccaacacaacttaagaattttctaacaattgacaagcacaccgataatgatcctattataga

SEQ ID NO: 19578 - DNA, 1501 bp, Oryza sativa
ttccgagaaaaaaatatttccgtactcatgtccgatcatatttgatcctaattcgtattcgagataattcgtatttgtttcggtatctgagctattcatatttgttttccatctggcaaaaaaaaaaagaaaatgaaaatgaaaacaaacatggtatgagcattatccgtccgcatccactccgttttcatccttagtggtgagggtagttgatatctgggttctttggccccatatgtcttttattcaccattactattcctttttaaatgagtatagacatttctaaacaatgcaaatgtgcaggttaacaactagctatagacattccttggcaatatattaataatgaacacgcttttaaaacatttacttttagaattcggtataaattggagtagagaatagaggagaaaattgccccaaatattttgcgcttgtatagtatttttgttctggcttgttcttttgttttctgcttaaaggggcatgcgcttgagatcttaaggtgtgaaccaacatgttccacatcaaatagatttattttaaaaatgaacaactctgagattttcatttactaccattgatctgacatactattccctcaagttcttcatttcttatcattttggacatgatacccatattaattagggtgtatattatttattctacccatattaaataccttgaagtggtatatttagagatctgagagtgttatgtttaattggcttaggctttatttgttcgagatttttggtaggaactaaacaacagcacacaaaatatgaaatgccattatgatatgattaattaagtattaactatgataagtttttaaaatagatttatttgtttttttaaaaagttgtgtataaaaagtttttaaaaaacatatcgtttagcaattagaaaaatatgctcatcgaatatgagggaataactaagcccaaaaaactcagaagagcattactattggaatgaaaggcccagttccgatttaatgagaattttacaacttcgctgctaataggtttttttttttcactgcatggcgcatagttggaaataataacaccattaactacaaagggcaatctcgacctataccggccaccactaaaactcttcaacgacagtcgacgagaattctcatccaccgcaacaaagaaagcttattcaaccactaaattaagctgctattttttttttgtcttgtgtttatacttttcttttattcttaagtccaaagtcaaagtcataatcacttacagagcgtgcagaaaaaaaaagaggaaaataaggtggcctatcatgacttttgttgggaaaaattgacaggtgaaagagctgtgataaagaagcaagccgctgcagattgaattgctgggtaggatatttctaggctggggccataagacagttctgcaatcttcagctcgtgctgggtgctcttgcatctcggatttgctatcagcaaccaacaccatgtcctcca

SEQ ID NO: 19579 - DNA, 222 bp, Oryza sativa
agctcggtaccctttggaattggtggtgcaataagttaccggaacttacaaatgtttggacagatcactaaataggtatcttgatcaatgattggatattattgccaattttgatgattttgctattagacatattgctaggcatgataattctcaagtaaatgatttagcacaacaagcatctggctataatgtgaagaggggagtatttttgatattaga

SEQ ID NO: 19580 - DNA, 1501 bp, Oryza sativa
atttataaatgaagtaaattatttgagttctttaattattttgcattcactccactacattaactgaaccaaatatatcatgaaagattaaattttagaaacctttcctatggagacgaaatgataaccacgaacttcataagtggcataattatacttacttaaaaacattgaggagaatttcctttttgttaatctaaaattgtatcatctgttttaacactgtaacaaggaaatttgtaatattaaggaagaaagaatgatcaactgttgttgccattgctttttttttttgagggaaagcattctaggggaagcccccaaagtaaataaattatattaaaaaggtaaaacaaattatattacaaacaccttaagcaggaggaaagagcttatcgttcttaagcgagaaaaagaagaagggttaagtcattcttgaagaatgccattgcttttgtaatgcttcacatctaaagtcactactctagttaatatatattcatatattgttatattgtattcctacataaccacaaaatagatcatgttggttgcttatcatgcattcatgcatatgtagttataagaagaagggttaagtcataaaaagaagatggtgatgaggtggcacgtgacttgtcaaagggctgcctacactaggggccaagagtggtacaaaagtggaacatgtgtaacttgttttgctagggtttttgattgctttttacttgttttccttttagaaagttagttttgataatttgtcatgcacggagttaatgtgtgtttttttagttttcctaggagagagggggttacagatttatggtgggtgtgggaagaacggatggacgaaacttcctcttcttaaatggctgagaacaaattaaaagcaatgtgattatgcatattgtgttccactttcaccattgtatgataatgttttggtaggatgttagacataatcaggggcagagatacagtgtattcatcgtggtcatatgacctcgatgacctctagagaaatctattgataaattgctaagccaatgaagataaaactatgtattaagtgagattggcatatgatgacaccaatgataccgatgaactggatctgtccttgcacttaactattaccaatcgtagcaacttagttacagagatcacttcaataaaaaaaatgtaggaagaagactacttacaatctaataaaattaagaacacaaataactaccacgattaatataaatcgtttagagtgactgaatactcaacaatgaaagctgggaaatttaactatttgccactattaggttcggtaattattcaaatgcccctcttaggtttgtatattttttcgccgctttaagagatgccttcttaactatttgccacttttgcccacgtggcatgccaacgtagcaatgcagggtagaaaccaatgtgggacccactagtcagcctctcctctcctcttcctctcttccttcggtctagc

SEQ ID NO: 19581 - DNA, 855 bp, Oryza sativa
agtaaccaatgtttattctttaagtatgtgctggaaaaagtgtaattgatcacccatgacttgcaagaattagggcatataggtaaatgaaccactcatttttaaggccaccttataaccttttaccttaaaaaggttaccaaagttaaaccattaaattcatagaaaaattattgaaaagtttatggtaaaaataaattttgtgcattaaagttccagtagtatttggaaattagtcggttgtaagaattgtatatccatatatataaataattttgaatgattatttgtaaaataatttttattgagtgcgtatagtgcaaaattatatcacatgccatacgccagccaacgcccccactctcttacaaagctacttttcttgtttgctctttctctctctcatttctgaattgctggaatgcttcggtagttcatcgtctttttttccctctataatcaatggctgaactctttagcttctctctattttgtctttttctcgattcaatggttattgtttatctgatgatgtggctcatcctaatagcattttgaaatttacttttcactaggtaagattaaccacatctttgataagttagcttaaaagaatcatgacaagtaaaaggacatgtaatactttagtggttacagtgatctaagtagcacccaaagattttaagtttaaatcttaaatagcgaattttggattgggttggatgtagaggtgtaaaatatatctttcttaaaaaataaaaaaatattaagtaatttaaagtactcaatcaaacagccctttcatcttcccctacccggcccttgtccgtctacccggtttggactccttccagt

SEQ ID NO: 19582 - DNA, 1501 bp, Oryza sativa
tccactcctaaatactccctctatctacttttgatagttatatttctaaatctgaaaattttatttttgataggcatatttcaatccaacaacctatcatcttaatgactttctcggatttaatgcgtgactctttattcttccacacaagatttgctacatgggtatcgagaaatgtaaatattaatgaatcgcttgtttacgagaaataactagtcgcatatttaaatagatgataagtagaattacttatccttggtctgtgtgccaagatgaaatatgacttttaaaaatagatggagggagtatatctccacctatatagactaaaaaggagaaaaagaaagaaagaaaagaaacccatttcgattcccaaaattttcccatggaccatggttcaattcgtggcaacttaaccatgaagataggaaacatggaagggctactattattatactcaccgtggatcgaccataaaatccacggagagcgggagagcgcaggggttgtctcgcgctagcgcactcccatctcctcgtctcacctcatcttctcggcgctaataaaaagggaccctgagacttctccgtctcaggtcaaggcgacccgacgacgtgacgagagaatctctcctctctctctctctcgctctcgcgtgaggaatcctcgtccgtcccggtcccacgctctctcgctcgctcgctgacgtgcgggacccaccggtgctgctccgccagtccgcgtgccatccgcgggagccgcgaccgcgaccgcgaccgcgaccgctggcttccaccccaagccccccctccccaacccgtaaacccctccagcagcagaggcctttgcagttgcttcgccttctccatctctctgcttcttttgtttgtttttctttcccatctactccgctcctccgccgttgcctccccggctcgccgtcaccgggagacgcgaggtgaattccgctcatctccagtcccttctcttattttcttgcgatgatcttgcggtgttgcagaaaatagtttaaaacctgcgcctgttttcatctcatcctcctctcttgtggtttcttgatgagcgcaggcattgcttcttctcccatgcgccgccgcaatctcatctctctgttttttttttctgttttctgtttgcaaggtcctgacctttttcaaaggcgcgaaagattgtgtttttcatcgtcttggggggtgtcttctgtgatgtgctttcaagaaaccctcttctggtttcttgctccacggcggcggtttgagtctccgtctcactgataatccgatttggagcgcgattgcgattttggaggggtgaatgggtgcggccggggctgttgttgagatcagttcggacgacgaggcgattcctgttgctgccaagcgtcccaacgttcctcccgtgtcgtcttcacatcctctacctgaagactgcaacggagttgaggagggtttaggtgatcctgctgccttggtggaattcg

SEQ ID NO: 19583 - DNA, 429 bp, Oryza sativa
gccacggggtggcgtggtattccccgggagaggttgtgtggcacacgttacacgtgtgatgggcatatattaaaatttccgttctggctgtcctactgttctagcagcagtatgggaagcctggttggatgatacaaatttacacacaccaccgtctttagctgtttctttcaactaaatgttgctgttgtttcctttgtgtatgttttggtgaatgtttctgcattttgagtccatttctctatataccacttgccttgcctgctatgactatctgaattttctgtttttgattcatttagcatatacctttctgccttaaatcataggtgcttatcgattttagaatggaacatcaaatattgagtattgaacatcaaatagggctcgctacttgatgtggcaacttcacattgaagactctgtttt

SEQ ID NO: 19584 - DNA, 272 bp, Oryza sativa
ggggatcgttgatgtgaaaggtccttccatagtattcgacataatcaagttacttttaattggttccaaaattttgtaagcatggcttgtcatttgcctctgaagttcttgtgagagtttgctcttctgtaactgttaagttagatatgtgttctgcttctgataatatatttcaatcacatgatgtacattaatttggcaaacaagttctgattgtttatcaaactagaattgcaacttgcttcttttcttactttaaaatctgttgcagc

SEQ ID NO: 19585 - DNA, 190 bp, Oryza sativa
ctccagacatttccgtcgcgactttacacgaaagaatattcccaaatacagaaaatgtgtcatagagagctttgttatctattgacttgtcaagattctgttaacaacataaactgatgtcaaaagagatattctttgttggctatctatgaaatgaatacataatatgaatgtgctaccttaataaata

SEQ ID NO: 19586 - DNA, 509 bp, Oryza sativa
tggatcgattggtggcaatgggcatgcatgcacggggctcaagtagatgcagacacacgggagcttccaagagatgtgcacatgcatgtcgcatatatgcagggttcttcagctagctgtacatcagtggctgcaagctgctatagctgctgctgcacttgcatactactacagctgctacacctaagcactagcagagcgaggcatatgcggcgagtcagtctgctgcatactacaactctgatttctgatcgatctacctatatgtccttcttatattcagctcgaattattagtgtactgtacttcatatctttcataattgacgaactcgatcgatcgatcgagatcgaccgatccatcgtccatcgttcatctctgcaatagtctctgcaaagccgcatgcatgacctagctagctagcaggttaattagctaggtttggtacatttgtgctatgcatggtcctcctcctcctccatctgacagtgtacgtgaatgttgccaga

SEQ ID NO: 19587 - DNA, 164 bp, Oryza sativa
acattgctgagcccttagcctgccagtcaacttcagcctgagatgtgcccgtcaaaccactcgaaggcagcgaccagatgtgttacacattcaggagacttgacaaaaatggctaaagatctacaacctctcaaatattcctaactcatactcatgtgaatcta

SEQ ID NO: 19588 - DNA, 1501 bp, Oryza sativa
tacacttcaattcctgtcagaatcatgtgtttttcatattcctccgttttttctaccctgcgattcaaaggaccctaattcagtttctcttctactaaaaaaatctgcacctgttctggatccttcttccaatcttcagactgaacagttcactgtttatttttgtaatcatattccttgaataaaacattattattatgtgccacgtataatactaattgatgctacttattggtgtaaaaatgatctctccgatgctgacgacaatggtttgatttaaagttgaattaattgcacaaactacacatgcaaaagcagcgttgcatactggagttatttctgaaccttttgtttattcacttccattaatatactttttcgaataagaacttccaattaatatacttgatagtaccaacttggccatactgctttcatcataaaaggaaaattatatgcatattttccttttggaatgtcagtaagatgctcccaagttccgatggagcaaaaatgtttatcaccaagttgccttttagaattattctcaagcacaaagtaggttttaaaactcattagatttgtgcaaagccagctctagtggccatttgggcaaagaggagctgagctgaaggattcttatttatctcccacaaacaaaaagtaaccgaggaataattatgggtagtagctgctgttgtcattgttcaagatcctctgaatctaaatcaaggtagcaacttgggcaacacatcatattcacgactaatttactctaaaattgtgagggattatgcatgtatcatctcaaccagttgagataaaaaaaatgctacttatatatgttaagaaaagcaaaaaaaaaaaaagcattttacctcgggagccaccattctgaatatgtaactatatttttcaggtgttgatgtaccattgtgagatccgacaagatcgacaagttaatttggcagacagctgtgatcttggctctctacatctaatgcatcttggtagggctattactttcacaaaataatcaggttgcttgtcctatctaattctggtagctgaattaagtccctacacattgcaaattgcagtactttctttaacatatcttgtaaataaattaaaacaaactaattggttgtcccatctggaaaggacatcttgtctttttttaaagagaaagttgatctcctaaccaataactgaatgtcccacctaagaagacgccagacagctctgaacattatgttgcaacttcagtttgatcaacagtgaatgctgatcatcagaaaggatgtacagatgtactgtttattgccagtttgttaggaaacatttccataaatgtctctggtaaaaagctttggaaactgtaagctttagaatccagatcatctaaacatatactccatatagattttccacaagggtatgaaaggagcacatcagaattactgtcaatttttcatgaacttttctttcttcaagatgc

SEQ ID NO: 19589 - DNA, 813 bp, Oryza sativa
  unsure (1)..(813): unsure at all n locations
caacctcgcaggttcagaaatggctattctacatgcttgctgtaacagttactgatcgatcgacgtgatgggcgacctgtgaatctgtgatgcctttgctacggaggagaggggatgggcagctcagttccataaatgcaacggcgacgaggacgacacggtcaatcatgcgccattggacacaagtggaaacactcgctgcaactttctagtccaggcaccacttaatgcccacatactatcacttccagcactttgtatgtgacttgtcattgcacaaactacaggggtgagtgacaagagacctgtttccatctaggagtacctccttttcttttattaccagcagcaacgatacttttttttttctcttctctttcgtgtaggtttactccaatactcaatgggcattcatatgcttccattgactaaggtaggagtgcatacatatgtgatccaaaagaatacatattgttggaaattttgggctatatattttggtcaacgatgcttacatgcacaaaggtttctagcttgcattccttgattcatgccaagtatcatagcaattactacatcaagtaaaaaattctccagaaaagaaaaattccaatacatatagagaactttttacaatccttgaggggagacatagaccaaatcgtggccgtctattgagcatcatcaaatggctgagaatcatttcgtatctagtagcgtcggtgcctatcccaccgggtaccaagcctntcgacaccctataaaggttatgattaattttcttttcgcaccacccactccatgttcctccaa

SEQ ID NO: 19590 - DNA, 1501 bp, Oryza sativa
  unsure (1)..(1501): unsure at all n locations
tcaattttcgcaggcacggctccactcgcctgcaactacgtgtattaaaaatgaagatttccacatgcgggcaccacgccctcatgcaaaaattgtttttagcaggcaggcatgttaagccgccaacctgcactagaattttgtcaaaaaataaaataaaattctgaaaaattgtgaaaccctagcccgcatgcctgccaccgccgcaccgcatccccaaaactgtaacccgcatcctgaggtcgtcggtggtggaggaggacccgaggcgcgacaaggcggagcacaggcacccgtcgatcgacacgctcatcaccatcggccgctcccgagaccagtcccgccggatctgccctcgcacagcttgccacggtcttcgtcgtcgccctagccattggtgccattggcatcatcgttgtcgtcgtcgctgaggcccgcagagggggatccgctagtctcgagtctagcgccgccagatctgccctcacgcagcttgctgccattgtcgtcgccaccctagccaccgttgtcattgttgtcatcatcgccgaggtctgtggagttggatccgccgctctcgaggccagcaccactagatccacccctcttggggccggggccagggatccgccaccgtgcggcttgccgccaacgttgtcatcacctcattagctagtgctagatccacctgtcgcagggcagctcccgtcgccatggctgcggtggaggtaggggaggaggggacgggggagaagggggtgaggagtggagtggggagagatattttaagagatgagaaaataaaagagaggaagcggatggggcagccggctgggtgccaggcagacctcttaatatgttcgcctgtgaaaataaacctattttcacaggtgggtctattaagaggtccgttggccttatcttcctcctggggcaaaattatcataggcagacaatgttataacccacctgcaagttagagggggttcgcccaaaaaaatcatttatgtaatagagcctggagatccgacatcatttcaggttagctgcaccaagcagatattggtttttgtcccacattgaaaaattatgatgaaagagcacgatttaaaatgttagggctatcatcactcatcagactatattttatgttgtgtagatccatcacctaaagttatggctctagttgagtctaaggtggagcaagcctaaggttggtgggtaggactgtgcgctctaattacatgtattaaagcataggtttgcactctaataagccctgggattttcacattttgggtcttttgaaaaactatttcgcanatagacccctagaaaaacttattccagaaatggtcctttttggggcgttagagtggctggcgccgtncttcaacggggacgtgccaggcgccgacctcctgccactgtggcacactcgaaccgacgtggtaggaggagggcgcctgtatggctggcgccgccccagggaggagggcgc

SEQ ID NO: 19591 - DNA, 1501 bp, Oryza sativa
  unsure (1)..(1501): unsure at all n locations
tttgagtttattttttctatggttggtttctatgttctcctaagtatgaaaaaaatatcaaaaaaataaaataaaaataaaaaaattgcatctctctgtactgtttaacttataaacttatagctatcatttcatgtggttatattttgaattagattaagtaatttcatatagtggtagagtgcattatgtttaacatgctgatcaaagggttttactaaaggagttatggtctaattttggtgaaggtgcaaattaggctaagtggtatgctagctatattcagacttagctaagtggtagttcgagtttaaattttttttgtggtgggttgtatcgtgatcctaagtgtgaaaaaacattcaaaaaataaaacaaaaatgacaccgttgcaacttcatacagagaaacaggaatanaggcgaggggtgggttgggggatgacgcgccctcctccctggggcggcgccagccatacaggcgccctcctcctaccacgtcggttcgagtgtgccacagtggcaggaggtcggcgcctggcacgtccccgttgaagnacggcgccagccactctaacgccccaaaaaggaccatttctggaataagtttttctaggggtctatntgcgaaatagtttttcaaaagacccaaaatgtgaaaatcccagggcttattagagtgcaaacctatgctttaatacatgtaattagagcgcacagtcctacccaccaaccttaggcttgctccaccttagactcaactagagccataactttaggtgatggatctacacaacataaaatatagtctgatgagtgatgatagccctaacattttaaatcgtgctctttcatcataatttttcaatgtgggacaaaaaccaatatctgcttggtgcagctaacctgaaatgatgtcggatctccaggctctattacataaatgatttttttgggcgaaccccctctaacttgcaggtgggttataacattgtctgcctatgataattttgccccaggaggaagataaggccaacggacctcttaatagacccacctgtgaaaataggtttattttcacaggcgaacatattaagaggtctgcctggcacccagccggctgccccatccgcttcctctcttttattttctcatctcttaaaatatctctccccactccactcctcacccccttctcccccgtcccctcctcccctacctccaccgcagccatggcgacgggagctgccctgcgacaggtggatctagcactagctaatgaggtgatgacaacgttggcggcaagccgcacggtggcggatccctggccccggccccaagaggggtggatctagtggtgctggcctcgagagcggcggatccaactccacagacctcggcgatgatgacaacaatgacaacggtggctagggtggcgacgacaatggcagcaagctgcgtgagggcagatctggcggcgctagactcgagactagcggatc

SEQ ID NO: 19592 - DNA, 931 bp, Oryza sativa
gatgtgagacaatgaaatttctccctttcatgtcttcatggaggacaataatggtaacaacagttcttttcacatatccaacaatcatgcacaaaatataacatagttggggagttcatgatgttttcagaaacttggatgtattcggtgtatattaatattttggatgtgagacaacgaaatttctccctttcatgtcttcatggaggacaataatggtaccttaatctatggcatcatggttccaaattgtgttcaagttgggtaagttttttttttttttgtggcaactacccttcagaattgtggaacataatactaaggtcaaaattaaaaatcggtgcatgaggtgtgggttaaggagattataaaatcaagatgagggtctttgctagatataagttcacatagaaaaccaggattagcttaattttctacttggactgaacttgtagtagaaccaaatttcagaaggagcctgtcctgagcacaacactgtgctttaaatctaatgcaagagatttatataagctgtgggacaacgatttgtattccaggatggaggttcaatattttccttctaaatagaagcagagagttggcatcttgtgcagaatgtttcctcatttgttctccttttgacaagtaaaatgcatcaatgataatctgtgggtggaaattagcatcacatgcttcattcgtccatcacctaaaaagattctcatataatctgatattggtttctgtaggtgaatgtttagttgtttaaacattgctttattactgccaattaaactcgcccttttttctctttagttgcttccctgtttgtgatcaaatcaacggtttatctatgctttgtactcagctttgttaggtagtatcagattagagagcactgaataattaactattttttatcttctactga

SEQ ID NO: 19593 - DNA, 1501 bp, Oryza sativa
cttatttatgtttcgcaacaggatcttaaattcttaggcatagggtagtgacggtacttctacattcagttcgtcgaagaattggcatagaatttgcaattttcaagatttcggagaggaattgaacttttgctcaagttctttgggagttttggacctggatcctttattttcgcatatataggtggtgttcttttcttccgaagatgaagactaagttttttacacaaaacgaggtggtattaacgtatgattgattaagttttaattattacaaacttgaaaattagattaatatgatattttagagcaactttcatatagaaagttttcgcacgaaacgctgtttagcagtttgaaaaacgtgccacagaaattttaattttcattcaacttttgttagagaaaagaacaacttttgctagagaaaagaacagaaccatatagtctactgtttttttacaccaaccatagagtctcctcttgctagactttgagctgaacgccatccgactactccgcaatccgggggggggggagatggtgacacgtgggctctactgtttgttttgtcgcgtagacaccacgtcgattttgctatatatttgtcgacaaatttttcccctaaaatttgacagatataattacagtacaatcgtagtgtaattacactgtaacttgcatgtaattacactgtaactatagtgtaacttgtatgtaatttttaaaaatctctccgtaacatgttatttcggtaaaatggaggtcgtgggaacaaattctttcatatatgtatgtgctatgatttgttttcttcctcaccaaaacaaatcttgtaatagatctaacgattcaaaattatgtgaaacttacatataagttacgctgtagttacacgcaagttacaatgtaattacactacgattgtgctataattacatttgtcaaatttttgaggaaaaatttatcgacaaatgtataggcagtcccaaaatctctctcaaaacggtgtggggaggtaaattgattcgctgtgctcgattttgccaattagagacgaaaatcaaactcagccaatggttgagggatccgaaataaacttttttccttctgtaggagttgatcgttggaccaaagtgaaagtatcttaggcctttgaactaactcctgggtctcatgggctggctgcgatgcggaatgcatgggccttgggaaatgggtgggccaatgtctcttcggcccggtttgaagcccaccacaccacctcacctcgccgccgccgccatcgccttctcaatccccaattcgcacgcggagctaatcctcttctagggttccgacgaatcccgagctcggaggccgatggcgtcgtcgtcgtcggcggcgtcggggaagtcgcggccggagtgcatcaactcgtcgaacccgttccacgagtgctccgactactgcctccgcaagatcgccgaggccaaggagcgcatcgaggacgagcagcggc

SEQ ID NO: 19594 - DNA, 327 bp, Oryza sativa
agaagtaccaggattggaatggaacggtacagaaccagaaatatttgaagacccttctcctgcgtaagaccccgaggtgcaagagatcacggttctgaggtgcctagagtgcttaggagccacgactccaagtccaaagatgagaacaaggagaagttcatggtaaccgtcttcaaaggggataaggaacgtgccaagctcagagatgatgacccccagaaggccgctgaactagccgggccaacatacttcacaactcatgattgcccggaaaagtacgaacatgggaaagcactcttgcttgaatgggcactgaacgaaggacca

SEQ ID NO: 19595 - DNA, 1501 bp, Oryza sativa
tacaatggcaatatgcatatataaattgatcttttcatactaactctgtgatctttaggttaaagtagagtgacattgggttggggtgaactatataacactatattttggcttagggcaacagtgtaaaactaaagtatagtttgaacctggtgtgagagagaaaaaataatgtataataaaatccacaaatgtatatatattgatatcaagttttataatagacatagattacttttcatacaagtcatctatgataatccaaatgtctcgtggcctaaagaattaagtttctagtgtttgatatttttttaaaaaaaaatcatatgactcatatgaactaatcacacccacatcacaattaatttctaataattatacgtctgaccttattctgaagattaaccatcagcttgactcaattttctttaactttgctcatctcttttttaaaatgaagctgacattttgccctattctaattacaacgtgggggaatacaattagaaaataatttagagaatgaagaaaaatgaaatatcccttgacataaaatacaactcatccttcaaaatatcgtcaaacatacaattttcctttaattttttttacctattctcatcatcgtcaaaatagcttctagagttttaatcgctaacacgacctccactaattaacaaaaggaaatagtaatacccaagcgaaaaggaaacagaaatacccagcatgaaaaaaatcagttgctattcgaatataataagtactcaatgccttttgttcgattacagataactaaaccccgttgaattcaatgttgtgcaaattcgtttcaatcgtactttacaaggagaagaaggtacaatgttctgaacgtgtgaaagaacaatgtcccacgctgcaaaccgcagcaccacaagccaagggccacgattccagatcaaacgccacaaactaaaaaataaaaaaaaaatcggaagaatagagagagagagagagaaaaagaacgatgagagcctccccgagcgcgcccacctcccacggctccggctaaaaccctagagcgcgcgcgcgcgagcgcggatgcccctcgctctcctcgcccgcgccgctctctcctccacctcctcctccatcgccatggccaccacgcgctcctcctcctccagggtgcttcgtgcctcccgtgcggagctcaacccaggtgaaacgctcgtttctttcttcttctcctctagtagtaccttttcttggggagggcggggaggaggaggaagctcttgtagcctgtttccattcattgttgccattaggggtattctagattgacaggtcagattagtatccgaatatatttgggcatttaggtattccttttctggataaaaatgtgaaaaagttgaggtatttctaccttggtgaggttatttcttgaaatgtggcagatagatgcttcttccagtctttattgaagggttgctactgatgggaggggtggattgtc

SEQ ID NO: 19596 - DNA, 1501 bp, Oryza sativa
ccccaactgcagcactaacaggttgatgatcttcagaggtgtcactgatcattcggataacctaagaggcaaatatatgaattgatgatatgtgtcaacttggattgaatttataaggagaacctccttttctgtctaaattcacctcactgcggatgttgctgggatcagcctgaaagttcttcagcacaacaagcgcggcaccatgctcacggagcaacccaagtaggaggtgttcagatccaacatagttatgccctgaacaatgtaagtaggttcagtgctagagaaatgaaaaaaaaaatggaatactttccttttttttttccttcaacaggagtagtaaagatatactagcagtaaaaagaactaaaaagtcaccatgtttaatgtcagttcccattaaaaagtacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcccggccatcttctccacctcggcgcgcgccgccttgaggctgagcccggcgcccctgagcaccttggcgccgatgccggtgccctccccgatgacgccgaggaggagctgctcgctgccggcggcgtggtgccccagccgccgcgcctcctcctgcgccatcatgatcgccttgatcgccttgtccgtgaacatgtcgaaccccatcctcgccaccacccgcgcccccctcctcctcccgccgccgccgctcgcacgcccgtacgacgccgccgcgggtgaacggaggccgagtaatattggcggcgcgatcgggggagcgtggagctctcgccggcccgcggccgatgccttgacgaggcgggcgtgccgcatcggcggaggcgttgggatcatagtagccatggaggaggagggcctgatcctggtggcggtggtggtacggcatgccggcgatcggagagacggcggcgggttcagtagggttctctccatggtcgccgaggagaagcttctactctacgcctcgatcaatctggacaagcattcaatccatgaaagatcattaggttaaacggatgcgatta

SEQ ID NO: 19597 - DNA, 198 bp, Oryza sativa
tgtgattagagccatagtttctagtcggattcgtggctatgggcaaccccgttatgggtataaatagaagaggggttgaggctagaagatattgactctttggagagaaaagttaaagtttgctcaaggttccaaccctaatttaaatgcactttgtaaaacacatattgatacaataaattttatctactttcaaga

SEQ ID NO: 19598 - DNA, 1501 bp, Oryza sativa
cgtttctttctttccacagctaattaagctagttagatactccctccgtttcaagttataaactttgataaaagtaaaactattttaagtttgattaaatttatagagaagagtagtaatatatttttaacccaagacaaatttagggcatgttcactttgacgtcaaaaaaaaccttaccaaattttagcaacttgccaaattttggtaggatttcttatatagttaccaaaatttggcaacaaactaaatgtagccacttttttgacaactttatcaaaatttagtaaggttgaaaatgacatcaaagtgaacaggcccttaatataaaaatatattcaattattgatttgattaaattaatttagtattataaatactattatatttatttataaacttagtcaaacataaaacagtctaactttgaccaaagtaaaaatatattataacctaaaacggaggtaatagaactcatgcgacgagtaagttataggcattacgctgccaaataaatatttcaaactaaatttaaaatttattgatagttaaagttttacccatttgattttagtcattttttaaaaagtcaataaattatggaaatataatatattattgtactctctctaaagttgaaagtatttaacccatcttgtcgaccgacctgtgtgtttggaaaaatcttaaaaaaaaggtcgatcggaatcggaatggactccggattgggcttagctggatcatcacagaaaaaagcccaccttgttgctccaggcgaacgtggtagagattgtgcagtttttacggccggcgagcagttgaaacttgaaagttgcagggcctcgctcgtactttcctctattctaaaataagctcatttctcagcttacctacacatatcaataaaaaagtaaaaaagataaaaatatcattactgtatttaatcttaatgtaatgattcctttctttatctactttctctgcatttattcagtacttatacaaattctaatataatgattactaaaataaaattatttaggacaaacggtataggctaaaagaacttaggatgggggagtataccgcgggtagccactaaaggacctgttgaggttgtagctaaaatgaaccttactaaatttttgacattgctaaaattttagcaatttaataatattgctatgttttggtgggattttttatgtatttttcaaagtttagtaaaaaaaattaaatgggtgtgcatatttgacaattttattaaaagttgataaagtttatttcggcttgatcaggcccctaaagctgcatattcgtttggtcgcaggctactcgcgcgtgccgggcggtcgtattgctgtccagtacagtgcgacgatctcgatcactgataagatgagcatgcatgtacagtagaggatggttcgagaaacaccacacgcatgcatatgatcgatcgatagcgtcgagggcacgcgcgtaggacgtactctgatca

SEQ ID NO: 19599 - DNA, 1051 bp, Oryza sativa
gagaacgatcgaacgaacgagagcgagaacgaacacgtcaacgtacgttgccgcgagaacgtgaacgagaacaagaacgatcgaacgaacgagagcgagaacgagaacgatcgaacgaagacaagcgagaacgagggaacgaacgtgaatgagaacaagcgaacgaacgtgaatgagaacgagcgaacgaacgaggacgaacgttaacgtgaaatgcaatatatatatatatatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattcactacggaattggtgcgactcctagcaattgactattgtagtcttaattagacttagcatatactcacgaaacacttagcatacatgactattttagtcttagcatgtaatattatttgagttttaatataatattactttatttgtaattagacttggtatgtaattattgacaacggaattggtgcgacaagtagcaattgactattgtagtcttaattagacttagcatatacgcacgaaacacttagcatatacatgactattttagtcttagcatgtaatattatttgatttttaatataaaattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttacagatgtttcttgtatcacaga

SEQ ID NO: 19600 - DNA, 718 bp, Oryza sativa
attccttctatactttcttgaaggagggtgtgttcgctaccggtggatggaaacggtgtacagtatgcacggaaaagggacgatccattagcacgcgattaattaagtatttgttatttttttaaaaaaatagattaatttgattttttaagcaactttcgtatagaaactatttaaaaaaacacaccgtttaacaatttgaaaagcgtgcgtgcggaaacgagagagagaggttgggaaaagtagcatccgaacacagttctttagtacatgatatatgggctgtgtttagttcctgaaaaaagttggaagtttgggaaaagttaaaagtttggaaaaaagttaaaagtttatatgtgtaggaaagttttgaatgtgatgtgatatgatggaaagttggaagtttagagtagttgggggtgaactaaacatggccatgatcgaagtgaaagcatcaaagtttcagaaagtaactatattatgatctaaaaaagtaactatactatattactgtataagcattatgggccattttggattgatgccaaaatgtgccctaccagtttgtttcgtagtttgaatagtgaatgtaatggtttggtttgaagccaagtgaatggtaatgaccatgattaatttggtataattctagaactttcctgagtataatataaatttggcttccaattggtatcaatccaaatccattcacctaaaa

SEQ ID NO: 19601 - DNA, 711 bp, Oryza sativa
aaggtcccatttatttgggcatactactgttcttctgcgagggattattcagagatttaatctaaaatttagataaggacatcaccgaccaatccgactggcataattgcgtcgccaattggcaggccaacggccaacgcccatgccacgtatcagtacactacagtacagatgtacaatgccacaatggtttctgatctgtatacatatcttgctgttggttctggaggcaaaaaaaaatcatgcaaatttctcgcatttctgtctatgggaccagcagttttcttgtagccaaacaaccaaagaagaacagcagcgaactggtttttgcgaactttgcacgagatttttggttcaatccgacaaacattcaatttggctctgctctgcaattaaaccctaacgtccacaccacatgatcatcatcaattcatcacgtataggtaaggagcagagcagacaaatgcactccgttcatttactgatcgagcataccaggacagcaaggttggtgtccatctccatccaatcttggtacagttcatccaaccaggaacaagaaactccgatgaatccacgcaagaagaaagaaacgtcgccttccttaacctgttctaagtccccatcgattcaagatccattcatttccctgtttggtgatgctgatgatgattttctctcatctgtttctgttcctcctcatgtgacaat

SEQ ID NO: 19602 - DNA, 853 bp, Oryza sativa
tttcccgctatttcgaaattctttttaaactcggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattatgaaaaactctaatatatgaatgatagttttaaaaatatattaaatttaatacttttaaaaattctccagtcaattataattagcatatgaatgatggtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtcatttaaaacttttaaaaattgtaagtatcgcatataactagcatacacattatttaaacttgttgaaacctctaataatcgtgcgtaattaacatatgccata

SEQ ID NO: 19603 - DNA, 1501 bp, Oryza sativa
ggagccttggagatatatatattcgtcaggagatctatcaagagcaacttgtagtccttttctttttcttgcagagagagagtttctacgaattgcgagcaacgaaaatttcctgacgacttgaggattcgtcaagcagaaagtctccaagttatttgagcataaaacacttcttgtaataacctgggacttttatagtccactatcgtgtgaaaaatcctgtgtcaaaacgcgctatacgttgcatgaacacacaattataaacttttttgaagatggtaattatgtcctctagatacaaactacaactaattaatttgatatttttagtccgtataaagttgactcggtttttgagtctttgacaattactcgtatggatcatatagattaagggcccgtttggaagttcagctttcggcctgctatgggtgttaggtttgggccagggacatttaccagttatgttggactccaagacatctatttggaagggccacatcttcaaataaagcctcacactaccttacggcccagagaaatctctgcaggagcccaccgcaaattcaccggagaatgttgttgcaaaaaatttacatgtacgtacgtattgcagatttacagcttatttttttgaacgcataagaaggtccaatagtaattcatacatagtataattgtttgtgatcaatagactaatggcgatcgatcgcgagattatggtctgatcagtctttttttttcctttttgcttaggcggttttcatcctttctctcttttctgaggctcatgtttattcaagcttctacttttagccgcccggaatccctgatttgttttaacggtctttttttttcttttctgtaacaggcgatattccttttttaataaaccatagatacattttggggcaatttcgttattacccctatttccatgttcaatactgattttgcccctactttttagggttttcgtttttgcccctacatttttgaaatgaaaccaccgttttcacatagtccattaattattgctaacggtgttaaatgtgaggtaaaaaagacaagtatactcttagatattttccagtacttttgtacactactttcaattttgacccaaattttggtaaactttaacaaaatttggacaattaaattattgctatagtatggcatcaatagatttttattttgattatgtcaaaagtaccggaatatatctaagggtatatttgtctttttacacccacatttaacaccgctaacaagaattgaataggggcaaacggttgattcatttcaaaaaaaaaagtagaggtaaaaacaaaaacctaaaaaataagggcaaaatcaatattgaacatcaaaataggggcaagaacgaaattgtcccgtacatttttgcctttgtcttttctacattgtttcgttatttcatttcttatttcgttaaaagtgctccgttatgtttttggcacggcagttgttctattct

SEQ ID NO: 19604 - DNA, 713 bp, Oryza sativa
aattttctgtttaggtcccattcttgtcacaaatgtaaccccttgccatgctctagttatgctcggccatgttttgtaataattctggttaggtcccatgttttgtaatttttttaaataaaatcataaatataaagttttaatagaaaatgtaccgtttaatagattgaaaaatgcatattcatgcatcatttctcactcttccagctaggatattgataacgtggatagctattcaacctgctgaatgttattgtacatgctcttaagagagaataaaagcctatcggtaaaaaagaagtaatgggggtaaagtagtttatcaaatttttttcacactgagctgatgcatgttgtggtccctttaacaaggtagattatctttatgcccaattgtctatctatagccaacatcagcatggagcaataaccgctctaggtcaaataatagccttgcaaattttaatactcactaaataactagacttttctagaaaaatctccaccatgtcatagtacaatgtctttatccatgcaaggtccaaactggaaaggaattttgtaaaaaatattaagtatttccaacagttttttccctctccttataaaagttggtgctggtcagtacaaaacaatcattcaagtgaccaagcaaacacacaaagcgccactgtgtagctcactgctcactcatcaaccaacttcctcaataa

SEQ ID NO: 19605 - DNA, 294 bp, Oryza sativa
ctctacggcaaccctaggacgtccctaatcacatttattcagtagccgtcatcgtttagagtcgggttttgcttagattattctgtcaagaacagtttcaccgctagatcggtttgtggaaccccaaatttgagtgcttaattattcatatgcaatttggttgcaatctattttgttcttacttgtgttcttcgattcgcatgcagggattagccttctcggcgaggtcaaccgggtttcggcatggttgataaccagaggagacgtggtgctgtgattgcggggctcaatagc

SEQ ID NO: 19606 - DNA, 1501 bp, Oryza sativa
ttcttccccacacacattttctctctcatcaacttacaactaaattttggagacaaaaaaagtgtgcaaaacataggtgtaaatgtagtatgacaaaaaaaaaacattggaggatgaagttgcaaaccttttaggcacctccgatttgtatgtaatcaccaaaataaattcaatattaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtagcactaaccggggctaaagatcaccgggatctattaccaaccgggactaaagttaagatctttagtcccggttggtgttagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcagtcgaccgatgaaagatggtttctccaccagtgttggtggtaaagatccacggtcagtttatgaaatttggaataaatttggagcaataataataaacaacccacctcctgcaaaggagatgataatgggtctaactaaaatttccacgccatccagaatagaacaactgccgtgccaaaaacataacggagcacttttaacgaaataagaaatgaaataacgaaacaatgtagaaaagacaaaggcaaaaatgtacgggacaatttcgttcttgcccctattttgatgttcaatattgattttgcccttattttttaggtttttgtttttacctctacttttttttttgaaatgaatcaaccgtttgcccctattcaattcttgttagcggtgttaaatgtgggtgtaaaaagacaaatatacccttagatatattccggtacttttgacataatcaaaataaaaatctattgatgccatactatagcaataatttaattgtccaaattttgttaaagtttaccaaaatttgggtcaaaattgaaagtagtgtacaaaagtactggaaaatatctaagagtatacttgtcttttttacctcacatttaacaccgttagcaataattaatggactatgtgaaaacggtggtttcatttcaaaaatgtaggggcaaaaacgaaaaccctaaaaagtaggggcaaaatcagtattgaacatggaaataggggtaataacgaaattgccccaaaatgtatctatggtttattaaaaaaggaatatcgcctgttacagaaaagaaaaaaaaagaccgttaaaacaaatcagggattccgggcggctaaaagtagaagcttgaat

SEQ ID NO: 19607 - DNA, 303 bp, Oryza sativa
aaaattttgtctaaaatcaaaaatagtttgtgactaaaaatagtgcatacaagaggtgtaaagccaagcaaaggtggtaagaaagaagtacgtcatatattcagttttatgtattattttatttcatgttatgcgaataaatattctgaaatttgtttatgttgttttaaattttcagaatggacgaatcgaacattccatcgttcacgttaggtgatttcgaccctaactacgtgtcgaggtcattcccaactggtaagtatgatgccaccggatcggctccaacaccaccagttatggagc

SEQ ID NO: 19608 - DNA, 223 bp, Oryza sativa
aatggtggtgatcatgtgctgtttagtagtagtgttttatgccctaattgcctctaatgctgctcccaagaataaccacgccatcattttgccactccttgcttgggagtgacctatgcatggttgaattgatggattctcatgtactactgtatagtaacagagatttcttcatttgtttatgtgatggcaatcatctaaagcttcaggtagtacaggaaca

SEQ ID NO: 19609 - DNA, 165 bp, Oryza sativa
aagtgatcttgtcccaagccgaaaaaatgaaaacgggccgagggtgaaaaaggcgacaaagactacattccctctaaaaaaggggtaagtacacttaatatctaaactgtttgagtgataactgttagcccaagctaattataaactttgatacatactcataga

SEQ ID NO: 19610 - DNA, 359 bp, Oryza sativa
cttggcccaacggctcgagaaaaataaatgggcctcgcccgcaagcccatcacctgctcggcccagttagaatcttactcgcaaacgaggaggagaataatactaataatgaagtcaaatagagaaacccaccacctcgctcaatccaaaccccaattcacacgcgttgcggtctccgacgagggcgaggcggagctaatcgtcatctagggcaaggcggagctaatcgtgggtccgatggagaagccgtcgccgccgccgccggggaagtcgcggccggattgcgtcaactcgtcgaacccgtaccacgagtgctccgactactgcctccggcagatcgtgaagtccagggaagataa

SEQ ID NO: 19611 - DNA, 1501 bp, Oryza sativa
atcaaatatccacaaatctttcttggggtcaagatgatccacggtataaaagggaccccagggagcggtgaaaggcattcaattctatcgccaacacacccaccatagtttacgaagccggagtacgcggagccaagtcgctgggagatctcgtcgaattcctcgactacaatctcgtcggtatcatctaattcgactactctcgttgtaatctgttctcatcatcataaataccatataaactggattagagctattacctgacaagaggcctgaaccagtataatccttgtcttttgtctgcttgatatcgtactacgtagacccttgttccaacgtaccctagtactctactcatccggtccccgagtatcattcattgacagaatcctcttacttatgtgcgtgcagtgagtttctttttcttctccacttgcacaaatcttaaaacaaatctaacggttcaaaattacgtgaaagttagatgcaaattacattgtagttacactatagttgtatactttggttacatctgttaaatttttaagaaaaaaatctgtcgacaaatatatagcaaaattgaagaaaagttggcccatgaaattatttttttgcctggggcaggtctctcggataataggcagggatcccgggctgcggctgaaaggaaattggaatcatttttattaaatgtttttctgttaaaaatttcaaaaataaataatagaatgaatgttttttttaaaaaaaaatgttccttccgccaatttaggaaacaaataatggaaaaaaaattacagaaatattcttctccatccttactgtaggacggaaggagagtataggtatgcaaaacttttagggactgcctgtatatacatcatgagacagatataggtcatgcagatttcttaccctttagattaacatctaacggatggcatcaatatacataaacaacaaacaaaaaaacaaacaaacgagccacgtggacaatctaaaacttacgtgggctcaaatgggcaagtagatttcagacttacatcgtaaatacactaaaattacatatgtaattttcagacttacatcataaatacactaaaattacatatgtaattaatatatagttatagtgtaagtaactataaaaacaagttagctcagtgaaagggatgagttaaaaatcatggattcgagtcctggtacgtgtaagagtttttgtttctcatgccatgcacgaatctcagcgtagcgtaaatctcaaatacatccgaccgtaaaaaaaaaatgtgtaagactaagccatacaaaatctgtcagcagatggatagctgttccgaaacgggtattctattttttatttttgtaatttttcaataaaaaaagtatataaataaataaaatcaacagaaatcccgaattggactagggtttacccctcctcccctcctaccagactataaaatcctgttgccctgacctttctctccgcctctacccc

SEQ ID NO: 19612 - DNA, 177 bp, Oryza sativa
gagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacggatatcaga

SEQ ID NO: 19613 - DNA, 273 bp, Oryza sativa
caaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaa

SEQ ID NO: 19614 - DNA, 383 bp, Oryza sativa
caaatcctgaggataaatctgaacatgatcatcatgtctagtttcatcatcagaatttgattagagttaagaaaccctcttcttattccttttaatttgggacaagaacacagtcaaatttcaagtcggattcgctcgaggaaataaatttgcattgtttgatcttgacatgtttgagactgatttgcccccacacttaatctggggaagcttcaggaaaatctacgtacgaataacctggatcaacatgatcgtcaaaatagggttggctagcgaattgattaagcccacctcattggtttgattgaagaacacgtcggtatcgtcaacgctgctaattaaactcccataatcatgatccttcttcctttctcctccacagg

SEQ ID NO: 19615 - DNA, 792 bp, Oryza sativa
atgtaaggtgcttgagcctttgtgctccttttgtttgtgaacatgtgtgtatgaactgagcttgtttggtcagattttctgtggctgcatacacccccgttggtgtagaagccaggttttataaattcccattatctaaaaaaaattaatagcaattaattttgacacctatttacaattgtaactcttacatattcattttacgactttaatgatttatcaccatgactcgcatgaaaaaaatatgtagtacttaaggtttaggatagctgaaattaatgaattatataatttatgtgatagctatttaagggtataaacaaatgaattgacttataaaaagttagaatattgtttaaagaagacactatttagaaacttggaaagcgtgcaaacaaaaatccaaaatatggaatcgagaaaaaaataaagggccttaaactccctttatcacccttatcacagtaagagttctattaatattcgtcaatattacgctcacatttataacataatgattcctttcacctttacgaacaaatagtacaaaatccaaatacgacataacacaatacattataattattatgtaatcaactctcggtttcaacttaaacagagctaattagtgttgagaaaaacacaacccatggtgcttaattattctctcgctgcatcacacctttaattttcttttcatgttattaacaacattaatcatctccatatatgatttgatatgtggcaaagcggtagctttacagcggttgtgatcaccttatatgtctcaga

SEQ ID NO: 19616 - DNA, 412 bp, Oryza sativa
tacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatata

SEQ ID NO: 19617 - DNA, 1250 bp, Oryza sativa
atgtaaggtgcttgagcctttgtgctccttttgtttgtgaacatgtgtgtatgaactgagcttgtttggtcagattttctgtggctgcatacacccccgttggtgtagaagccaggttttataaattcccattatctaaaaaaaattaatagcaattaattttgacacctatttacaattgtaactcttacatattcattttacgactttaatgatttatcaccatgactcgcatgaaaaaaatatgtagtacttaaggtttaggatagctgaaattaatgaattatataatttatgtgatagctatttaagggtataaacaaatgaattgacttataaaaagttagaatattgtttaaagaagacactatttagaaacttggaaagcgtgcaaacaaaaatccaaaatatggaatcgagaaaaaaataaagggccttaaactccctttatcacccttatcacagtaagagttctattaatattcgtcaatattacgctcacatttataacataatgattcctttcacctttacgaacaaatagtacaaaatccaaatacgacataacacaatacattataattattatgtaatcaactctcggtttcaacttaaacagagctaattagtgttgagaaaaacacaacccatggtgcttaattattctctcgctgcatcacacctttaattttcttttcatgttattaacaacattaatcatctccatatatgatttgatatgtggcaaagcggtagctttacagcggttgtgatcaccttatatgtctcagacactacaccttgtcacacatgcgaaaggtaaaggtgcagacgtgcattgtgcagcgggcaaaaagagaattttggacgctttatttattagcaaacaatagatccgatgattataataataaatccaccagttctagtgtaagtgtacattagttaatatagattttaaattgttaatttaatgggtacacaatataatggtgtagaccttattttgaaacagtgcattacttaagaataatataccaatgtaataaaaagtagatccgatgatttatataatggggccatcagtttaagtgtacgtataaattagttaatatagatattgtttatttaataggtacataatataattgtgtaaaatttattttaaaatagtgcattatttgaaaggaagattttttgttatatgatggtagattctttgttttgtaaaattatgattatttaaaaaa

SEQ ID NO: 19618 - DNA, 153 bp, Oryza sativa
ccggaggggaaggaaacggccgcggcgatctcgggcgccattgatgccgccgaggtttaggggaaagattccgagcgaatccgagggagagacagagggaaaagcggggggaaacggagagggaatcacggggagtgatttccccctctttaa

SEQ ID NO: 19619 - DNA, 1501 bp, Oryza sativa
cactttatgtcctatttcatcatgaaccgtgcatcacatccagatatctcggtgtctccctttcctatggtgggctgcatgcatgtgttctatacagtcgatctacacacatgttggcatttggtatcctaactttgtaagagatggacaaacttattacagggtctagagatgagaaaggatgattggtgttgttatcgatcgcatttcagaatagctagaaaacatatggcatccaatctagctagccatttttttgtgctcaccttccaaatgaatatattggtccgatagctggatgtcgtaaatgtagtgttaaaattagaattgaacttcgaatcagctgggcggtgagccggtgacgtacagaatgtaactatgtcattgctttgatgatggcacatggcaatgttattgtgtacaactataaatgtacgttagtttcaatgttgattgacaggtccagccatccaaaagcccatgcagcaagaatgttcacactgaaataagttaaactgcatgcaaacacataaaatgtaagttttgctatatttcacttgttagaaatatattgactttgctatttgtcaatcaactgaaatttgcacagcctagatgtgtgcttacgattgtgtacaatcggttttctttatcttaatgggccatactaccttttaaagtcgttacattttttgtgaatgggaaaaatataaatcacaatctttttggaactgcttgaaatagtaactaatagtgagaggttggaaccggtcattattccattagacattagtgtgttgatacttctcttatccctagatatgaggcccactgtaaataaaaatttatttatgcacacctatccaatctattatatctcttccatgcatgcaaccctgctcatgagctcctacacagttttttttcctattcacttcgtaagttgtaacgatattctgcttggaacaggggttaatctaaaataaatttatagtggggactcatctcttttttcctcctctccctcttcttcccccttccctctctccttctaccaatagtgatctagcggggtattggggagttgagtcgccctgacactcacactggatccaccctggcttggaacgattactaaagctctatgtagatactatacttgataccaatacagcacaattgtcttctctctgcgtcacaatagtcataggccatagagaaaaaacaatagcatgtcattgaagtattacactcccatctttgatatagcataagttcaggcagcgtacttccctaataatccccggatgctgcggatgcatgttttaccctaaacacgatgtttgacaaacagttatgtgctttgacagtgaatggaaaagacagtgatgagagcatcaacatgattccctgttgcctccctttcctatatatcggctcaccaatataaaccaaatatttttgaaggactattctcattctctctgtttggattctatca

SEQ ID NO: 19620 - DNA, 1501 bp, Oryza sativa
cctagacttgagaaaattcttgctacgccacagatctcacatgtcatacacacattatattttagagccagtactataattggctacaaatctatagctcactactcttctctctactcttttatcttcttgacatgtgtctattgctaacttatactccctccgtcctataatataagggattttgactttttgcttgtattgtttgaccattcgtcttattcaaaaaaaatttagaattattatttattttatttgtgacttactttattatccaaagtactttaagcacaacttttcgttttttatatttgcacaaatttgttgaataagacgagtggtcaaacagtgcaagtaaaaagtcaaaatcccttatattatggaacggagggagtagtttattattgtacccactcttgcttaggccctgtttagatcccaccctaaaatttttcaccctgtcatgttcgaacgtttgaacacctacatgaagcattaaatatatgcttaaaaaataactaattgcacatattgtgactaatttacgagacgattcttttaagcctaattgctccataatttgacaatgtggtgttacagtaaacatttgctaatgacggattaattaggcttaataaattcgtctcgcagtttaatgacggattctatagttagtttttttagtagtgcccgaacatcctatatgacaccctatataaaacctaatgtaacacgccaaaactttacacctctggatctaaacaacacccccttagtctcacaatgtttttgtttgagtgaagtgcacatgcggtcattaaacttgtacggatatatcttctagttccttaaactcttaagatgaatttttcggtccccaaacttatcatgagtgtcgtatatgtttaaacgggttccaacccgctccgtgagatgacgtggagtttacttcctccgttccataaaaaaacaacctagtacgggatgtggcatatcttagtactacgaatctggacatacatgtgtccagatttatagtactagaatatgtcccatccaatcttgggttcgttttttatgggacgggggaagtacgtgtcagtggatccaacgtgtcagtcacgtagaaaaaaaataaatttaaaaagagaggagagagaagaaaatgatgtttttaattttgaaaaaagtaaatgataaaagagaggagaaaaatatgttcttaattttttccttactatccgtttgaatctatatacacacgagacaagttgagggaaaaaaattatgagagtttaggatctaattatacacccacatacatttagatatcagccgtgcactttactttttttttttttcgtgactactagtttctggagtaactaccaccaaagctgtgctgctgttgtgcttccagtggcaaacacagcagatagataatacagggcccgcgacgtgggcgagaaaaccgtgtgccccgcgcggcgtggcggctcgg

SEQ ID NO: 19621 - DNA, 1501 bp, Oryza sativa
tagccagcatcatacaaacaaaaatggaggtagtgttagaataattaggctaggcccgatttatcctattaaaatctcaaaggcccataataagtgttaaggataataataccacctcaggatttaagcgaggagtatctcaacctaaatagggagttattagaggctccctgttgaccggttgaggtgggagtcggaaagccacacgcgcgcgcgccgggccgagggcgtggcgtggcttggctggctggctggcgtcacgtcgctattcttttgcaaccacgatcccacgttgcttctttcccgggtgttagttcttcctcctccgcgcctgtcctgttctcgcctcctcgcttctgatcacttgcgcgcacaagagatcggaaggagcagggcctccggaaccacaccttcgcctgatatctgcaccgggtaggcgggtgatcaggtttttggggagatcggaaggagcatggcctccggaacctcaccttcgcctgagatctgcacctgttctcgcctcctcgcttctgatcgcttgcgcgcacgagagatcggaaggagcagggcctccggaaccacaccttcgcctgatatctgcaccgggtaggcgggtgatcaggtttttggggagatcgaaaggagcatggcctccggaaccacaccttcgcctgagatctgcaccgggtaggcgggtgatcaggtttttggggagtgcttcccgcacgactgctcgtccaccatgtctgcgcctggagccggagctgccgccgccgccgctgctgctggagctggagatggcgtgcctggagctggagccggagccgttgcgaacgtcaacaccaacagaggcaattctgcctcacaatccagcggagggccattctcggggtatatccttctcctgctgttaactcattcgtttatagcgctgttagtcctgttagtcgcaagtcaattgcagcttttggggagtgcttcccgtacgattgctcgtccaccatgtatgcgcctggagccggagctgccgccggtgccactgctgctggagctagagatggcgcgcctggagctggagccggagctgttgcgaacgtcaacaccaacggaggcaattctgcctcacaatccaacggagggccattctcggggtatatccttttcctgctgttaactcattcgttcatagcgctgttagtcctgttagtcacaagtcaattgcgttcttgctatgttcatgttcatgatgcttatgatacctttagcatgctactggttatgctacatgttgtcactagatcacccaacactgtttatgccatgattattgtcttaacattttagattaaaatataccgatatatgaccatatttccaacaatccaaaaacctaataggtcattttcggtagttggctttgctgctgcactgaaaccacatgcttttgatggttctaactataagagatggaaagcacgtgcactattgtggttgacagcga

SEQ ID NO: 19622 - DNA, 1501 bp, Oryza sativa
gggacggaacgccacgcgcagatgtgctagcacccgcgcgcggctagggttttgctcggggagggaagtgacggctagggtttctcacgtgatgcaatgcctccgccggtcacacccctcacgaatatataggatccattactcgggcctccaaggcccgtaggactcctattcggatccctatccgaattaagcttatattcgatccctatccaatcccttattctggtccattaagcgtgcgaccctgtatgttcatgtacactcggctgtaacccgaaaactccttttcggtccacgcgtcaacagcggcccctagcagaacgtattgacccaccgggcatacatcaagatcatattggctgaacctctagtgtatacttgtatgaacccctttgcctcacgatatcgattaagctcaaggctagatatgtgccatcctctaatagctcaatcattcactcgaacctgttaatagattatataacttgtgattgactcctcaatcacctttggcatggccatgcacttccataatctataacatcgaggggcccaaagatatctctccataggaggggcaaatcctatcttgattattcatataccactacatgtttcatagcatacccgaaaactatttttataactacccaattacggagtagtgtttagcagtccctaagtaaactattgcacatgttggaaaccatgataatctcaggtctaaggattcaacaccaacactaaatgagatcactgatgacacaacacatatggctcttgcagtgtttcatgttgggtctatccaacaacatgttcaccaacatgtgtccacattattaatttggtatctctatactatgatccatgagacatgatcatcaattaatacatgtgctgatcatttaaacatatttgttccacatatgatatttgatcagggatcctttagaaatagtaacaaacaacataaagagtctcataaaagaatcacatattcattaacaaataatgagttatctatttcgaggaacaatgtcagataaatatgtaaacatagtatgtgatacaatcatctctatgattgcctctagggcatatcactaacacttcccccttccctcccacccctccccaccccgggaccctaattcgttggccctccgccggggaagtagaggagtttgccggagttggagagcagctggatcacgaatcaggaagcacatctagtggaccaaaatttgcaatatttagagatagattttctgtcaacagatggttagcaattctgtttttcatttggcatatgttcaattaatctcaattcaatcggttctagttaaacatggaagcagtcaagcagaaggaagcttacaaagaaatcggcgggagagctttccattctcgcataccccacgccgccgccgtttcttccggcaatatcaccgtgcgccgccgagaaccccggtgcaatcgcgctacgtgcttctcctat

SEQ ID NO: 19623 - DNA, 1193 bp, Oryza sativa
cccatttttgatgagcagtcctattacatacatacatgctcttttgatttgttgctatgcatatttagctactttagggcatgtttagttcccaaacaaaatttttcgcgttgtcacattaaatatttggacacatgcatggagtattaaatatagacaaaaaaaaaaccagttacacaatttgccagaaaattgcgagacgaatcttttaagcctaagtgtgccatgatttgacaatatggtgctacagtaaatatttgataataacggattaattaggcataataattaaattcgtctcacggtttcctggcggaatctgcattttgtttttttattagactatgtttaataatttaaatatgtatccgtatatctgatgtgatgtgcaggggaaaactttttgccaactaaacatgcccttagactgagttcggccaactttgtctgacacggaaaacaaagcaaatgattagaaccagattaattaagtattagcttaaaaaacttgaaaatggattaataaaagcaactttcctatagaaaacttttgcaaaaattcacaccgtttaataatttgaaaagtgtgtgcgtgaaaaatgatggaggcgagttgagaaaaaaagggaagaacacaaccttaacataagaataaagtttcttttttctttcaaaatgcttttcgtgtgctctgtcccattttaaacgctgttgtatacgaaaatgcatagggagtacacattattagcacccgtacattctatacacctggaagatgcgtcctcgcagaaagaaaaaaaaaagttacttgtggtaatacacacgtcgtccctgacgattatttaaggaagaatggttctgttcttttcagttaattcaacagattatattattgccatcatatcatgaagtatttgttccacacgcaaaagaaatacgttttgttgaaaaatatttttgtactacattgctcgatcccttaacaaagctatttgtttttaaactgagatcattattatatttcaaatgatccggcttttggtagaaagccaagataacgaaatactacatgttaagtttatttatcaaaatatttaatttatatctacaattgtgtcgataatttgtttcaaattggacaaagtttatgactcgttccattttggtgatcgatggcgtgtcatatatgcagg

SEQ ID NO: 19624 - DNA, 1501 bp, Oryza sativa
atcacacaagaacaaaaggacgggtaccaaagtaacacatatggcatctaatcacagaagatgctgtaccttgtaaaatttgctctttaaaatgatctctgacataacttccttcttgctcttgtgaacctgccaacaagtgtaattaaattgaggtcacaggagacggactgattaaatttggatcctaataccatcctatcaaaacttacattagttccttcaggaagaccaatttctgaaggaacatcaccactttggagaggtatgcggttcttcgagaggatcatgtgacctgaaaattacagaggattaagcacgctgaacaaaatctaatcataaatgttgattcatgtggatagggactctacttcattttggagactactatgatgcaagaaaacaatttcatgtaataatgtcatcttaatttctccaatggtgaagttaacaaataaaatgatgaaaagaaaactaaaattagtgcatgtttatgagcctattacaggtaagccatttatttattataatatgtagtatatgcaagaaaaaggactcactttttatagataatgaaccattaaaaatacacatacctacattctacacgtaagggggaaaaatcgctacctgccagtatcaactaaaactgagcctaaaaagggttacgtcctcaattgcacaaatgatcaacagacaggattttgcaggccatcaatagttactgggctagtttgggttgaagcctatttttgccctactgaaattttgacaacttcaatagtatgaaatgaatgttcggtttgctaccattttttgcccacacaagctcaaattctatactacaaaatttggtagggcaaaattggctccaaaccaaacaagcacactgtttcttttcaggaacaacacaacaaatatttaatacattcatcatttgaggcagaaaacagaacgctagcttcaagaaaccaaaatttccatatgaatgtcagaaaaggaagattcacaggaatccaagaagaaaataagatgattatatgccaagctaagacactaagacagagtatggaacaaaccttcttcatcactataatcatcaagaggcacttcttcatcaaaatcatcttttcccgagagagagtgaggcaggtgaacatcaacctcatcttcctcatcatcagatagattgtatttgctttctcgtttcagctttgcctagatagaattacaaaagggaactcaacaaactatagtaatacaagaaaacacttataacgatatcatcctaaagttactaaccagagataagaacaatgtggttacattacaaggcgaatatcactaggaacaattgtaagcggagaacaaattaatttttcctcattgaaaaagctctaaggttacttcatttttactagtaactacaatccatcaagtttattcatctgtcctgaccagagaaatgctacaggtgttgactgttctacgcaaaacatgc

SEQ ID NO: 19625 - DNA, 1501 bp, Oryza sativa
aggccagaacattcaggtgaaaggccagcctgagccatcagagccacagaagaaagagtcacccacatggttcctcttcgccaacctgtttcgaccgagatctctctacagtttcgggatgttcatgcgctgatctcatgagccgatcccgaaaaccgcactgaaaattcttagctgacgaagaggcccaagaattcaggaagttacagagagggccttcattctgttcaagacttaccagtggagtggcgcaggaatggaatagtagtgtaggggttgtttatagatcatcatcatttgtaaatatactcgaattcgccatgtccacattgtacatatgtagataaatcatgtaaatataactgtggaagatattgttttataagaaatatgttagattaacaaaaaaatattgctccttagaaaattcattttaaaagcagcaattttggccattgctttcaaattattgtagctcacctctcacctgaagctggaatcttcatgacagcaatggcttcaaattctgtggtggggcaagcagatgcaagtcagtggacaaaagcatgctattatcttcttacctgaagctttgctgacaaagacatattgcatcaaagcaatatcacattagcctgattctgataatgatgcatcaaaagcaaatcaacttccttgactaacctgcaacactgtcatcaatcacattagctgttattcgtcaacatgattcctcggttgatgacatggcgctgacgtctccgctgagcggctaaaaaaaagagcagctgaaatgggaatcaagaaataggcagcatgagagttagtttggaatgtctcttacctttagggatctctatgactttgcccatcacttagtgatgcttttttggctctggtgatgattgattggatgcacatattgctgctatgattggtgacatctaatctagagagcaagtcatgaaaaaggcagcagcaagcactgataaaaaaaagcaaataatgcaggcttaggtcagaactagagccttcagaagcaggacatgatcacattagcaaacagtaaagcagcttttgttcatgctttgcacacagaaaaaatgcaagtgcgtgtatgcatgcatgcggctccattaggcgcatgcgcctaagcttctccatgaattgagtgggactgtctgaataatgggcaaagtggatggtcacaacacaagtggcctctctgattgataagcaattaggcagatgtaagcatcaagatctaggcaggtgctgatggtgatgttgctctccacatggaagccatcccaattcccaattcaaagcaggtcagcatttgggcagatctaaagcaccagcctaatttatcttctgatgcagaacaccatcatcaccaacagcaatagagttagatgtaatgctggtgaacacaatgcttcccttgcaatatgagcaaatatttcagaaacagtgaacaacatggcaaggaatggctata

SEQ ID NO: 19626 - DNA, 1501 bp, Oryza sativa
aaaaaaaatcaaaacgtgtaaagtatgaaaagggtagcacatgcataaaaggaagtaaatggtgccatgcctaaaaaaaaatgttgccgatttgccatgttcgccgtgcacagctgcatgggcacattcatttcctatttccccctcaaccttccatctgttcaccaatgcaatttttagctcaacatatcatatcttagtataaaattatgcccaccaacttttaaagctcaatatacaaccatgccatattattacccactagcaataattacatatttattctttttaattataggaaaaaaaattcattgcgctctgccattttgaactaaaaagaatcagaattattatttttaaagaaaaagttcacaagaaacaattcaatccaattgctaaagaaattagacctttcagccacgatactgcacgccaagaaccaatgtcgttgtagaatttcccgaccatagctatcaagttgtcttgaccagaaaaaaaagtttacataaataaaatgcatgaaagattacatttaaaattttatttaaaaggatcaaaaaatataaaaaaaactagagaaaaaaaataggcgctccaagcacactgtttttggtactagtatcccccagtgtgaacgaagcaggcaaaagacggacagcctcagaaccaaacaattctccagattctgtccgtggtttggtgagctggacagccgtccacacgcaaatccggaataacccaggggcgtaggtgcaaaatgcgcaggcatgaaaaacaacccgtaggccaatcccagccaagattttgggggaacaaggagagagagaagaggagagaagaggccattcttctcttctccaccacctactctctctctctctctctctcatctcctgccttctctctaggatcgccgccatccaccacatcccacgctttttactgccgcacacataagagcacaggaggaggaggaagaagaagagtagagagagaaagatagagagaggagcaggagaagcattcgttcatccaggagagagagaggcttcaagttcttggtctcctgctctgccatgtccatgggtatccatccatctctgctttctctctccctgttgtgttgggctttcttgttcatgtccttggaatgtaaagtttggttctttttttttatggtacctttgtccttcctttcctcttgatttcatttagtaacggtgttaggaaggaaggatattctttctgctctgttcttgattttgtttatcaattttcctttttttatggctcaccctctttcagatattgccatatcagaaataaaaaatctgattttttttcatatattattcatcatactagttttaacctttttttttttgaaaaaaaaatatgagagagaagaaaaatcagcatgtttcttgctgttcatcagaagctgtagtgaaatttaatggctgcatgtggacagatgaagggtatggccctacctgggaca

SEQ ID NO: 19627 - DNA, 1501 bp, Oryza sativa
ccctagcttgcagtacccattaatcaaaacattaaccgtcaccttcgtcgccgagcaccccatttccaacatcctggctttgaccctcagtgcagcctcgatgctcccctcctcgacaaatccttgcatcagggtggtaaacgtcgtctcgtcaggcgccacgcctctgctagacatttcctcgagcatgagaactgcagtcctgacctgatgtgctcggcacaacgccttcatcagtgtgttgaatgtgacaacatcaggcttgattcccctagcacccatctccgagtacactgattcaaggagtttcattttgctcccctccacaagaacattgagaaggtgattgtacaccacggtgtctgcctgaatgccaaacaatggttggagttgattcagaatcaggtcgacggcatcgtcgaacagctgctgcccctcgtagctgtccaagaaggagtggactacgcccaatttcacctggtgcccctcccgccgcatctccgcgacgagcaccttcatgaggtcgagggccccgaccgcgccgagcttgcggatgatctcctcgtagacctcggggccgggcgcgaagtcgtcccgcgccagcgccgcgttgagcatccggagcgccgcgtcggggtccggctgctcgcgcagggcggtgaggagctgctcctggccagccgcccggagagggccgtgccgggaggcgcgccacctcggccgaagcggccctactccgacatggcacgggcacggcggcggcggcgcccgaggggcggcgcaaacgcggggcattggggttcagttcagctcagctcagctacctgaaaatccagcggagccctcgggtggtcgctcctttctgcgtcaacccgccggcgatgtcgtcgtccccgcctcagcctgcgccatgtccgggtcgtcaggtcgtgggcaactgggcagaggagcagctaaagtaaagtacaggtggggaagagagcgcatgcacagggagagggaggaagtggccgcaggacccggcggcggagcgacaactttgcgggcgtgcggcggcgtgttctccgtgaaggcaggcagaggggaacaggaggaagggataaggcaacagtttagtttttttaaggataagtcagtccgccttttagtggtgttttgggaatcactccttcactctttcccaaacaccaccttactaccattgtggataatactagaatatgactatggtactttagttttttcggttaatacaggataatttattcaattggtcattctcaacggatgttgtacagaatggttctttcttcaacgcaccaaaatttgttgagtttccaacatccgctagaaagcttatgcatatttctacctatcttcaaggtttgccagacgaaaaacctccattgcttgtcaaaacacatggtaagtaaattatggaagccttgagatgcatcatgccatggaataactttgtagtttgataaaaaaaaacaactaa

SEQ ID NO: 19628 - DNA, 1501 bp, Oryza sativa
aactcaaccgatgcagcattaagcataaaaataagtacaagatctaggcaagatgatgaaaacctataagagatggtggatacaccatataaattggattagtaacgtaacataaccctatcgatcacttcccaacaataaggaacagccgataacaagttataaagcgcaaccaatctagattacagcgtgtatatgataactcgatggattacatgaacatgattaaagtgtcataaagatggaagcattaaccccgagaatgcaagccgccataacaaactttacctctagttgaagatcgaatcgatgcagctcaacccgaaagcaagaactcgtcgaaataaaacgaaagtaaaaagggtggtgatgcgccgagattgtattgaactgttgttttgattacatggtttcgggctctatttatacccgagatacaacatatatccttgccggacacgacacttatctctaacaaactttaagataccataagtctttgcggcatatttttgcccaaacatatctctatggaatttacatgaaatatcctaattaatagatataattgcctatctgagagctttatctccatcgtggcaatccctgtgaagcactttgatcgattccagaaacagccttgaaaccatcttcatcggaatcggctgtatcacctctatcggctgtgttggctgtcctctatccaatccatctcagccgatgcaaactccagtcgatgccttcgcagccgatgcatactctattcttcgaatcgatctctttgtcgaatccgccttaatcccaatgtcgaacctgattcacaatttaccaaatttggtagtcaacaggagtgccacgtgagtaccgggtttagcctcttccctctagccttgatatcctcaggcccatatcaccgacacgctgattaggagcccctagaaagtctcacaaaaccgcactattgattattttaagtttgatctatcacaattttaaattctaccatcacatcttaaatttataatcttttatccatcatataaatattacatgcatgaaattaaagctttttaaaagtttgatatacgactatgtaaaattggttaacgttgtggttttctgaaactttcggaccataatacctgaggttatttttcacgtgtcaaaattactatggtttttgtgcaacttgaatggggttttatgaaattttacttttaaaaattaaaaataagatccatggatcaattagaaaccaggaaatgatcaaatgataagtggcaatcccagctgcagcagtcaatgggctaaacgcttttgggcctccaaatccaaacgggcctaataggcccattagccgacagcccatcaacaacagcaaaattagggaggcagcggctggagcaaacctccactaaaaccctagcctccccgctgctcctctcctccccccgtcccccggcaatggcgaagacgaagcccatggcggctgccgccgccg

SEQ ID NO: 19629 - DNA, 1501 bp, Oryza sativa
aacgagtggtctaacagtgcaagtaaaaactcaaaatctcttatattatgagacggagggggtaatagagaatggagactggacatcatgtcaccgacttatatatattcccccctacactcttgttcatacaaacttttttgatgagttctttaattttctaaatgattatctgccaaatattaacattcttgtcacatggcatggcacccgggagttctcagctaaccgtcactgatgtggttaacaacggtagtgcattgctggttaatttgacaaatacctccttcaggatatggccacgatcgaatagttaaccacaagtaaatactccctctgtttcacaatgtaaatcattctagcatttcccatattcatattggtgttaattaatttagattcattaacaccaatatgaatgtgggaaatgctagaatgacttacagattcattaacaccaatataaatgtgggaaatgctgaaatgacttacattgtaaaacggaggaagtatatgttaaggcagtctgcatgcctaccctagtataccttaccgtcaactctgagacacgatcgaacttaggtcgtgtttagttccaaaataattcttcaaactttcaatttttccatcacattaaaactttcctacacacataaatttttaacttttccgccacatcgttccaatttcaaccaaactttcaattttggtatgatctaacacccccttgtgaactctgagacatgattggacatggaaatggtgttccaaaacgtatttcatcggcaggccggtcaaccaatccgcgcatcaaagaaaaattaaccggtcggttcatgtcctttcccttgtcatcgtgtgaagaatagatagtgatgtatcccttgttgtttcgcttcatgtgtgtttatccgaattgcttattagcaaataaaaaaccatttatgagtaaacttttatatacgtgacattagcaattaaaaacaaatattgtaaaataaagtacgatgaagaaaaaaaatcaaattcaaaattaaattctaaaatttagagtttagctcataagtataagcataatccaaacaatcataatccaaacaatgagacacagtgaacgctatgtccagtcaaatccatatacgctgaagttaatgtgtcgaaaacggtgatgaaaattcttggcggaccgagcatcgtttttataaaaatgatattatttttagtcatttctgatcctagcttatatataaaatttgagttctctaatttgtttcggctatgtattgcaatgaccacttaataattaaattggtaaatatgaaaaattctcaatcgactaattttctaaacaatattgttttcaaccatttttatctagttatcatggatgaccactcctttcacccccgttgataagctctcatgtgccctgaaatgacacatgcattcatgatcaccaatatcgccatgactaattcttcattaatatctattaccatgg

SEQ ID NO: 19630 - DNA, 565 bp, Oryza sativa
ttacaacactaaataagaaccgagacaacagtattttaacttcacagaatgaaggaaccaagatatcagaacatgtcgcttgcatgttatggcaggccaatagtctggtaaaacacttgcagtccattgggccataacaggatgcaggtctgggaaattcaccagcgaattagacagtaatctagttcgatgtatgctcattagtttagatagcattagtaaggtttattgagataagatgagtccggttgaatatatgatctttttaagatctctatctcttgttatattagagataaggtggtgggctattagttatgatgtaagcaagaaaggtgaattggtctacctctccatgatcacctctccctatccccaatctagtgcctcatccctggtcctctgagtatgttaattacttacgatgaactaagattcattgtattcatgttgttttaagtttcgagcttaatctgagctgagcttgcccaggcagcacaaaagctgctaccatttattcactactagtacaattgcaattttctttaattacgtaggggggaaa

SEQ ID NO: 19631 - DNA, 302 bp, Oryza sativa
agcaatattgaaaatgcattttgttgggaggagatacaagaaagaagtccatttgttcacacgtctcaccggatcatcgaaccaaaccggcccaataaccccaaaatcctaccataaaccctagaatcccctccaccccaaggcccagccgccgcctcctcccttcctctcttctttcctcgccgacgacgcgattccccaccggcgtacggcggcggcggcggcgagggatttcgccggccagctagccccatcctcaacaaaatcgaggggtcggttgctctcccggtggaagagcccca

SEQ ID NO: 19632 - DNA, 210 bp, Oryza sativa
ttgttgtaattgcaattgtaaagtctacgtaaaaaacataccggattattcttccgttgccttgtatctgtcattgctggattggagtgtttcgatttgtccatcgtgtgtaatattcagatatataactaatatatttaaatttcacatgaaacaatcaagctgaatggaaaccaaatacctacagcaagaaacatctatggaacgcga

SEQ ID NO: 19633 - DNA, 180 bp, Oryza sativa
aaactctatccccaaacaaaaagagccccttacatagaggggtttcacacagattgaactagattatgatgtgtccacaataccatcggcacgatcatggttgttaaggcgtcgctgtagcagtaaggcggttgcggaggtcaaggcgtccactccgccttatgtttcctccaccttaga

SEQ ID NO: 19634 - DNA, 332 bp, Oryza sativa
gttggataccactctggagttgttgcaatggaaggcaaggaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaagg

SEQ ID NO: 19635 - DNA, 366 bp, Oryza sativa
ttagcattgggcaaagatggactactaatcttggtgttgaaccattaatctgatataaattgtgttcaaaaaatattttctgcatgtaaattctattgaagtagccagagtcatgctggatatgcttaatgcttttaatccttcaataagcacataatgggacctgaaatccttaacttcactaatatgtcatatattatctttattaatatgcatatcttgatatgtttttgtccacttttggaacaaaaagtcactagttcttcccattttcctttggaaaagcctagaaaccagagcaaccctgactaacctcagatctgttaaaattgcagaatatggtggacaagataaaatcttcagtgg

SEQ ID NO: 19636 - DNA, 927 bp, Oryza sativa
ccctctttttttttcttctccctcctttctcttatttttccacctattcttttcttttttgagaaaaaataaaaataaattgctgaattcaagactagaacccatgatctcatggttcataacaaactctcctaaccaattcacctgtatatctgttcaaattttataaacacaaacccgttatgttactgtaggaaatcataccttattattatgattcgacaataacattatcgcagaactgcagtaacacgatacgttattgtgaaatttataggccgttactgcaaaatttataggtcgttactgcactttttacagtaacatcatgatgaaattgcagtaacagagaacatatggtagtaacagtactactacagtaccactgcttgcgcatagctaaatttttaaatctcaatcttatataaaatacaagtgctaaaaaagtgtatgtgcatggtcacaagttaacacaagtgctaaaagtacttctctttatccatacaaagatacgtagtagcaagcttagtataagtgaatttttagaattgaaatctttaaaaaataatatctctcacatcgcaaattattttttagaaccgttttcactataatactttaaaacgatgttacaacgagacaatagtcatattactacacgatgatcgagacaaaaatgcttttataacgttggtaatgcagaaagtagtcatgttactgcatattgatcgtcgcgttactacgccgttacagtgagacaagaacttaaaaaaaagtaaatctcaatctttagagagcaatatctctcaggttatatagtatttttctaatccgtctgcaccatgatgttcgtaaaaaaatacttaacaaaactagatccatcatgactattttttgatgttgttactgcgagaactagatccatca

SEQ ID NO: 19637 - DNA, 1501 bp, Oryza sativa
tacatacacgtatggagaactgatcgatcgatcgatcgatcgatctatgcgtgtgcaggtgagggagctggagaactgcccgcactacaacgccggcgtgggctccgtgctcaccgccgacggcaccgtcgagatggaggccgccgtcatggacggcaacaccttgcgctgcggcgccgtctccggactctccaccgtcgtcaacgccgtctccctcgccaggctcgtcatggagaagacgccgcacatctacctcgccttcgatggcgccgaggccttcgccagggagcaggtcaataaaatcaccattgctcccaccaccatcccctcgcctttctgcagactgcacacgaatattacagttacagtatcactccatgaagattcagataatttctgattatctttagctcatcgctaatttctcgctctgattatcttctcgtaaaataaagttctttctctgaattttattttaatactatcggtaaatcagcaataaaattcaggtcaactccactgttttgttccttgctctgatgatctgttcggaaatggtagaaagaagaccctcttctccaagattgcgtcacatttcttagaccgaatcgaatacaattggcgtgattactacgtatgattgattttattagtagagacaactggcactacatgagttcaggtgtgtgttgcatgaatggaaatagttgagtatcacacgtattgtgtgcaccacttagcttaggagaacttctataagggtgcgtttggttgcaaggatggaataggatgggatgggacgaacccacttttgaggttgtttggttgagcggtgagtgggatgggttggtccctggagaggaatattcctctcagatccgggaccaaccgatccggcaaattctggcggacgaactcgtcccagttgggatgagcgaacggcgtgacccgctcgagctcgaggccagcctgcgcgctcgccctactcgccctcaggagcagcggtagacaccggtgggctcgacgacagcgaccgtggccgcggcgggctcagcgacgtcgacggcgaccgcagcgggctcagcgatggcagccgcggtgggctcggcgacggcgaccacggccgtgggagggctcggctcggtgaccgcgggggactggacgacggtgaccggtgggggctcagcgacggcgaccgcggggggctcagcaacggcgacggaggatctagtagtgggaagggcggtggaggcggatccgcgtcctctgcctgctcgccgccggcctgctcctccaaccgcacccctgctcgcccgtccgtgctcctcctctgttcgtccgcctgctcgcaatattgcgccgctcctcctcctcgccgccggcctgctcctccaaccgcacccctgctcgcccgtccgtgctcctcctctgttcgtccgcctgctcgcaatattgcgccgctcctcctcctcgccgccagccatcgtcgcacctccgctcg

SEQ ID NO: 19638 - DNA, 1501 bp, Oryza sativa
tgtatagaaaccttttataaaaaacacaccgtttagcagtttgaaaagcgtgcgcgcgaaaaacgagggagatgagttgggaaacttagggtaagaacacagagtactaaaagcacactcttgttcgttttgtgtgtaatattcatgagctgcattattttatcgttttgttttttttttgttttgttttgtaagctaaaagtacttagttttgtcaccacactgttagctcatatctatatctatactactacttaaaaaaaccgtagtggtgacggtgatttcaaccctgtcagacacgcgtaatactaatcgtacgatcgtgagatcccacgcgctcccctcctacgcatctgccccatcactgcatcgtgctcctcctcctcctacatcacccccatcaccaaccgccgacgtgctcgtctccgtcgctccccctgccccattccccacgccgtccagtcccctgccgccaccgcctccgtcaaaccgctgctggtgcagggaggactccggttcccgatccaaccgacgacgcgctcgtctccttctgctggcgtggggagggcattcaccatcgccgtcgccagcgctgggaggtgcccgcgtcgtcacccgttccccacgccgtccagtcccctgctgccaccgtctccgtcgccaacgctgggaggtgcccgcgtcgttgcccgttcccccatgccgtccagtcccccgctgccaccacctccgtcgaaccatcgctagcgtagggagggctccgcgcggcggactccgaaaacgccgctgccttctccctccctcgcgaaggtcttgttgtccccactgattcgccgctgcgatgcagtccactcccccggtcatgatctccatcatcgtcgcgatgcaagtctccctctaaagttacatatccactcctgcgccacccctccacctcctctctctctaccaacccctaatcagtcaccctgctgcaaaaaaacatttagctgctattcagtttcagaactcacctctttattaatacatttagttgtttttttttatcaaactacaaagttattccatggcatgatgcatctcaaggcttccataatttacttaccatgtgttttgacaagcaatggaggtttttcgtctggcaaaccttgaagataggtagaaatatgcataagctttctagcggatgttggaaactcaacaaattttggtgcgttgaagaaagaaccattctgtacaacatccgttgagaatgaccaattgaataaattatcctgtattaaccgaaaaaactaaagtaccatagtcatattctagtattatccacaatggtagtaaggtggtgtttgggaaagagtgaaggagtgattcccaaaacaccactaaaaggcggactgacttatccttaaaaaaactaaactgttgccttatcccttcctcctgttcccctctgcctgccttcacggagaacacgccgccgcacgcccgcaaagttgtcgct

SEQ ID NO: 19639 - DNA, 1501 bp, Oryza sativa
tactattaccactttgagttatatctttctttctttggatatatctatatatgtcaaatttaattactgatgtactgatttgaattatattacaaattatgttctgcaggaaacaaagataacaaagatgcagaaagaagcattcagcatggaaacattcagaatatgactcaattagttttgacagaacataacgcaaatacattgatttcaggtaagaaacataattagtttcaaatataatctgcaaagatcacatttagacaaaacatcatagttaaaataaaatttagctggtttgaatcatatattgtcaaaatatctgtcaaaaatagataattagtgatttcatgatgacataaacaatttcatttacaaataaatatgcagacactcatttactatgtagatattataattttcaaataagttacagtgaaataaaattaaaattacagttaagaaacactgtaattccaatattagttcactgtaactaatgaaaaaaattaacactttagttaaaaaaatatcacagagtgatattgtgtatttgcacagtcttaatggtcttaatattcatatatatgtctagtaatcaacataaaaacaaattacagtccaaaaattaaaaaaaaacatagaattaacactgcaaatagagttgaacatacatgtaactcctagaagcagtatatatttcatataaacaagtaaagcaatttgatttaccttttatttaattttgttggactctgcagcaaatctgaaaaattcagagaaaacaaatcattactttcatattttgagttatgtttatatgcagagactaaaatgagtaatgagtaatgagttatgtttatattttgagttatgtttatttgcaggcatctcaagaagaaataagcatcaacgacaagatgaaattaaatagagaaaaaacaaattcaagtgatgagtacaacaattgtactctacatgatgaatggtctcttttaggagtaagttttggaatgacagaatttataatatcaaacaaaaatcagcaatacatgtcataaaataaatttgttttcaatttgcaggctcaaaatttttcatatacaagtctcatggaacaaattatatcatctcaaccttcaatatctgaagttcaggtattttacaagtgtaataaatgtaatgttgaagacagataaacaatattattaatgtgtaaaactaacattttaaatttcaaatgcagcaagaaatatcaacagaatcaaactttgttgctacaccaagagcatttcaggtactcacatatttcataagaagaaagaaaatagtaaatatgtattaaattttaaataattgtcttattatttgaattactttttgtgtagaattcaatgatattgacaacaagtagaacataagatattccttttgatatggattatgctaatacaaatcaggtatgaattaatttatttttttgtttctataaatcgtattt

SEQ ID NO: 19640 - DNA, 1501 bp, Oryza sativa
tgggccatagctggattatcttttcgttttagggttaattagtgtggtgtttgaatcttctgaagatgaagattaagtgtttcacgcaaaatgagatggtagtaacgtgtgcttaattaagttttaattattacaaacttgaaaaaggattaatatgatatttaaggacaactttcatatagaaaattttcgcacgaaacgcaccgtttagcagtttgaaaaacgcgccactttaatctaaaatttaatcatccttttaagcagattcgaacgggatctatgccattacaacttcctcgatttttaaaaagaaattatttctactagcctatttggatgcatatgctattatatttaaataaaaagtgaaatatatcaccacttaccccttcttcaatacatttataaaaaaacttgaatcaaattatccctcatttttcgttcaccccttcatctttctctctctcctgttttatccgggattcaaatgaagctacggcaaccggtgacgtggtcagttgactgggatgagtcctcactcctcagcggtactttattgccatattactgtttttttaaaaaaaatctaccacaacacaaaaaccaagctggaataaccggaccaaccgaaaaccaagagaatcgactcttttctgttgggtttggtttttcattgtacggtcaatttatgctcatcacggctaaacctgctgaaaaagtcatgaaaaacgcaataacaaacaatagtaactgattaaggatacataaatgattaatgatttatgggataaccttctgctaagcataatggaagtgtgggttaaattgaaacagccatatatttgggtgcacatggcaccaacattggaggatgcactatctttatgctagttatttactcaacataaatttaggcacattaataagataatgtcagcactagttcacttacctctaaaatttatcacaagaatacaatataatactacaagctaggagtagagaaaaaaaaggtcaacaaagaagtatcctgacccagttaaggccatgtttgatttagcttaggattataataatctgggttattaggagtagcttattacaatctataagctagattactataatatagtaatccactctaactatgcttttttagattattgggtggctaacagctaacaaacatctaataatctaaagaaacaaatagcttatagtttattctgtgttggcttattataattcaacttatagtaatctggctcaataattgaaattacaataaccttaaacttatacatatgtaatatgacgaccattttgtactctcgagctttctttagatttttttaattcacgtgaataaccaactagtttatgaattgtcaaaaaaaacccctttttttgtggggtatccaaaaaaaactttatgcatagtgaggctggggattgagtcatggaaaaagttcccaaagtcccttctttcttaaaaacaggg

SEQ ID NO: 19641 - DNA, 1501 bp, Oryza sativa
aagtccacggccacgtcccacttcttctctgatcgataatgatggttcatgatgtagtgtttgggttaaaatggtcagggatgttcatttgggtttaaagagagagaacacaatacgtcgtgggcttggcaatgagtcaaagggatatttatgttgtagttaggtccggtgaggcagagtcaaggtagtttggaaaggttgtacaattaggcaccaaaatcatgcaagattttttttataggatatatctaaaaatctggtgatagtctttctcatgaataatctactactccatattatttcatattataaatcgtttgacttttttcgtaatcaaagttatttaaatttgatcaaatttataaaaattatgcttacattttcaatacaaaatcaaacatatttaacgttagatttcatgaaaatttggtgttgtagatattgctaattttttttataatcttggccaaacataaagaattttccctacgaaaaaatcaaacgacatgtaatataaaacggagggagtatcagaataaatctttcaaatataactatagtataactttcatataattactctataattacgatgcccatgaacaggaggaacttttcatttttataaccaagttttgtacattggaagactttaagtttctagccataattcctattaaagccttcctctcaaagttctattgaaaatacacatatgtaaaaagttatgtggaaagttcaaaactttcagagggcgaaggctttgtgtgggtgctaagtaaatgtacaatgatcattaataaagggttgttagtcttgcttattagaaatagtagatgataccccacgcgttgctgcgggacttagttaacatcaatttattagatatgaggtacaatctcaagaagaaacaaatagctttcttagagaaattttttttaacagccctatccaaaatttatagataatttaggtagcacatgtcaactgaagaaacattcagccataaagctcttttatacggattgacgggttggatacatgtagatgtgtatagagatgggccaatgtgttcatgtaggctacatttagcattgaggaggcgaagagacttacctggtaactaatgggttgggctttatgctgcattccatataacatctgagaagtgatctaatgtattcatccaacggttcacaatttgatgatgacgtggaagcacgaggtttgagcttttagccttaactttatagaaagaagggatttgttgacatgaaagaaagagatagaattgagacaaaacatccttgttatgcttaacaacggctcgattcttgcctctataaaatggaaacaaccattgtatgatgatgaaaaagaaaaatgaaataatagtaattagagtgttattttttaatagttaagtttttatcatctcatctaaaaacgcgcggtcttaataatcttgtactccgtataccattaaacatgtcctatgcac

SEQ ID NO: 19642 - DNA, 1501 bp, Oryza sativa
tggactagcttcgttagtccatatatagttgcaattttgtactcaatatatttaagatagtcaaataaaaatctcagcctctacatcatgtgatgcatatagctgtgtaattttgcttctatgtggtgaggttatattcagtcggataatttggatcatcgagagtttctaattattatgatactctctttttctttattttgaaatgtttctaatattgtgtcaaagatagttcctaactcccataaccttaagagttttctatttgacatttacaacatgggtaattatttagcataggccaaatatttgaaccattttttaattattattccaaaaaagataactcagaccaaatgtttgttttgcgttagctaccgatcgccgctgcaacgtcttgttgctttttaaagcattcgtcttaattattatattttcctatttgattggcaacgacaatattaaaagtagcgatgtgttttctttctccacgagcgacaagactacgtttagatataacagccgattatagagaatgagactaaccaaccaaataatttagtcattgtatgcactgttgtgtttgactgacttcattagccgtcggttttaattttgtactcatgtggtgagtttatatttagttggatatatagtattacgacatagaggataaccgagagtctcttattattgtgatatatacatttttcttttgtattcctattgttttgaaaggttttctggctctaattgaaaagttctttttattgggcttttagaacatgtgtctattggaagatgtgaaacattttcatttttaaggaaaaagattatccaaaatactggctacaaaatttcaacatgtcatatactcctatatttctagaaaaaaagataacttatgtgagaatgattagaggaggtcattcaatataattaagatagaaaaagaaaataacttctcctaaatccccccgagtatgataatagaaaagagataatttccaaacaactaattaattaccctaataatcatgacaagatcggacagcagcaaacaaagatctatcgaatcttacattatctagctctctcttactcctccaatctgatgagccaaaaatgatagtactccaacaacactaatcattgttaaatcacacaaataattagcaagtcgatccagttttagcatggagcagcagaaggggcagtttaacttggggtgtgggccccacccggagcacacagagagagaggtgtacagatggcgggaaagtggggacgtggcccccatcctatcactcccccactcctccactcgcgccactacctccatctccatcgatcgcgcgcgccttctcctctcccgccactccatcgccgctataaattgcaacgcaccgctcgatcgatcaagaagaagaaggggatttgattgattgattgatcggagcaaggatggcggtggcttgtttgccggaggacggcggcgagg

SEQ ID NO: 19643 - DNA, 1501 bp, Oryza sativa
cttaaccatctgttagcaacttttttttttacaagaagacaatcacgaataggacacttaaacgtcttgcggtgatatggatttacaaaccacctcgatttagacgaagctaaaccatgatgggttttgtaaaactaaaccggctagcggagctgatttagatatcaaaattagcctctagaatgatttagattgatatggagataattaaccacccgtcgtaggcgaatagggaaatagatgtgtacacaagatagctaactgatattccctgttctcctcgtttgcaggtagcaaaagttccaaaatattggttagccgatacaatgcaatggcagagcagctatgccagctcttattcttcaaactccgcctagtaggtcgcccaactggttgcgagaataagatttagcgttttctagtcaccctcctgtacctcgtccccctctctttttcgtttccgatgtgcataaactttattcctcttaatacaatgatgcgctccttgcgtattcccaaaaacaatgcaatggctttgattgaattttgttttttgtttcaatggatgtacgcaacagagagcaaccacgtactgatgggtaggcttcctagttggcttgtatatgccgatcaacgtacgttgaatcggctcctagtttttctggatcggccaaaataggaacacaagagcgaaacggcaagcgctgaagtcctgatggccttgacgaattgatcgatgtccgtatctatctatgcagcgtcgtcacgcggctgcagatatataggaaaaatactcagcgacggcggctttcctcggactcactcacggtgttgatctattcctgtaaactcaccttgatttgattttctttaatttttggcagcagatcgagagcaatccgattgctgttgcggatgaccggacagtgtggctgccgaatacattgatccagtgtgtaatacgtagacggcggcagtgaatgtatgtggattgatttcggtcggatatatagccgaaattttttttacgtttcctagcatagtcacaaaaaatcgtgttggtaactttcttatagcaagaagacaattacgatcgggacacctaaacatcttgcggtcgccaaccaccttgatacaaaactaaactggctagcggagctgatttagatatcaaaattagcctctagactgatttaccgtctcgtggatgaatcggaaggtttacgggataaacctacaaagagatatcgcacccttgcagtgaagtcggatgatttgtggcgcaaatcaacaaagatggatgaactattgttaggtagaaaataaagtagaaagcatggctgaaaagtaaaggtaaaagaacaattcgatagattatagggattgtggtttgggggttagaatcgaaccgaccatagcccttataaaggggtcggtcctgttacaagaccctttccatgttttattgaggatagtgaccaattagaactcaaaaaatacc

SEQ ID NO: 19644 - DNA, 1501 bp, Oryza sativa
agagactgctgaagtgaatgattgatgttgtcccataagcaacttccgaaaagaaaaacaagctacagcaagacgctactctcctaaatctttaaaaacccccagcttcttttcagatcacgacctactctttaatcaaggcaaagaggatgcccgccactcggctctaactctggaacacacgcacatctctttttcgggaatacgctagatgcgtatttttgcattaagaggaataaaacagttctttacaaacacacgcgcatctctctccttccaaaccatcccgcagattagcagcacaagagtgtcgaaagcgccctgtagctggtccttccaaacatcaaggcaaaggcactgttattttctcaaatatatcttttaaaaatcttttttctctttatttttaactctaccaaggaagttaattaattaccaaggacaaaggttacgatatttaaagcttttgggttcaagtcgctggtggctggatgactggatggatccccactctccagcaatggcggcaaggttgtacttcccctatcctagcagcgatgacgtccgccacgaagtgagaaggaagccgagcgcggccggcgatggagcggccaaggaagccggcggcgacagctgcggcgccggccggatctggagacgtcggcggcagcggcggctcgggttcttcctgcaatggcggcgactgacagcaacgttctgtctgcttctttcgatccaggtaactcaaatttcaaggatctgtagccatatttctcagaatacttcaattctccatataagcgtattgatccccaaaaggaatttcagaaaaaaaaaagtggttagcttgtcagctgattccttgcacatccatcaaccatggtaggaaaacattttctgaatgtttcctccctgtccatgacattttcactagtgttgcagtcagacaagttgaaaataaaagttgacttggaattaactagaagcaaagccttgaattttgacccagagaaaaaaaaaacaaggactatccatgccagctgcaccacaagcacttctcaaatttcaacagttttaacatgttgagtttcataatgaagaagtttgccatttcttttgttcatgttcgtcaggtcctttctttttgtcacatttgtagaaatagaaggccattgcagtgtctagaacgcggaattggtcaactaaaaattcatgtgactgtgaaacttgacgagaaaccagtggtgctgaaccaatctgtagaactttctttactgctttcatcgtcaccgctatgtggacagtcttgtatggttattatattgttgcaaaatgtacaaaacagatacttgaatccaaacggttcacattaaaaagcatatctaggttgggatactggactatgtggagcattcaaagtgtgtttttgtaaaccacagtataagagtatgtggcagccttaattcctactctgcttcacctgatcctttaaaatttttca

SEQ ID NO: 19645 - DNA, 407 bp, Oryza sativa
tgagcagcgcgcgaatctgggtgagcagatttgtctcacccggagatacggtaacgccgcttcggtcggcgagcgtaattaacgcgcgcacgatacaatccattttgattgccacaaccgcatatccacttcatgcgccataagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgcttccttcctttcgccattgttcctcttgccttcgccgcctgagctctaactctttctctgccacgccctactttcgccacacgcgctcgttctcaatcatctcttcctccaccgcca

SEQ ID NO: 19646 - DNA, 1501 bp, Oryza sativa
  unsure (1)..(1501): unsure at all n locations
actgatccccaaaagaaatttcagagaaagtgtctagatagtccagaaatgtaccataattctatcgttgaagaaatgtagctagtcagatgtataaataggcagaaatggtagtagggaaagcattttctgaagagcaattttacggtccttgaggaggtaccatgaggtaccaaaaatttaggagatttgctccggtccagaaaaagtaccttgaggtaccggtacctcacggtactaaatcgtttgcgatcgttgggtctagctgggcaggatgggcattgttagatccaacgatcggaaacgatttggtaccgtggggtatcggtacctcgagttattttttgctggatcggagcaaatatcaaaatttagtgtaaaatttggtatcttatagtacctaggtagcaagagataccaaatttacaatagaaaaagtggtaccttatggtacctctttaaggactgtaaaattgctttttctgaatgtcgtttttgctggtcctcactcctcagtcagacaagtagcagcaaaaaaattgactctaaattaacaaaatgaaaaaaaacttgaattttggcccaacaaaaaaaaagaaaaagaagacttagaatttgtactggggcataacaggggaatttattaacttgtaataggatggaaaatttttaacagtttaatggaaaattaatttgggacaacaggctttttcattttaacatgttacatgcatttatcatttttcaacagttttaacatgttgacattcataaaaaaaaagtttgagatgccttatgttcatgttcatcaagtccttttttttcacaatttttcgctggttcggcaataactggccggaatatactaagaggtaagaaagaatttacaggtctcaaagcacgccgagaggaaacggcgtgctatcacaacaaaaaagaaagaaaccctctatacacaacaactatgggggaaaaccctcgcacccactatacaactcaaagagaggtggtcaagcccgcttcttaccacaatttccactcatcctcaattgacgcacaaagattcaccggtgagactgcgtgcccctcaaagacacgagcattgcgttctttccaattagctaagtcaccaagataacgcccgcatcaaaacaaatatttttttgtcacattagaaggctattgtgttgcctagtagtagtatgcagaactggtcaactaaaatatacacgtgtctgtgaaacttgnnnnnnnnnnnnnnnnnnnnnnnnaatctgtaagaatttactctacttctttcatcatcttcacaatatggtcagtcttgtatgattatattaatccaaactgcagagaaaacctgaagcttatattcaaacggttcacactgaaaaataaatctaggttgaggtaaatcacagtgcaattcgtttccttttatgaagacatggagctgctggaatatgtgccagcctcaattcctactctgcttcaccagatc

SEQ ID NO: 19647 - DNA, 1501 bp, Oryza sativa
ctgtccctgcctgcctgattttgttgcatgcaactgcaagacaggtcactgaaaatctgaaaccacaatggatgatgcagtgtgagatgagaggacatgctaatgctatgtgaactgtgctgtactagtgttgctgggaagcacttggggtttggtttaggtaagcactgtagcagttgcacttgaaatgtaacacaaaacatggtatgaactggaatgttataagataatggaactattcaagtaggggcaggttggccatcttttttgccaaactgatgaaccttttctttttgtgatttatgtggtcagtaaattatttttccttgtatgattttaccatgcatgataatctctgctgacggtagaaatgatctgatctgtacatcctatctttcttgtaacactgattataagttacattaagctgtaacggcataaaacttatacacgttcttagtgacttaaaagcaatgctgaaaaaaaacttcattaaaaacaacttaaaatgagctctaaaattaattttaaaattttaagttttgtagcggctgattcgttgtagaatgtcaggaacatttcctttcagcatctccagaatgtcaggcagtgattagcatgccaaatggccaaccaaatgatggtacttggatggtttattctatccatttgttgattatgcttgcccttcttggttttttacctgaagaccggtgccgtcttttgaccgggcaaagaggcatgcttggaatcatgacggccagcagcttctccggcagcaaaccttaaaatgcctaaattgctcatcagatactcccttcttttttccttaggtcatcattatccatttcgttgtcatgataagggcaaatttgtttgcctttagttcaaacaacacgtgctcatgatcatgaattgaacacctatattttaatcagtgatccagaatgataactttgaaaaaacaagtctagatatatatttttagtaaatatttggattagcgccaaccatttcttgcatggtctgtgcggtcattttttgacgtgtatatttagttgcacataaacatataaatactcgctatctgcctacacttcaaaatcatcaggttttgatagtgtatatttagatgcacactcactctatgcgcgcgctttaaaactaaaaacatcttttattatgtatattaggatgctctgctcatcacgtattaccaaaaatataaaaaataataatgaaaaatatgatggcagatgtttctctcaaactaaagaaaacaagccttgctagcaattgaaagtatctaaatattgaaactgcttggagagagtgtgtatgacaaaaatatacaatgcatatatttgaaaagtgctgatcacactttctaatttggttccatgtgatggtcatttttgagttagttgaggcatgtcctggattccaatcatgtgtcactggtggagaaaccctttgcagtcccagttcgtaaccccccttt

SEQ ID NO: 19648 - DNA, 1501 bp, Oryza sativa
ctcctccatcgacggtggcaatggtggccccaggttcttggaaacctaggtcatcatcgccgtcatcgatgtcaacagcgggggccttctgcttggcctcacttcgccgtttgccggaaggatccgccggggacttgccctcacggcgttcctgcctcctgtcctcctcccacttcctcgttcgctcagctaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtctgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatagtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacaccctggacgaagaggcaccctccattgcgcggggagcacgccgatcactacgtcggcgctcaatgtcgaggcgggcatccggctccccatgctgatcctcccgagtcgaaggtgtcgacgagggagtggcagccgaatgacgtgcagccgccgccgctcgccgtgccctccgtcttgacgacgcggaaccggtagtggcggcgcctgaggtcctggtggtggcggaccgtccgccagcacccaggcgttgctgcgccgtcatgaccaagttggccacgtcgtccagccatcgctgggctggagactccgggtcatggacgacaggcgggtgtcgtaggagtgcgccagcagcctgaagcgcaccctgaggcgtgctgccgtcgccgtagacgaggaggcgacgctccccatctcgccgttctcctgcatc

SEQ ID NO: 19649 - DNA, 1501 bp, Oryza sativa
cttggttcattcacccgatccaaagctttaatttgatctgcagcatacatgaatgaccaaatatgctggttcttcttcttgaactctctcagggttgcaagaaccaagctccagtaatgactgttggcatttgatctcagcaatctactgaagacattggcacccatgaaacacccttcagtttctattgcaatgtccatggctattgatgccatttcagggtgctctgaagcatccatgctcccaaatgttctcaccttgaagaagtaccagtaggcttccttggataaaagctgtaatctgagaggtggtgtggttcctaacctcgcaatcttgtctgatcggcttgtgactatgattttactatcgcgaggaatgcgagttttgtatatcgagtatagtctttccaataaaaccccatcgatatttttatctagtccttctgaatacctatccccatctagttcaacaatgaccaacacccttcctacacccgaggcacggtttcgatgtttgattacaccgccatctctaagatccacaatgctttcatcttcaagatcggctcgagtgaagaacacaatttgcgagaaatgattgcgcaccctttcatcgttgcaggcatgctcgacaagagtactcttcccaactctccctggaccaataatcggtagaactcctggttctagtgtgctatgattcccaggttgtaggagaaaattgatgagatattccatctccgtctggcgcccaaacatgcactggtccaagatcaagtacatgctatacggctgacgatgaaggcgagggcaactgcttaagaatgcaatgaactcagtagcatcagcaatggtgttctccaggtccccaagaactctctgcagctcacccaaactctgactgctactgtcactgcagaaacggatacgcttggcatgactgaatttagagatggcaaaagatggactcacttcaccatgatgatccttgccttgatgagctctgcacctgaaggtgtccagggtgtagtagcctctgaacatctccttcctcaggatgctcagctgctccagcatggcttggttggtgatgcaccgttcttccgcctcgtcgacgatgatgcgaaaccgcagcagcagcctttgcaggttctccaatctttcatcgtcgcttggagccggcttttgctgattcaggtatttgcttacaaggaaagatatggatctacctgcaagttcagtcaggatgacagaaatggttgcctccatgttggctggagaaaaccttgcagaatggttctgcaatggaatgagttacctctagctagaagtataacttatattatgtgatctgaaacttctgattgtgccaaaacaagtttttgtattatctttcaattaggattaggattaggagtacaagttgtaacaactaacaacaagcaatgagtgatcagaagtcaaaattggcaggggataacaaattacatagaatcaattag

SEQ ID NO: 19650 - DNA, 1501 bp, Oryza sativa
atacctttttattaagtaaatttggtccacctgtttgttttaggctgggctggctaaaaaaaatagtgcccatttgatacggttggatgaatgatagggttaattaaatctcctattacaaatttgtcatattggaaaaatgatattattatttatcaaattggctcagtgtcataagtattttgtaaaatttaaattatgccattatatatgtatgtacgagacgtacttgaaccaatattttgcgtaacgtatttttcctacccacaaccattgcgcgctggtctcctcccagccagattcatacgtggggggtgttacgaaaatagatgcacaacggagacacgaatttttacgtggaaaacccttgcgggaaaaaaccacgggcgccgaccggtaatgatcactatagaggagtttattacaaacgtaggggaataacaatgggaacgtcaccccttcccatacggcttacaagagtatatatacgggataatagaaagacacctaataggactctgttgatagaaaacacagggcctgggagatctgcttaactccagtgcatgtccaaaactcgccttcggatgtatgagcgtgccagttgatttgatcctgcaatcaacaagaaacaaagacaaagaaaccgtaattaaatccataaatgatagccgatcggctaaatgccgatgacatgtcatttatctttgagccgatgtcatatgtaaatcgatcggcaattgttaagaaaacaaatcagaactaaatctactcgatcggctgcaaatatcaatgatacataatccttatatcgatatataattgaatcaagtgattgggatagatcggtcaccttgccgagacagtataaatcacttagatcgaaatatatattaataatgagattatatatatatattcatagcatagctgatcagatagatctagcgtgtatcggctaatactccgatactactttatattaagatattaaagcaaatagaatatactaaacagaaatctaatatacttaaatgcaacaagatcttaacatgaaggacagatctaacatgttaattgagcatgtagaacaaaagcaattggatcagataagatcggctgaaactccgatactaccctaatcggcaaccagtaggcaggctagagattgaaattctaagcacggcttaatagatcaaactcaactgatacagcattaagtatgaaaagaagaacaatatctagacgatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataatttgacggactacataaacaagattagagtatcataaagatggaagcactaatctcgagaacacaagccgccataacaagtttacctcttgttgaaga

SEQ ID NO: 19651 - DNA, 1501 bp, Oryza sativa
ccgaataccttgtgattcatgatgagtatcacacatgttctgttcagaacatggttctttgtcgcacaaactttactcggagtgaagctgaagttcccatgttgagcatgcaagattttctctttggaagtgttagacctcaaggaaaattcaaggttcttgcgtggaagtctcaccttccgccttactacaaccacatgttcaactgtgaggtacagaggaaacatcatgtggtcgccaaaaagaagagatctctggaactttgcagctgacaatctggttgttttctgaagctgtgctcctgctgaccatgtgttgtatataatgtaattatcttatgctgtaatgtaaaactgatcatttgtgaaatgtttttacctagtatctgagcgagtatgtcatccaagatcctatgtaagatgtgctatttgtaagaggttgccaaactgaactagtcagcatctaataattttctgctatttgaagtttgaagatgtcaacatgctaagacgcaaggatattagttcagaagtcgatgacaactgacagcaactgattgatcctatgttaattgctactccgtattacctgccactgttgacctctgaccatcgattccttgttgcaacttgcaagaaagcatcctaatccttaacgaaatacagtacaaacacgtattggcacgatcagacgtttaagatcacataacataggtctgatatttccaatttggtcggaaaatttcttcccttttttttttcattttttgtgaatttggtccaaatttagtcaaaattgtttaaatttcaaattgtttcgttctgaaaattcccaagatttctgaaatttctctgaacccccgtgccgtgaatagaaagtacattttttttagataatggattaaaccagcctctacatccaaacagatgtacacaaccaaccaaacttacaagtagaaatgtgcgaaatgaaatcgcaaacaatgattccagcgttgcctttttccggttcctctgactgaatttttaatctgggatgataactagcctaaccttcttctgtgtttgcaaaatgagtagttttacaacaagttaattaaatctgtataggtcaataattgcttggaggaattagttattgacgaaatatgtaaaagtctatagaaaggtgtagtctccctgtatttggtcaacactggtcagaaaatacaagaaaaaatatcatgcacaacgaaagtctcgctttatagtagattcagtacttgagtcatcaaacagaactcttaagcaaatctctcaactctcaaccccaaaaagaataattggtgttgattgattgcatacttttctatagaaccactgcatccacaaaattttgttcaccatcaatcgatgtcattttaattactagtcaaacaagttggcatcaaaaaaatgctactcagacaagctagagcacttgccattatacgattgcaggattcctcttattctggttgttg

SEQ ID NO: 19652 - DNA, 1279 bp, Oryza sativa
tccgttgataggctacccctgtcagtgagctgtacttcctcccatagaagacgtatatgatggcaccaaccgctagccacatcgaaacacgaatccacgtatgaatcctgcgaacgatgaatcaaagggtgtgagtacgtgtgatatcagatatgataatatccagatcgttttcagaagttgctaatctcacaactcacaagtataggtttagatagttcattctattttaatctatccagatcatctgtttacagtgtattgtgaattgaataatggtgattttggtttcatgattttgcaaatctactagataatataataggagacggtgcaagcttcaagatgcaaagtaaatcagagcaaaagctaatcttgaacccaagttgctcacccaaggttcataagcaggtatacgttgatgagaatgcaacatactggaagtataggaacaaatgggcacataaaacctgaggaacaaaggagacaatttgatgttatttgtaaactgtatagatcagaagttacataaattttgtcaatttcgtagtagtataatggccatagtctttgtacctccggtttgtcttaaagagctcttgtcttgcccaatgaaccagagtgcaatggtagcactaaccaaaagcaaactaccaaaggcacctgcaatggatcgcaaaaatctacagaaaggaaacagatcaaatgagtgggtgtcaagagcaagtcaaaaaaatttgcagtgggtggtttcattttcacttacaacggaaaaaaggagaaagaaactgaagaaacaatggtgacaaccccaagaaaaattagtataatgcatgctatggctttctgtcgccttatcttgttggcttcattggcagtaggtatgtcttgaactgaacgcattaagaagggggaaaaaatcagaaagttagtaactatgaggctgttatacaaagtattttgaaagtgatgaactaatgacaaacagataatacattaatatcatgcaaaggcaattgagaagtgggattacaaccataaaacaaaacaatactaaagaggagtcatcttttttatcaaagtatcaaaccccctatcccaaaaaaaaagtatcaaacacccaatttatgttagtagaggcaatctggtaaaggcaaacaggaagcataagaactaaatcaggcatgtgcagtacttttgatgtttaattagatacttcctccgtattttaatgtatgacgccattgactttttgaccaacgtttgaccattcatctta

SEQ ID NO: 19653 - DNA, 435 bp, Oryza sativa
ttcattgatagattatttttctacagaaaaatgatagcattttcaccaccaaaacataaccaagacaagaatgcacccacaatcatggccccccatgaaggctgaatcaataataggcaaccttttcaatactccattaccataaacaagaaagcggccacctttcacctccctccaaacataaaccaacaagccgacgcttttgacacacccccaaatcaagaaagatatgaaaaaagccctaacccctaccaaattcatcacaaggcggcaatattttaccccttcatcaagaataagcacaacaaatgccataaattcgaattcaaccagcaatcacatacaatcgccatctccgcactcccccaaaccacactcgatttcctagggttttagccatcgcattcagatgagcaaagagttgaaagaatgggg

SEQ ID NO: 19654 - DNA, 308 bp, Oryza sativa
cctgcagccccgatacttttaatgttaccgttgcccatcaaataggaacggataataattaagaggaacaattaaagaagcaacgatgaggacgacgacgaggaccggcagctaaagcgaaacaagacattcggtcaatcggctgctaatttcctcctgtaggtcgatcgatcatggggaagaagagaactgtgcatcgaccatgacaacaaacctatctaatatcgatcgatcgatcgacaaaattatcggatttatttatactacacatggtggttcgccatttttctgttgatcacacctgcagg

SEQ ID NO: 19655 - DNA, 340 bp, Oryza sativa
tcagattaaattgggagctgtagaaattaatgaactagaaaatgctttcgaaaaaaagattatatgcaccgtcaaaatattttttatataaaaaatagcgcttttgatgatttgcttcacattaaatcgggagcagtagaaattaatggaattttaccactactatctcgctaaaccgtagaagtgtttcccaacaccgacacataaaagtcaacgcccgacttttccggctagttgttgttttaattatcgagaaaagtcaactgcctaccaaaacaacgagttcttgatctctcctccctcggtcccctcccctcagccactcgtcgtccctcggcca

SEQ ID NO: 19656 - DNA, 1501 bp, Oryza sativa
ttagttaataattagataattatatagtatgtgtagaatcccagtagtttttttttctagattcatcactgcatatcctacatatatcaaatatccttttttctgaaatttttgggtattcccacgaatacacgtaatatccattgcgtccgctcatgattggtaatttggtaccaccatctgtagatctcctcgcattacttgtagatttcaatttccttcaaaatgcacaagattaagagaatgttttggctaaaaaaacaagtgtgccatcacacatttggaatacaatattggcttaagcttcagagtttcatctcacctagctatgatcatttttgctttctcaaagctttaatcaagaagtaatgcacagttgatacagggtaattttagaccgtcaaacaaataacttttgtttctagaaaataaaaaaaatggtcctttcaaagtttatggacatggtacaggcatcatactagaagtttgtcaccctggaatatgggctcccattttcttaaccctgccatcatccattgggcaacgttggtgtaggcaacagcatcgacgctgctacgcaaatgattttcctgtacagggacccttttacattgcgtgcggacggtaacagaaaaattggctcattttcccgtgcggtccatttaagaggaccgtgcggtcctcttaagtgaaccacacacaaaaaaaagagtttattttcgcaggcggacattctaactgaactgcacaaaaaatgctattcactcccacacactttaaaattttcacctactctctacgcaattagttatttttagcctatatttaatattttatgcaggtgttcaaacgttcgatatgacaggggtaaaattttagagtgggatctaaacaggctcttaataaaatttggtcagggttttacttcaatgccgatccgaaaaacttacaaaggatgtgtttagttccaccggcaaaaaaaattgccgggtcacatcagatatacggatacacatttgaagtattaaacatagactaataaaaaaacaaattacataatccgcatgtaaactgcgagacgaatttattaagcctaattaatccgtcattagtaaatgtttactgtagcatcacattgtcagattaggcataattaggcttaaaagattcttcttgtaatttacacgcaaacaatataattagtttttttgtcaatatttaatgcttcgtacatgtgttcaaacgctcgatgtgacggggtaaaaaaaattgccggtggatctaaacacccccaaaaaagttaattttgcaacaacagaaagtaccacactagaaaagatttacatggtggcatattactttcaacacatagtatagcagtataactctataagggcttttgtaactgagcaaataaatggtgttggagaacaaatgatgcaatcttttctctttcaaaatgcagacaaactggctcccgaaattcaagcatacaggttta

SEQ ID NO: 19657 - DNA, 461 bp, Oryza sativa
tttggaacctaagggaagggaaaactccaggtgtgacagtcctggacaccgtcacaagtccaaatagatctcaacctgctctgtgcgccaacgtggcataccacgctgatgcttgtggacttggtcataatatgtggatcccacgcaagggtagacttcacatgtcagtctctccctcacgcctctctctccccctccctcatgccatcgcactcacattcgagaacacaccttggtgaggacccgcctcccgtcctcaagttccagcttggtggtgtccttgggactcaagcccctgccaggcgatatctcgcccgacaaaagtcggcgccctagctattagctttgacaagaaggagatgttgcccgacaatagcctagacgtgagcgcctttccacttgtggtcaactggaatgttgtgatggagttaaaaacatgaggagaaaggcatagagattca

SEQ ID NO: 19658 - DNA, 1501 bp, Oryza sativa
acaaaaaaaggggttttttttgacaattcataaactagttggttattcacgtgaattaaaaaaatctaaagaaagctcgagagtacaaaatggtcgtcatattacatatgtataagtttaaggttattgtaatttcaattattgagccagattactataagttgaattataataagccaacacagaataaactataagctatttgtttctttagattattagatgtttgttagctgttagccacccaataatctaaaaaagcatagttagagtggattactatattatagtaatctagcttatagattgtaataagctactcctaataacccagattattataatcctaagctaaatcaaacatggccttaactgggtcaggatacttctttgttgaccttttttttctctactcctagcttgtagtattatattgtattcttgtgataaattttagaggtaagtgaactagtgctgacattatcttattaatgtgcctaaatttatgttgagtaaataactagcataaagatagtgcatcctccaatgttggtgccatgtgcacccaaatatatggctgtttcaatttaacccacacttccattatgcttagcagaaggttatcccataaatcattaatcatttatgtatccttaatcagttactattgtttgttattgcgtttttcatgactttttcagcaggtttagccgtgatgagcataaattgaccgtacaatgaaaaaccaaacccaacagaaaagagtcgattctcttggttttcggttggtccggttattccagcttggtttttgtgttgtggtagattttttttaaaaaaacagtaatatggcaataaagtaccgctgaggagtgaggactcatcccagtcaactgaccacgtcaccggttgccgtagcttcatttgaatcccggataaaacaggagagagagaaagatgaaggggtgaacgaaaaatgagggataatttgattcaagtttttttataaatgtattgaagaaggggtaagtggtgatatatttcactttttatttaaatataatagcatatgcatccaaataggctagtagaaataatttctttttaaaaatcgaggaagttgtaatggcatagatcccgttcgaatctgcttaaaaggatgattaaattttagattaaagtggcgcgtttttcaaactgctaaacggtgcgtttcgtgcgaaaattttctatatgaaagttgtccttaaatatcatattaatcctttttcaagtttgtaataattaaaacttaattaagcacacgttactaccatctcattttgcgtgaaacacttaatcttcatcttcagaagattcaaacaccacactaattaaccctaaaacgaaaagataatccagctatggcccatgaaacattaggcccaccagccgccggcccccaccaccaccaccactgccactctattcacttcacttccaccgcgcggcggcgaggcga

SEQ ID NO: 19659 - DNA, 1501 bp, Oryza sativa
agcgtacacgtcgcgtggtgtacttgttgatgatgaggccaggtcttcgagtagatgtaggacagatggctcgtggggatcgatatcgattaccccgacgaatcgatctaaagtagtcgccgcaccttgttccttgtccgtatctctaggagagatttgtgattgctggaccttaggggatgacaccttcatggcgctgagaaggaccttgcagcttgagaggtcgtgagtctttgccttatagataggacaatagacatcacgagttggagaaatacgttgaattccacgctctttgcaggcacagatttcagcttgtacgctgaggaaaaccgagcaagcttgcaaggtgtgcttgctagtcctgtggagtggacaccaagctttagtcgccccggaagttgtccttgtaggctcgtgcttcttgtgggtaggacaagatttggccgcattaggatccttctcgggcttggatattgtcgacgttccgttctccgcttctgcgggaagatctttcgacatggagtcgaccggggtcgtaatcatgctgttctcactaccgataattgctgcgccagtcgagatcggcattgtggtgttgaccgggaagacgatttcacctacttgagtccacatcagcatcgtcgaagttgaaactccttggtcgatgccggtgttgacgttgtcgtcgagaaggcttgaagtcatagtagtagaaccttgagcaccaagtctccctacttggcgcgccactatcgacagtggatacccgtagatcggatatagagggtattggggtccgttggtaccaggatctacgtagtacgacatcaagcaaaaaaagacaaggattatactggttcaggccccttagtaggtaatagccctaatccagtggatatgggattatatgatggaaaccacagattacactgggaatagcagaactcaatgataccgacaagaccgtagtcaagttggtccgactagatctcacggcgacttggctcctgcacgctccaactccctagactgtggtgggtgtgttggcagtaatattcgatgccttaggtcctgcccaaggggtcccttatataccgcgggtcagttgatctccaagtaggactcggagatatcgaacccctcacgatatggtatagacccagtctcgtctgagtagaactccttccatccgtagattccgtctctatcacgtgatagatttccttaacgtatacggaaactatccgtatacgcgcgggtataccgtatcggtattcaacgtacatccaagaatagagggtataccttatccataaccctgacagaaggtaatatgtaattgccatatctcttgtatgcagcatacaagcatatttctatctcgcatatctcctccacaagtatgtaatcaattgtttccatcatgattatcttatagagcttcgtactacaaaagttataatgtaggtactaaaatttaagggttaatttgatatgt

SEQ ID NO: 19660 - DNA, 1501 bp, Oryza sativa
tgttaccgtatcagatgggtatgatttgtgaaggcagcgccttagcactcatcaagctgggccgatgggttttgctctcttcgattttgggcccccaaaatttctaggggccctattccatcgctcagttggctcaccctcttcgacgaccatgatctttatagatattatgaaatcggtatttgggtatcatatttggatcgtggagtgtcggcttacaccgacaaggtatggtgtgcagatggatacctgatcttatctaatattgtgataccatataaatcctaaactacacacgttgagagatattttctctgtcctaaaatataagtattcttagaatagtgacaagttaaatatttttaactttgactattaattaaaaaataaaaaagatcaatcatataaaattgatgtaactagatttatcatcaaacaaactactatcatactccctccgtaaaaaaaactcaatctaagatgggataagacatattctagtacacagaatatgttacatcccatcgtaggttaggtttttttatagagggagtagtatgcaattattttcatttaaaatgttttattattatagatattgttggtcaaaataacatctcgaagatcgtgtcgaagtctaaaattggttatattttaggacggagagatcatgaacgactctcattttctcgtgtgtttcacgcctggctaaaaattaaaaaaaaatctactcctagcttggcacgtgacctatgcgtgatccgcaaccgctctcaacctccaagagctcgtgagtcgagaaatttccggcgtggtcggtgcccattttggtcagaatcgcacgagcaaagcaacaccccccaccccgcctgagaaatccccacgtcaacggcagcaaccctcccccctcgatctccgcctgtaatcttcgattcgtcgccggcaaccgccgcccgccgccccccgtcgatctccaaccgcagccttcgccgtcccgctaagttggagagcagcacaagtgctgctgggagccgcttgggggaagccggttcgggcgactgaacgccggggagcgccgccgccactcgctagctccggcctccgggggcaacgccgccgagccacgtcgccggtcaggtatatttcggtttttctgaatacggaaattccatcaacaccagtatccaagcttaagttaggcctcgcaaatatttcaatccagggatttgtgtgccgcatgataacctattagtattattaaaccatccttccattgctctaaaatttgagctctgtattggtcgatgattccacgaaagctcattggagcccccccaatgacccatgttaaatccacccctgattttagttcatatgctccgctttatcatttttagctaaagatgcatcatatggtagttcgttcgcactgtaatgttgcttcgcctgcttgtttgattgagtggctcttcctgtatgcatgtcctaaacaaacaggcaa

SEQ ID NO: 19661 - DNA, 1501 bp, Oryza sativa
ccccacatattgtactggtgtgattatggtgaataaaaagcaactccggcttcggccaacaggatgtagggttattacctgacaactcaggggcccaaacctgtataaaaatccctgtctccatctcttttacctcagtctcgcgtatatcctagtaccaacgatccccatactgtccaaatactagaaccgcgatatcaaacgtcgacagtggcgcgccaggtagggggattttggtgctttaggatttcgacgagatgggtttaagagatggatcctctgtcaacaagctactcgacaactttgaccatgaaaagatctaatctgatcggagtacgtctcccgacgagattggaatcatcgtcattaactattcgatccggcgagatcggcttcaagattttcgccaccgcggaagacatcgatttaattttatcgatcaggaggtttcgtccccgaccgaccatctccaaatcgacatcgccggaattctgacagatcaaatcgggatcggcatctactacgcacggttgcatgcagcgcgcggttcccaagacccaagcttaatcaggatcaacatccattattcaagcttaatcaatacaatctggaatcagaacccgattggttgagatttcacgtgcagcagcaggacaaccgagcggacgagaagccgaccgattgcattgtcatgcacacgtgtattagcatgcacattgtggagcccatacgagccacccatacgtgtgctagtcactgtgtgaccagagaacaatttaggttggctactaaggctaattaaggtaattagtaagattatttttttaaaattaatctactaatttcgtagatacatccggcatgtatctacaaagatacgcaatattttatctacaatttatcgtacctattcagatcatacagtattgtcagatctataatttattacgtttacttagagcatgttttttatacaatatatattgcgcgagtacttccgatgttaggccaactacggtctaacgctgggggctcgctctgttttcttctgtataaatcatgcttgtttacggtttacataatgcctgataattacatctgctcgttatatcctgataatactagaagatccatgcagttttttgagtacatactcgatattatctgctatatatcttgccttctagaaaatatttttcaggaacaattgagcactcgagtaggttatggtcgagtacactccattatcgagaacattctcgacaaatgcggagttatcgcacccaacttaccaacgaagaccgacgacctatctcatagcaccggccatggctggactactcgagaaaaggttgtcaacggataattcctcgcaaacgccgttggcttgatcacccaacatgattgcgagcagacatccggatatgctataagttgggtatgtgagtcatgctggccacatgatatgcacatgtaataaaccaactttagcgcccctata

SEQ ID NO: 19662 - DNA, 1501 bp, Oryza sativa
tcactcctatgaggagtcgaacccaggacctcatgtgctactgatgctcttgtaaccactaggctacaggccctttcgcaggccttgtttatgtttagtgcccaaaataaaaactattcatccatcacatcgaatgtttgaacacatgcatgtactattaaatgtggaaaaaaaccaattatacagtttgtgtgtaaattgcgaaacaaatcttttaagcttaattgcgtcatgatttgataatgtggtgctaagtaaacatttgctaatgacggattaattaggcttaataaattcgtctcgcagttttctggtggaatctgtaatttattttgttattaaactttaaatgtttcaaatgtgtgtccgtatatccaatacgacaatcaaacctaaaaatttttcccacctaaaccaggcacgtccatcaattagcctctgtagtttcacattcacagcgatttgaagagtaggaataaggcctcgttcggaattgtgtttggactgaaatttttggagcaaacgaaacgagaaaaaaccattagtgtataattaaccgattattacttattatataaattaaaaaataaagagactttaataaaaaaaagttttttacaaaataacccgtttagtggttaaaaaacatgctcatcgaggacggggaaagtaaccatttgatattgccataaagaaccaacaacagtctaatttggcagtctcaagaaatcaaaccacgattttttgacttctctactcagtaaacaagtcatgcggtatattgcctggaatttagttcatctttagttggggaaaatttttaggttttgttaccacatcggatatatgaacatatatttaaagtattaaacattgtataataacaaaacaaattatagattccaccaaaaaactgcgagacgaatttattaagacaaattaatttatcattagcaaatatttactatagcaccatattgttaaatcatagcgcaattaggcttaaaagattcgtctcacaatttacacgaaaactatgtaattggttttttttccacatttaatactccatacatgtaccataacactcgatgcaagtttctttttttaaactgaatggggcctcaataacaaagtcatgtagtatattgcctggaatttatttccaaattcggtttaaatttacgaatatacccttgttacttctagaagggccaaatttcccctaaaaaacccaccttttccatcccttctctccaactacctccttccctcctccatctcgacacctcctcctcgtctccggccgccgcttccccctcgccgccggcgcctcctcgagaccgtcgagatcgagatagagagagagtgatggggtgggcgacgcggttcctggcggcggtctgcttcttcgcggcgggcgtcgtcttcgcccccgacgtcctcctcggcgcccgctccggctccggctccggcggcggcgccgccgcggccgccaagg

SEQ ID NO: 19663 - DNA, 1501 bp, Oryza sativa
gagagcagggcaggcaggtcgacctaggagataactattttttcatgtacctattttttttcaaccataaattcataaattctttcaccaagagaccaagtcataatgtaaaaaatcataataacaacaaaaaaatgatattttaaataagatgcccgcgcaactgcgcaggctaccttcctagtttaaagaaaaaaaagtcaaacgacttataatataaaatgaaaggagtattaaaaaaattagttgtttgaattgagaagatatcttgaagtatataaattttacgctaagaatgttaaaattacccttccttttaacttaggaaaatctctagtttacatgatcggatcccctaaaatcttgcacaggttcaacttacaccataaactgttaacatcttctactagaagtctagaaaacatcatgtagctaccaaaaccctgcaaatcacacctcgagcaaggtttggggatgcttttagccttttaggtgatttattagcacctatgcgtgataactgctgaaagaatattgtctgtccttactccaaaggtgtgtttagttcacgccaaaattgaaagtttggttgaaattgaaacgatgtgacggaaaagttggaagtttatgtgtgtagaaaagttttgatgtgatggaaaagttgaaagtttaaagaaaaagtttgaaactgaactcggcccaagtggtgtgaatattgtgtaaaaaaaagggggaaaaaagaatgacgcggaggcagccacgagaccgctttaaatgcaatttacaccaaccaaatatccatggtgtaaattggaccagaccaataattgtgaaaccaaaaggaaaccgcttcgtgctgctctacgtttttttaagcaagtataggccctgtttagttcgtggggagtaatccattactctcttcccttttagtccctaggaatccaaataagagtgactaaaagtgactaaaagtgtatattggaactaaaatccattagtctttccatagggactaggcgtgtttggaggtgggtgttaggaacccatctcccatacacagaaaacggagcgatccattaacacgtgattaattaagtattagctaatttttttttcaaaaatggatcaatataaatttttttaacaacttttgtatagaaactttttgcaaaaaacgcatcatttagcagtttgaaaagcatgcacgcggaaaacgagagaggagtgttgaaaacttgctcttgcaaacacaccctaaagtggcagcctctctcttctctccccctcggtccacgtgcctttagtcctttttagttcctagatccaaatagtagggactaaaaagtttagtccaagaactaattttagtccagggaactaattttatctttttaatatactagaaaaagtgtacgtgtgttacaacggaaaaactaaatcgtgacatattttttatgcagtatttgagcattgtgaattgtgaaattgtctcacgtgg

SEQ ID NO: 19664 - DNA, 1501 bp, Oryza sativa
aagatcaacaccaatgacatgtataagttgaagaaaaaggaaatggaggaagcctcaccttccaagaagtgcattactctctaagccgaagttgaagacaagggcaagggcaaggtgaatgaagtcaatgagaacttggaagaagagaatgcccttcttgctagaaggttcaatgatttcttgggaaggagaaaggagagaggaaagggctccaactcaaataggagaagaaatagaagacccaacaagactctctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcgaggaatgggactcaaatgaggagagctcgcctcatccgggtccgaggaagaagatggtgatgatgcaagctccaggaagaagaagatggccgttgttgccatcaaggaggctccatcactcttcgctccactttgtctcatggcaaaaggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctaattgatgttggcatatcttgtgatttgcttgatgatagtgctactttccatattgcttatgttgcatcatctagcatttctacctcttgtgatgatcttgtggatatgtctagctctagctctagctcttgtgtatctatttgtgatgcctcacttgttgttgagaacaatgagcttaaggagcaagtggctaagctcaacaagaggttggagaggtgcttcaagggtaagaacactcttgacaagattttgagtgagcaacggtgcatccttaacaaggagggacttggattcattccaaagaagggtaagaaaccttctcaccgtgccactcgttttgtcaagagcaatggtaagtattgcccctagtgtcgtgaggttgggcatttggtgaatgattgccccggtggtaagcctcctaagacatgcatgtttgattctcattatatgcttaggaaggctcatgatggtagcattgttcctagatatgtgggttcccctatactcggtggtaaaaagaatgacatttgggtgcccaaagctttggtctctaacctccaaggacccaaataagtttgggtacctaaaagagcttgatcttcttttgtaggtgaactaccacaccggtgggagccattgggtgcttgatagtggatgcactcaacaca

SEQ ID NO: 19665 - DNA, 1501 bp, Oryza sativa
ggtaacaaaagcttatgtttctctatgttgaatattgtttccagatgaaggatttgtaccttccaacgccatagagatattaagctctatggcatcgatggaatttcaaaaattatatggatttaagctttctactcaggaaacaattgcagaacaaatcggtgcattccttttaacactttcacatgttctggtaactttggtgcatcataggcttcataaaaagttcactatttttgatcttgtgaatactgctaaagacaagacataagctaagaaaaacttaactgcatttgtaattttccttgtatttgattagctgtgaagcatcatcatacaaattgaaagcgaaaacattcaaaaagattttggtttaaaataattgtgaacagaaaatagtcactggaaaaaatcagtgtatcacgatcagtagtctaccaacatgcccccactaaagatgtaacaccaactaagcattccaatgaactttgagaacttgctcacagaatttggctgggaaggaaacaatgatgcttttatactcacatggactggaaagcagcagggatttcagcttgatattgctcttttgtacattctgacattgtaggttcgataggtacagtggtcctccagtcctgatttgttgttgcattcattagtcctgtattgttctcaacttcctgaaccatttgttttggtttactaattggtttttattgtttttacagggcagttggcttatgaacggtatacgtgcaatgcttttctcttgggaaacaaataccatacagaaacaaaaagctgagtggttcctcccttgctgaggaccagtggttcttggctgtttcaaagctcactgtcaagttagagattatcagtgctctaatcccttcacactagttccaaagtccaaacctaaaggaatttcctttcatgttaatgatcacatgaagtaaagagctgcctcctcctgatattgagttctctattataaattttagatttctgtgttctggaggtgaagaacactgatccacacatgcgcgtacatttgttgctgctgtttatatgtaaacatctagcaacattatcggtggagtgattatttcgcatcatggtgatgtggctaaccggctacagtgttgtagatttgagatatgctaaaagttacttgtgccaactgccaagaacaaagtgacatctggagagagagagagagaaatatttgccagctatatattttttgaattgagattgaaagaacagtgacaattagagctgcatatcgtcagcttgttgaatgttttttttttaacttgttgaatgtatgtttaatttgccatatcctgttagttatgcaccgtccatgtatgggtaccaaaccaattgaaggtcacgtgagatctcgtctttgttaaggtacattagatcaacacagtatctgcacataatcgttttagacttttggtgatactttctcaatttatttttcttattt

SEQ ID NO: 19666 - DNA, 1501 bp, Oryza sativa
ttctagtacaacgaatctagatgtactcatgtccagattcgttgtactagaaaacgtcccatccaatactaggttaagtttttttttgggacggagggagtacctctttcctcattgttcttgagacgaacgtacattttgaccgtaagttgctgagtttttatcattaacattctctaaaaataatcaaattatatatgtggtctaaaattgtatcagttgatttataattaaaagtattctagtaatagtatcacatattttagttttagttgctttaaaactagctgttagaattcacctattcttagtcaaagctaacaaacttttagcaaacttttcatgacgttaagagtgtttgtaggtcttatttgagaagctcaatattgtgaaaaaaacatttgatgagtactccagtgtttgtaggtcttatttgagaagctcaatatagggctggataccacctagccagctcgattcatttgaactcgtttctttcaagggaattcgtttgaactcattatctaaaaagcatagctggtcttggcccataagctagctcattaacacacttatcgcaaatttataatttcaaatttatcttttcggaaagaaaagactaagcgctagttaatagcacaagaccagctaaatttcaagaatgcacataactgctcctctaaattttaggctgtattatggaatctctcgtgtaaaatggaactaatcattaacgtatgattaattatgtgtttactaatcttttgaaaatatagattaatacaacccgttttaagataagtgcagccgtggatatccgtgcccaacgtttgaccatccgtcttatttgaaaattttgtgaaaaaattaaaaatatttagtcacacataaagtaatattcatgttttatcatataatagcaataaaaatagtaatcataaaaaaatttaaataagataaaaatagtgtaaaactgtacttattttgagacagaaggatatatgattttttcaagcaattttctataaaaatatttaaaaggacatacggagtactagtagtctgagatatatgcgcacggaaaagtggtcggcgagttgaaatgggaggggaagaacgcagccgggttcccacttttgcgcgtgggtcccacctgtcagccgcccgaccaccggccgacagtgacctcactccaacccccacagctctttacttatctcaagcccaatcacaacccactcccacctagctcaacctcacgctcaagctgcatctctctctctctctctctctctctctctctctctcctccagctccggcgaccatcctgcccgccgccattcgccggaagagcccaccagctgcaccggcgtggcatcgtccacttggcgagagtggcggagctagatcggctatcgatatatacataggtggtggatgcgtgcgtgcgaggtggtgagggtgagatgaggtctccggtgggccgcagggaggtggtgg

SEQ ID NO: 19667 - DNA, 1501 bp, Oryza sativa
aattatgttgatttaaattattgcattatcgctttatttaaattcccgcgttatcactgttttatttagccatgcctatttacctttgttatgaccttattattattgttattgttattattaccttgttcaccctagaataaacaaaacctcaactagtggacactctactcatggcaccactagtttagttttaggtagatgcttcgcaatttaattaggtaacattaggtggtttttcaactatagactttgggaaatattcatatcatctggatactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagcgtttcaattcttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgataattaatattgtatagttcgagaatcgtgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccacaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttgaactctgaattgtatcaacttttggtgtaccttgcctcctgggacaaggattaatgcacgcacgtcaggaacgcccgttgggttatttccggtcgtgacacctg

SEQ ID NO: 19668 - DNA, 157 bp, Oryza sativa
ctgctagctgcactattgaccttgctcttatatttgcttttgcatatactccgctggtcactaatacatgtcatatcgatccttttacttttagacatattcttcggaaactacaatttagatgactaaatctaaaggctgcgttctttgctggagt

SEQ ID NO: 19669 - DNA, 1501 bp, Oryza sativa
cctcggattcgtccggattcactcccgcgatcttcgccggtgcatcaatggcggccgagatttccgcaggccgattccttcccctccggccgctctctccccctcccgacgctatataatcgctccccgagcctctctcctccgtttccgccgctcgccgctttctctccccatcggaatcgagcccgcgccgtcgtcctttctcttcgccgtcgccgccgagctccggttcgccgccgtagtcgccccggacctcctcccgtctcggcgtcacctccttcggcttcgccgcgtcctcgtcgacctcgtccactcctccgtttcgcccgccgaccgtcggagcaccgccgtcctcgtcaacccgagccgcgccgccgcctctcgccgcttcggtcgccgtttccgtcaccgccgtcgacccggggtgagccaaggaccgccgtttcacttcccccttccctcccctctctcggccgccgctccgtcgcgccggaggtcgccgccggcgaccatcggggcgcgggcgcgccgcctcccgtcggccgtgccggcaaggccgccttcgggcgcgtcccgcggctgccaggtggggcccggccgtcagccgcccgcgcccgcgggtgcggctgacgcgtgggacccacgacgccggccggcgtcagccgcgtgcgcccggtccaccatggaccgagaggctgacgcgtgggccccactcccgtggacccggtccgcgcgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttatgaagccaagaacccatttttatgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaataaacaaaacctcaactagtggacactctactcatggcaccactagtttagttttaggtagatgcttcgcaatttaattaggtaacattaggtggtttttcaactatagactttgggaaatattcatatcatctggatactatggaatggtttggttattgtggaattggcttcacaccgctccttctattcaaaatccccaaaatggttttaggctgggctcggggtgcatggttttgatagtagcacctcggccatataaggaccggt

SEQ ID NO: 19670 - DNA, 1275 bp, Oryza sativa
agggtggcgggcgggtccgcccgtcagccgcacgcgcgcggggaggaggccgatgggccgcgggggagaggagagagagggagggagttgggccgggccggcccaagagaggagggggggggaaagaagacttcttttagggtttttctttttataaaacctttttaactttgtttatttcttctcaattattatttgtgctctgaaaatttcactaaaatttatttacgcattttaggcttttaggaaatatacaaaaatcctccaagccttatttgacttttatatttgcacattttaattgttggaggctttcacacgaattttaattattctcggcacaatttcgaggatgtattttagagccgttttgggacgcgacaccaggccttgtttataagggggtgattatgatccaggaaaggtgcgctgtaatgggttatgttgtgcaagggttattgtcacaactcctttccgaggtaccgtggtggtattgaggcacatggtgacatgatgtggtgtcacgtcctgataaattcatcccaaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcgccggaaatatttattaagcaacaaaaacaattatcaaagtttaataaaacgaaaacctaaaaataaccctctccttccctttgggccaagtctggcccaaggttcctctctctctcttggcccgcggccaaagtctccctctcctccctctctttccctcctctcccgggcctctcctcctcctcccggcccactcttcccctccccctctcggcccactccctcctccaccctctccctcccgggctgcctctccctcctctcctcctgggccgcctcggcttcgcccggcccaagccgagccgcgcctccctcccgtgccgcgcacgtgcgcgtgcgtgcgcgccgttgccgcgcgttgaccgcgcgcctcccgcgtgggtcccgcctgtcaggcgcgtccccggcctccagccgccggcctccttcctctctctcccgtgaaccctagcgccgttcctcctccaaatccgctccattcaagccggctctttccaaattgattggggggaattaatccccattgattcctctttgatttcccccgtttttccccttgaa

SEQ ID NO: 19671 - DNA, 1501 bp, Oryza sativa
agtggaaatagtgggagagacgctacatcgctggtcgaggaccaggcagtagtcgtaactcgaccacttaaagtggaagtagtgggagagacgctacatcgctagtcgagaaccaggcagtagtcgtaactcgaccacttaaaattaggcgagagagatcactacgctttactggttcgagaactaggagtaggagtctcttaatcacctataggggcgctaaagttggtttattacatgtgcatatcatgtggccagcatgactcacatacccaacttatagcatatccggatgtctgctcgcaatcatgttgggtgatcaagccaacggcgtttgcgaggaattatccgttgacaaccttttctcgagtagtccagccatggccggtgctatgagataggtcgtcggtcttcgttggtaagttgggtgcgataactccgcatttgtcgagaatgttctcgataatggagtgtactcgaccataacctactcgagtgctcaattgttcctgaaaaatattttctagaaggcaagatatatagcagataatatcgagtatgtactcaaaaaactgcatggatcttctagtattatcaggatataacgagcagatgtaattatcaggcattatgtaaaccgtaaacaagcatgatttatacagaagaaaacagagcgagcccccagcgttagaccgtagttggcctaacatcggaagtactcgcgcaatatatattgtataaaaaacatgctctaagtaaacgtaataaattatagatctgacaatactgtatgatctgaataggtacgataaattgtagataaaatattgcgtatctttgtagatacatgccggatgtatctacgaaattagtagattaattttaaaaaaataatcttactaattaccttaattagccttagtagccaacctaaattgttctctggtcacacagtgactagcacacgtatgggtggctcgtatgggctccacaatgtgcatgctaatacacgtgtgcatgacaatgcaatcggtcggcttctcgtccgctcggttgtcctgctgctgcacgtgaaatctcaaccaatcgggttctgattccagattgtattgattaagcttgaataatggatgttgatcctgattaagcttgggtcttgggaaccgcgcgctgcatgcaaccgtgcgtagtagatgccgatcccgatttgatctgtcagaattccggcgatgtcgatttggagatggtcggtcggggacgaaacctcctgatcgataaaattaaatcgatgtcttccgcggtggcgaaaatcttgaagccgatctcgccggatcgaatagttaatgacgatgattccaatctcgtcgggagacgtactccgatcagattagatcttttcatggtcaaagttgtcgagtagcttgttgacagaggatccatctcttaaacccatctcgtcgaaatcctaaagcaccaaaatccccctacctggcgcgccact

SEQ ID NO: 19672 - DNA, 1501 bp, Oryza sativa
cctgctgccagcgacgagcggcggagggcagccggcgacgcgacagccggagagcggcgtgcggcggtcggcggcggaagcgtccttctcgttttttcgtccaatttcagtacctggcaagctggacctagctagcaagggctaggcaagaggcagcttctcagtggtcggcgaccggtggccggcggtgtgcgacggcagtcaggctaagcggtcgacagcgagcggcggcgctggctgccggcgaacggcgtttcttgcgctgttcgctgtctgctcggaggaaggagcggcagatgtggttttttggaggagcagtcgtggtgatgagtgctaggatggtcggtggctatggtggtcggaggctgaccttggctccggcagccagctcggcgagttggccacagccggtgatgacgagggagcctctagttggtttgagggatgagttgcaaagggagaagaaggtagaggaggaagaagaagtatgcctgccaataatgccgtcacaggtgaacctcgcgtgtgacttggaattgtgtcctaaggacagtttttccgcaccaacaaaacacttcgctagtgagaccagaggtgaaactaggcctagggctattggttcacgtttttgggtgctcgatggagaagatagtgaggaggaagaagagcaggtttgtcaccgagaagaggaggtggtaggatcagttcaaaaaggaagcatcgtacgcaaggctatggcagaaggtttcacgcttgatgaaattctttcagcgggagagtatttgttgtgtacaaattcatctccaaaggctcattcgtttccagggagcacaaggacgaaggggaagaaccatcttgtagatagattggtggctgcggtttgcaggaagaaggtttcgatgtgtaaaccctggaaaggacctctgccgtcacggcggatctcgcaacccaggaagcttgaaaccttcctctcagcagcgcttgaggattggcagaggaagaggacggcagggttagaaaaaacgccggcgaagttctcaaaaagagaggatgttaatgcatctactttctcggggaacctcgataaggcaagtagtcttcagttttctggtcgacaattagcgcaagaagacgaggcgtctgtctgttcgagtcttctccacggcggcactaatatggatggtcccacgttgcagatcggcaagggagatataggggagtaaatgttaaattttgttcagtgttgggccgactcctctcgcacgcgggccgccattctttggctcggaaggaacgtaacaagggggagattgagcgaccgaggcggcagtcgcagctagggctaaacattcgcaatagagaggggaggcaaagaggcagcgaagaagggggtctgtgtgtaggtggcgagctgcaggttagagccgaagaggagaaggaggttcggaagggagggatggcaaggaggaaagatgattacgatgggtgcagcaacaaagat

SEQ ID NO: 19673 - DNA, 561 bp, Oryza sativa
agggatgaaaactaattggcgttgaagttcagggtgtaaaattaaccggataaagagttgagtggggagtggactttttcctaagtttcaacttaactagtccatgcaaattttcaaatgtggttgctaaatgtaagctcaacgtgcagaatccatcaattcaccaccaacttttgttagttattggtaaaagatagttgcgtggtggcggcagataggatcatgagatcaatataacataactgatctcacatgttacttccaacagttcatcttcagattcccaccaaaatatataatatataaagagaggctacagttgcagtatggaatatgattgtttaactctcaacatccactcctcagaagttataataggaaagcaatacccctatgtgtccatacggtgctcagcgatatattgaaaaaagacaattgaaaccctggtctttacaatgctaatctcagctaataagagtaatagaattctgaatattttcaatattatttgtttgaagccaaaaagaaaatatctttagtaaaaactactactaaaactta

SEQ ID NO: 19674 - DNA, 1501 bp, Oryza sativa
tccccaccatccagtagctcttccgcagtaaagtgttgaagtgcttttaccagagtagcagcattggcaatttcaaggctgagatccaggaaaggatcaaatttgttggaacagtgtgagcaagttgtgcatctcacctgtcatgcatatagatatagtcagccagtggccatatgggtaaagttttacttgctattatactagtaataagttaattaagcatttggcaatttacctgacttcttaagagaccaccaaatattctgtgaactaggctcttctcataagcacttggcgacccacttggtacaccagaaggtaaacaacatttgtgcatggactcaagcaagctaaccattagctcatgtgcgtcttcctgccttgagatgcggaaactacgagaaatgcctaccttgcagttaaagattgcacaagggttgaataaaattatagatagatacggtatttcaaaataaagtggatcaattattttgcaatagcatatgaaaggatacatcttaaatttctgacaatgtgcacaggtctcaatatcttcccagttgactgtagagcagaatttacatgtctttgaagagcacataaagcacagaatccgatagtccgaccttaaaaaataataaagtgatattataagtaactacagaaacagggcttgccaagaaaacagaaaatgttattatattgttctctggagaaatgatacagccgcaaaaaacagaggttgctccagaacaggtgatgagacatagtacattggtcaaggcatgtaaactaaaatttatatctgtttcgttcaatccaaatagataagaagcagctctagctctagatgcctcgagactgattatagagagaggaaatatatttgataaccaccaccatagaacatccgataagaaaatgcagagtgctcacagacagcaacaaaggatggttcactactctcgactttcattgacaacatcatcatatcatgcagagtatctgaattgctgatcgcgaccagacgcaatgaacttacatgaggacatgtgctccccactctgcaagtaggccacgaacggctcggtatacgtcaagcattgcagaaccgagttgaggtagcaggtattgccaaaattttgcaagccagctccctgttttacatagatagggcaatagggcatctttagtgaagtattcacttgcaaagcctcgtgtttcaggtgaatgagcagattactccagtaaaaaggaccttcaatacgcggatgcaaatttttgcgcataactattccaaaatgtattctaaacaaaacataatacagttaaacgtgaatatatttttttcattacagaacaacaaaccagcatttctgaaggaaaattcataaaatgtatcttataattactgattctattcgtaaaccaaaacccctctaataatctgaactgcaacaactaaaaccacctaccctacatgtatatactatgctaccta

SEQ ID NO: 19675 - DNA, 1501 bp, Oryza sativa
ctttgtggttgcagccaaaaaacgcagaattacactaagaacctgcagattagagggtgaacagtgcactgcgctgcattacttaagatggcaactgttttgaacttttgatccaattacggtgttttgagaaaaagatcttgacggtaagccagggatgatagaacgactcctgcctgcttaagattttcattgtcaatagagacttgacaggaaaaatgttaattctttctaatgtaaacttcaggccatttctttgcatgatgtaaacttgcatattagctcgccttctgtgttccctttttggaggttaacaaatctgtactgatatttttagtgaaattgtgaggcaaactgaaaacatgttctctggatgcaataagcacttgtttctggccagccccgatttatggaatcagtattcagatctcacaaaaatgaccacaactgtttaacactacacattacaattgcataagcattacacatttgcattatccatgggaggaagcttgtgcaatgcagatggtttgatctcatccctggagatttggggaattgagataggctgctgctgccatcaatctgtgatgaagaaagttcatgcgtgcacaaggcttctcagtcttcaaattgaacccatgcacaagttggcatgacgagtaccacattttaacaccagaaatgcatcccgttaaaaaatgatacactaggaaagtattatcaggtttacctgcaaaatatgaaacattagacaatttcaatacttttgaagctttttggcacccaaacttctccagtttctaacaatccttaccttgtttcttgttagccaccattacctttattcagaatagctctccaacaatgtccgaacttaagaaggaccgattatatacatgaatttaaataaactggacaatggcaatcaaccgggattaaggtagtgtccaagttgagtcttaataaaacgagaagatgtagctaactagattcttctctaaattgggttccaacagaacctgtaaataaactcgttagtaacttaattaaatgccctagatttcatctccacatgcaacatttgaggacatgttagtgccaaaggaactaatattctagttgcaaagcaaaaaagagtggtccggtacatccagcaatgaaataatctgatgctattaaattgcagggaatgatgtaacttgtggtcaaagctcatctagttatgataagtttttcacaaagaatgtaaatggatcaatgttgtatctagaatataagttggataagtagaaattcaatccaagtgttgcaggaaggcaagggaaatagtatcagcatcactgtctcaagacatgcatatttgttactgtaacccacaacctattatggaaaaagtaaactgctagtattcatgctctgtgcatcattgtgacttaattgctggatcaagagacacatatagctagatgcgtatctaatattttgttagcaaatctgc

SEQ ID NO: 19676 - DNA, 1501 bp, Oryza sativa
ataatcttataaagggatagattcaaaggaaaatttctaagaggttgaaactcttgctaaattttcttcacaaaatctttctaggattattcattctataggaattttaaagcatacaatatgattcaatcctttattttaaagggtttcctaggaaattttcttatagggttggaatcatcctaaactcctactcttatatttttttttctccaaatcaaaaggccctcaatgtaggagtacagtcactgtgcgatactattcatttgtgcgtggcaagttgatactactagcttgcaatgctatattcacttgtgtgatcgagatgtgtctcatccgtttccacaactcttaaaagtttggatcattttaatcagaaaatttgttccaaaaaaattctcaaaaaaataatgatattttttttaaaaaaagttaaaaatgagatacggaattgtcatatggaatgcccattttctactaatttaaggcctcagaaaaaaaaacattactactagtaccaatttaacatgttcatggaaaattattttttgccccgtccaattgatacatgagatacaatacaaaatttacagacgcaagaatttcgccggtgcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagagaactctgctttcttctccaactccctcccttttgctttcccacctctttgcctcaataatgatggggtggtggagatggtggtgggtttggtcctgaagctccatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagagga

SEQ ID NO: 19677 - DNA, 1501 bp, Oryza sativa
gaaatggagatgcgatgagaaagtgttagccgtgagctgaatcgaggggagcttagtggaagcaggagatatgtagtagcaatgttctgtagttcagtttacgagccctctggggttctgttttcttacttattattattcagtttgtactattagctgcagatgtgcaaatgcaaaagaagggaatcgattaattcgaattgattgcagaaactcaggtaccatatgcctttgagcgactctttctagatttaacattgtttcaagcagcatttactccctccgtcctattttaagtgcaaccataagtttttgattgtccgtcttattttaaatatatttgtgcctagtattttaagcaagacaaatgattaaagtaggagacgaagagagtacgttgtcgtcatcgaaatgcaagaagcaaggagaaacggcaaaagctcataccgtcagaagtggactggtatgacgatgttggcccatgtattgtagacaggcagcccgagagcagtatgggccgtaacgcgatacccacgaacgtgcaggtgcagtggtgcaccgacaagttgggccggcccactattcttctccgcgcacggcgaggcaagttggaagtacgtgccgggctgggctgagtctgcaacgggcggggacctcacgctcgtagcccggccccggcgagccgcgacgtgtcaccacgacggaaaatacgattgattttgccgcagaaatgcagaatgcgtcctcctgaccaacatgtactcctaaggcctgtttagtttctaacttttttttaaaacttctaactttttcatcccatcgaaacttttctatacacacaaacttccaacttttctgtcacatcgtttcaatttcaatcgaatttctaatttttatgtgaactaaacataacctaaactggtcaccagtgctcggagggagccgcaggaacaaatcatcattacgctatcatatatgcactgccagactgccccttgcatttgcttgctagcatgcgtacaacaatatacagtacttcctttcctttaaagtcgttagaccttttcttttttctaataaaaaatatttgatttaataaaattacagtagtattttcaacacaaaataaatatattgtcaaaatatattcaatgttagatttaatgagacttatttaatattttagatgttgctaaattttattataaacttgatcaaacttaatacagtttgtctagaaaaattcaaacaattttactagctagtcagtcgccagctcgatcgatatctcaagacgatatatatgtgcttattaattggttgaggaccgtacgttcttcgacgatcgattcgatctctgctctcaaaatttccatgtgaggagaagagacgaacaattgcccacaaagctatgatgttattgccacgcacgcttaattcttaccctacgtacaaccacattatataccacttccgatctgaatgcacactgatgcatgca

SEQ ID NO: 19678 - DNA, 861 bp, Oryza sativa
caccttcaatgttaggaacgaactgctcgtttgattaaatgacgaccactcctttcctgaataaatgctttgacttctgcttttatgtttagatttagtttcttggatatcctgatggcctgaccacaattatggaagagttgaaaaacagatcgtttcttccctccgttttagattttagttcttgccaggttgccatccgacgaggttaagactgtacttttttttggatgattcattgtactttatactgtcagattctgctccaatgcagatgcatgctgctgtgtgtgatctgctgctattgctttcgaattcagtttcagcgattctagtcatttgttagaattgtggcatttctctagattggggaactggggtaaaaaaattttacggcattgtttgttgcagttctcttaaaatatacaaggattacagagcatcatttttgtaagagaatagtgcttggcatcttattcttataatactgttataactgtttgtggcatttggatcgtggattgataatttgcatatagtcttgctgtgtggatagagtaaaaatgtatcatgaataattctgctataaattatttcggatggagtcctgtcgaacttcacattcaaatggtatctatttcaccttttggggatccagttgatgcctgccttttaactttaagaacgaaagaatttcccctactggaaaagttgctatttgatcctcatgggatttgaaatttatttccatcaataaatatataaaacatggacaattgtgtcaaattaatatcatgacaattttcctttgatggacatgaccaatattgtgtgttacatgtgactgaactttttacttgg

SEQ ID NO: 19679 - DNA, 1501 bp, Oryza sativa
gaatgaatattcagggttagtcgtacactcataccataaactactacttgcatgctccatggctatcacaattgtatgacaaaatgaagatccactttcttgtctctcatgctcgtcctcaactgaaacaagacctccaaaaagcttcaggatcaaccaaaccattacatacacaacatacagactataaaccttcacaatcatcgatcacaggctataaacaatgacgaatcaagcaataaaaaggagatttttttaaaaaaatatcatattttcacggtgtctggtgtcgctagcggcgaagaacggcggcctgtacgtcatggagatgtatccccggggagacggccatgtcaccttcgaggtgctcgcctacggccgccacagccagccgccgcccgcctacgtcggcagcagcggctgggccagatgcagcatccaactcgaggactggcactggcgcgccctcccgcagcctccctacgtgcagtacccgggctacgaacgcgacgaggcgccgccgtgaaacacccttattacaatatcacggcgaccgcggtggtcggcgactcacgtctctggatatcgacggagggcgtccgcacgtccgcctttgacacggtgcgagatacctagagcaagcagggcgagtgggcgctgctgttcaggggcaacgccgagcacgtcgcggagcacgacctctggttcggcctctcgcgccacggcgacaagctgtgcgccctgcggcagcacccaccaccctttgaccgcttgacgcggagctccccgccggcctcctcccctccccacccgccggtggtctgcagagagagagagagagagagagaggaggaagggagagaagatgggaaataaagggtggtgacatggcacactgacatgtggggtcccacgctgattcagccgtcacgtagaccaaaatcgggatcaaaaccaccgaatgatctcgggtgaccggttttatataattaagagataccgtatatctgtttttacggttcgaggacgtttttatatccgatgacaagttgagggaccttcagtgtactttttcctttttctagtgcacatgaaaaggacaatttcaaaattgagattttgcgagcaggggcgatctgtggccgtccattcgttgtggacgttaaatcgaccccgtcgatttgtgatagaggttacgccgcatctgcgcgacccgctaccacccacacatcttcccgtctcaaaacaaaaagaaacaaaagaaaaaaaaaatccccatttctctaaaaatctagaggcttcttctcttctcctctctctcgttccccttcgtttcgattcgtctcgcccaaatcttcaaatccaaatccgcagcggaggcggccggggcgcggcggccagatcctggaagagaatccattccgggaggggaatccgcgcatgccaatgtcggatcccacggcggcggtcatccccaagccggggggcatcggcgtcggcg

SEQ ID NO: 19680 - DNA, 1501 bp, Oryza sativa
atcgtcgtctccgatcgttctcgccgtcgacgtcccgtcggtcgcccggctcgtcgtctcgcggcgccgcctccgtcatcgtcatcgtagcggcgtgttccacgccatcctcaccgccgtgcagccgctgctggctgccctcgtagcctcctcgccggccccggtcgtcgtcgtcctcgtcctctcgtcgttcccgatcgtcggggcgttcgtccctccgtcaagccgttctcgttcgtcgtcctcgcttcgtcaaggtcgctgcagcccccgtcatcgtcttcgtcctcgcctccgcgtcgtcaagcctcgcgccggccgcgtctcgccttcgtccaaggatcgccgccgaagccgtcccctcgccgttcgcctccgttgtgcccgtctgtctccgccgcgcccgttcgtcgttgtcgttcccgcgcctcgtcgcgtggtggtaaggttccctctccctcgctgccctgtcctcgtcctttcggtgtcgcccatgcccgttgtgcggttgtcggccccggtacccgtgtatcggcgtcggcagtcgttcgcgtgtgcgggtggtgaccgtgtggtgtctagtggagtccgtttgtcggccactcgcttcggttgacacacggggtccgcttccgtcgacccgtggaccgtctctgtgtactcggtctgccgcggtcctttaggttgacatgtggggtccgcatgtcaacggcgcagccttcctgtcttttccaggctagcgcttacacctgttttatagttgcaaaacttgattataataatccgcaaatctccatataacagcattaaacttcggatgatcatatctcggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccaagcctatttacctttgttatgacattattattgctattgttattattattaccttgttcaccctagattaaacaaaacctcaactagtgggtactctattcatggttccactagtataaatttaggtagatgcttcgctgaataattaggcaacattaggtggttttataactttagactttgggagttctcatatcatttggacactatggaattgttgaattatggtggaattggacacacacctctcttcctctttcaaaacccctaaaacctgttttcggtggggtttgggtgcatgccagttgtgggaagtagcaccccggccactataaggactaaa

SEQ ID NO: 19681 - DNA, 1501 bp, Oryza sativa
ctaataaccaacctgaggatggaaaagaaaatcaggtgattaaccaaagagacatttgtttggactaagagtttcagatgtgtcttttccggatcaaaggcaatgacagtcagtgtagcttttggcgaaacacttcaaggtttcactgaaaggtagcagaccaaaggacctcctcgccaccagaagcatccacaactctcggagtgaagagtacttagtgaccaaggtcaaaagatgactgatagaagatatcgaaaaagatgtttattaccaggcaaagaagtaggtcgaaaggtgattaataagagaaatcgggaaagaacacatcaagggcaaaggtgtaaaggaatacgttgaatgctaaatgatgacaagttatgacaagcatggtatcttagtaaagacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaagtcaggtgaagagaagattccatctgcaacaggagatcgagccaagcagtccagagtgaagaagtgttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaaataaaattcattcgctaaaaggaataatagaattaattaaaattcgaaaagaaattggcaaacactaaaatacgtacaagaaaaattcgaatgtggcccggagaatttttgttaaattctccttggtctaaaacgagccctcaaattttacttgaattttcagagcgccggaaataattattaaacaacaacaacaattaacaaagtttattaaaaagaaaatctaaaaataaccctccttcctcctttgggccaagcccagcccaaaagtccttctctcctccctctctttctctccctccccttctctccctctctctcccgggcctctcttcccctcccgggcagcccactccctcctctcctcctccttctgggccgcccctccctcctctccttcccggcccatcttctctccctcccctcctcctgggccgcctcggcttcgcccggcccaagccgagccgcgctcccacccgtgccgcgcacgtgcgcgtgcgtgcgcgccgttgccgcgtgtcggccgcgcgcccgaccgcgtggggcccacgcgtcaggccgccgtcgccttcttcctcctccgcccggccacctctctctctcttcccgtggaaccctaatcccttcctccctcaaatccacgcgaatcaatgcccttctttccaaattgaataggggaaattaaaccccattgaatcctcttcaattcccccttaattcccccttgaa

SEQ ID NO: 19682 - DNA, 433 bp, Oryza sativa
tatttttagttaattattatttttccatatctatatgcacgtgtctggtcataaaaccaaaaatatttgtgaatcctctttagagaaggataacatttcttactattagcttattttaaaaccaatatatataatagattaactataaagttggctataatatatttcttctctctctatctctcatttatatatttaatatatttgtcttgtagcttgtgataagctaactcttgaatgagagtcaatacccttaaattttttgggttcatctcagcatggaaattgttttgcatcccttggtaacaaatgaatggtatatacagtatgtgcagtagtacttttttattatttttattttttttaacgttttcccgtctcttgggctagtggcccgactctctcatccctccggcttccggaatccccaccg

SEQ ID NO: 19683 - DNA, 883 bp, Oryza sativa
cctctgatcagagtattaatctattcgaatagcggcgccctcggttatgggcaagccgagcaatgtacccaagttagcgtttcaattcttaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgataattaatattgtatagttctaggatcgcgtttacaaaatagctttgagcaactaaacgtctttaaatgctgtttactgcaaccctaacccctttatagtataattcctttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccaccgttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtaga

SEQ ID NO: 19684 - DNA, 675 bp, Oryza sativa
tcaaatggccataacttggccatttgaactcggaattggaccgttcaagtctctaatttttccttatgaagccaagaacccatttttatgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaacaaacaaaaccccaactagtggacactctactcatggcaccactagtttagttttaggtagatgcttcgcaatttaattaggtaacattaggtggtttttcaactatagactttgggaaatattcatatcatctggatactatggaatggtttggttactgtggaattggcttcacaccgctccttctattcaaaatccccaaaatggttttaggctgggctcggggtgcatggttttgatagtagcacctcggccatataaggaccggt

SEQ ID NO: 19685 - DNA, 1501 bp, Oryza sativa
cattgtgtacatgcatatgctacttctagttttgctcctatacaatatgcttataatgctagggggggtgttcaatgggtgattatacagccgattacacaggaatcggctatatgcaaaacctagctaacggtatgaccggtcatgacaccagtctaaccgcatcctatgccggtcataccgtgcctaccatagccggtcagaccgtgccctattttggccagatcggacctcctgtggccggtctgtccgcaccactgaccaccggtcagaccgagccatgggccggtcagaccggttccctgggagtttctccaggttttcataccacgactagcagtactgattttaattattattcatcacctgttaatactgttagtcatgctattccacatatccctaatgcctacaatgatattaataggggatatcctcccgatactaggtatggccaatataacaatattgtgccgcaacaaccaccttttaggccaccaagtccaccaccagatccaccaaagcctgaaactgtggaggattggtttagaaatactatcagggagaatttcgcaaagctaaggaatcgtgctagggagtaccaaaagccgtatcctaatttttatgatattatcccatatcctcgtggttataaaattcctgaatttactaagtttagtggtgaggatagtaggaccacatgggagcatgtagatcaatttttagcgcaatgtggtgaggctaattgggatacatgtaaattgcacttgttttctttatctttgttcggtactgcttttgcatggtttacttctttaccggcaaattctatttcttcctgggctcaattagaacaaaaatttcatgattatttccacactagtgagactgagcttaggttgtttgatttaacatcggttaggcacaaatacaatgaatctgttgctgattatattgaaaggtttagggatgttaaaaaccgatgttttagtttgaaaataactgacaaagatttggccaacattgcatatgatggattgcttgattctattaaagagagattgaatgaccagatatttcttgatgttgatcatgtgttgaatgaagctctggctcaggaaagccgagtggatgacagtagcttacatgctagtttagatgatagtgcaatatcatgtatagccgaatcaagcgatggttcggattgtgttaataatttgtgcagtgatgccataacgattatagccaaaccaaatgttggttcggattgtcttgctagcttagataatgatgcaacaaccattatagccgaaccaagtgttggtccggattgtattattaatttagacaataatggaatagccaaaccaagtgatggttcggattgtgttgctagcttagagaatagcatcaatttctaaatatttgctacatacacacagtagcataccgacggaaatcaaggaccgtatattaatctattcagtcagcaatttcggct

SEQ ID NO: 19686 - DNA, 446 bp, Oryza sativa
ccatagaaccgccaaggtatacaaacttttccatgtgcgttggcctaaccataagcaaaatacttctcgggagttctaacccaaactgccaaagaaaattcccataactttgctaattagatgtgtttatctctaatattcagctacaatatacactacgctgtcttatgcacgattcgaagttgtttgcagtttgaaccaacaacggcacatttttgggttcatgtcatttgataccctcgacacctaaggatatgcccgttggctaatatcaatatgatcatcaccaccaaaccaaagtcaaaatcaataatatattgagctttccttgttcaaaggtaacacggattctgaatttgtttttaagcttatgtagtttttaattttatgtcgtgctttgctaattttgtgcatttgttatgtgtgactcatcaatatttttcagc

SEQ ID NO: 19687 - DNA, 906 bp, Oryza sativa
tcctgcagccccaagctagccgatgtatataaggttttcatcaatcgtcaataaaccattcctaatcaaagataatcttgatagatcagacctaattaatcgagacggtatgatattgaagttgataaagagatatttaactattgattatacaagtttgagtataagacgatcaacacttagaagtagtaacaagataactaattggctagaactctaataaaatgttgcataaaaacttatcggcttagtagaatataattacatattagcaacaatctaataaatcaaacctaaacgagacagtataagattgaagatgataaaaaatgggataattgcttatttgaccctgttttgaagcctaacttctaatctgactatgtttttcttagtttgcttatttgacttttttaaattgaacactccgtctgaccctctttccactacatcattagggtttcttctagaaaaagaaaaaaaatctatttactatttaaactgaccaaaataccatcaaggcacttcaaccctatccatcccaccttgtctctctcatctcttacaagcggcacatggagaaatggatctgcggtggcggcggtgcgtcgagggagtggctagcagcaccgccgatgcgtggaggtagggagcagcagcgtcggcagcgcatggggaagcggcggctgccgcacggatagggaggtcggcgcaaacgccattgcgcgacggagcggccgcggcatcacgcgatgcgtgtaggtatctcggaattcccgtgtcgcatcagcggccgaccgcggcagaagtggaggaggatggagcgtttcgttgacgacctactcaggtctctcaagaagaacgccacggtgggtgcgccgacgaccatggtgaacgtgttccgga

SEQ ID NO: 19688 - DNA, 1501 bp, Oryza sativa
ctatagattcagagcctccaatagttggtgtgttgatttgctgggtcgattggatctaccacttcaatcgcaactattcctttatacttcatcaccaattcgcaatttttagattgcatctcactactagaaaaatgatttttgctagcggcctatggtgccgctagcatcaaaaggccagtgaaaataattcatttgtgctggcggacaaccaaccgcgaatgaaaatagggtttctctggcggcaacaacgactgacaacgaaaattggttttccctggtggcaatcttaagatacccaccagcaaaaacttttttggagcgaacaaaaatgaaaatccaggtccaaaatagtttcacaaattccaaatcattgtcccaaataatcacaatcccaaatccccaatcacaatccaacttgcaacatgttcagattcaaatccacatccaagttttcaggaaacaattcaaatccccatcaaaagagtttattagattcaattaacatgtaagtgtacatgcatacaagcattttgaacaatagcacaacattgaaaaaacagcatcaacaacagcgccacaggtttttgtggccgtcgccgaccgagcagcagctgagatggatctgatgagggagccatcggatttgggaaccctagccgccggcgaggaggtgttggcggcgagaccatgggattgtttagtctacatcacccgcccattagccttaccctaccctgttcatcacaccagtctgatcgtgacattttggttaacaaaatgatataaatccatgtttgcctatccatctcttttgacttgaacggcaagtagtccatagacaggggacaatttaggcattctacagggaggtgtagttattcactgctagacctttttattctcaactgttaccagaattcgggaatcacaaatgatatatagataacacttttttcttccatatatatcaaagatgcatcagcgatagatcacagttttttttatgcatgtttttatcagtgcctcgtatatatacatcgattattttttatacatgtttttatcagtgcctcacatcgattattatttaatttttgttttctgatcacagtattttcatctctttgatggttgttgaaaggtaagcaggaacatgttctgctcgattcggggctaaccacatgccttttcttatcatatcatgtacggttgttgtcccacataatactagatagaactcatgcacattagtctagctatattcaaaaacacattataactatgcctggtagatactagatagaactcatgcacattagtctagctacattaaaaaacgcatgataactatgcctgggtttattgctatctatggtgtgagtgataaacatcatcttcttgtaagtgatgagaggctatatatattctccatttctttcaggagccatttgaactagctagtatgatgagatgccggaggatgacaaagtgatacaca

SEQ ID NO: 19689 - DNA, 1501 bp, Oryza sativa
ggagaatctaaagggattattgaagacatctaagggcagtggatctgtagccaccgtctgaaaaagctcctccagcagagattattagattatactggattatagattatagtaatctatttgtttatttcagcttactcctgataatccagattataataattctaagctgaatcaagtaggccctaaagcatcaaagatttttcatgcaaattagagagtccaagtcccaaacgtcaatttaaattggaactgaaacggagtactagacaagcctgtggaccgggcctcccttctaattccctcgtaaaatcgtacgcacgcacactttctctcccaattcccatctgcgcgggctgctgcgaattgaagcgagctaggacatgggagggagaggacgccacacgcacgcctgcaaagcgcaaggccggccctgggcctaggccggttgtgcgaccgcctagggcccaggccggtggggggcccatcaatcacaccccctccccacaacagcccagcccagcggctgcggcagaaacccagtgtgctgaacctgcgggctacggcctgctatttcgcgcaagcgcaagcccaggagggagagggagcgctttattttccgttttttttaactactttgctatatcttactcgaaagattttttcttatctcttactcgattttctcacttgtgtattttcttgtaagttacggtgtaatttatgaaacttacattataacttttgtaagttaccgtgtaatttttaaatcttcgcatgtaagttttcaaatttgtattggatttggtttttttttcttgaagatatggtaatttagtgctcattatggtgtttcttagttgctttttgtcttttactgtgtctatcagattttaatctaaagattaaaaatatgtgtgatacgattataaaaatttttcgaaagatgcaaaggtgctccctgtttataattgcgacttctttggcgtcttcgttttctttgtttgttttttttttctttccgcaaatcacgacgtactccgcctctggccctccgcgaccacgagcgactcgctgactcccggccaccgccagtcacgcgtcgcgcgcgcggccgcgccaacgacgtacgccgcacggccgatcgacgtacgccggatcgccggactcgcctctctcacgatctcggcgtctctcctggacctctcctgacagtggacgccgacgcccggggctacaggaggagggcaaactgaggttaaagacttcttgtttgttcttgtgttatttcttcaatttttcgaagaaatttaggttagcgacttattacttatggacttaggattttctcgcttgtatgattatatgatttttcgatttttccactctaaaagttaggttatagagtatatatattagaagtaaaaaaaatagcatcaccccttaagggcctatagtgtcgagttcgtctagtgccttccaaatgtcaagaccggcccta

SEQ ID NO: 19690 - DNA, 196 bp, Oryza sativa
tagcccgtcgtgacaaatgtgaagcaaaatggattgaaaaacaaaatcagaagctacagctttatggcagagcttcacgaagagttacatttgattttcaggctgattatggggtggatagtttggtacacatgaagcacatcagtgatttgactacagatgatccctttgatagatcattttgtagatgccgtga

SEQ ID NO: 19691 - DNA, 274 bp, Oryza sativa
ccaccatttcggcgcggagaggagaccgcttcacccgccgatctgcgagaaaccctctccgcctcgcctcctccacctcccaatcttaacccaacctccccccttcctctcgcgtcgaccccttgctttgctcctccttcaaccttcttctttcttggagtttcttgagagagagagagagagagagagagagagagagagagagagaggggggagcggtcgcaggaggaggaggacggcggcgtctgctgcgaccgacggggagcggcgagga

SEQ ID NO: 19692 - DNA, 1501 bp, Oryza sativa
ggaataaaacgaatgatcaaacacgtactaaaaagtcagcggtgtcaaacattttgaaacggagggagcagtagtattagcttaggagtagcaactgtgttactgatccttaggagtagcaaaatgcatatggaggaccatggcccgctttaattagctagttttctcttaaatgtatgtattaagagtctcggccagttcttgtacccactgaaattaacacttaacgtgctcttttgttttcagcgattctgcacttgtatgtcttgtattttgctagctatgtacaatataatatactgtacatatatttcacacaaacgaacgtggcatgctattcatcaattgaagttatgatcaaaactataaaagtacgtaccttaatatatactccctccttccaaaattttgagatatatttctttttcatcaaaaacaagaagcaattaactcactcactatgtggcaaaaccaatgaatatgcaatcaataagtactagaatggcttctttatttccgatcaacaatttcatttagcatatagtgactaaaaatataactcagatttttggagaaaccaaagaataaaatagttctcagatttttggaatgagggagtataatggcatgcatgtcagcatgtgtataatacttccccatcctaaaaacatacaccatatgtactaggaaaacaaatcaacttttagggataaatctgaacatatgcttgttcgaattggtatcagaagtcaatttttttagacggaaggagtagcaacttttccaccttctcagtcgtctcagtcagaatcatcttttaaataattatttttcgcttattttcttgtcacaatcaatcataaccatctcttatttattttcacatatttccttaatcaccacggataatttcagaaatccatatatttgagggcatagggagtggtattcttgttttttgagcgaggatatgtatacaagtaagtattttgtagcaggaaattaaacaaattaaaactagccagacaaaaaaggatataaaaaggatatcaatgtggtgatatctttggcaggaaaggcatatatggatatgaatacccaacacaacacaatcacacatgacatgggtgtgactgccctatagcaaaagtgaaattaagcagagagatacgggcgatgatgctggatgatatggagcagttactgtttactcctatcctacctacagctatagctgcgtgccggggttggggctggctgtacatacaaatcttacaaattaattgctgcacgatatgatatggccactcgcacacatgctgctccagagaccccctcgcgccgtaacgcggcttcgctacggacggcccagatctctcttcctctctctatctgttcgtggctggatcggacggacgagatcgaccgcatcgcatgcatgcagttgacctggtctctctgtctgtatttcagccggtgggtgggggaaaaaaaaaagaaa

SEQ ID NO: 19693 - DNA, 1501 bp, Oryza sativa
tgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcatcacgggctaattccagtcgggactagctcggggcgtgacatcaccacccgatgatctcttttgctggaagaaagccgtgcgccaccatctccttcagattgtcttccatcacatcggagggcgcccactgactctcgaagctttctctttcttccgccatgaatgtgaactagatggtttgatttagctcgagatacggctgaaaagagatggggaatcggagcggtggatgcggggagaaattttgtgaagtttttgaggatggattggagcggattgatgaaccctaacttcgtcggcgcggttctgtactgtagcacggagtggggaatggcgagagtctcggcggggaagacgaagcgacgtttggacttcggtatttttagggtatcgggagtactaatgggcctaggcctgtacagtacttcagcccaattatgttttcagcgtggcccgttgtgatcctaagggacttaggcgctttttgctttggcaatatgtgctcacaatgacacggcccgatgctgttaaaatcctttttaacgcgattcaataattctttggaattattatgatgcacatgaaaaggtgcctgacagaaaggtgttataccatttttttaagcttttttaggctacaggagctgttgggttaatttgagatgactggtttattagtagtcattctcctagcatgttatatgcttattttggctatggtaagagtcacagcctaggctgttagactcattaattaccataattttctgtcatttttggtggatcattttaagagtttcttgctcggattcctaccaaatatatctatttttgggccttttgagtgtttgtcactcggcccttcttgtattttttgtccttgatatattcaagttgagaagcagtcggctgggtatcttactaagtaccatgcgtgcttcgctataaaaccactcggtgcttgactatatgtttagttttttaactaatcacatagtcaagggctacacctaattaggtgcatctactcgatgcaccatgttttatttttgcccttcacagtttttgatttttagtactcggcaagctggagcaagttgaattgaagcactcggactactagtttttgtttcgagaaggttgtttcgtcaactgcgaaggtctcgggggctactgtggagattatggataccccatatctgca

SEQ ID NO: 19694 - DNA, 1501 bp, Oryza sativa
agcagtaacaacagactgttggcccaaggaaattgggctaagctttcgctcggaaccccctaccgccgtggttcgtcgcctaatccgaaaccaccatctaaacatcagcggcacatggcttccgccacacccgaccgacgtccctccgccggccatcttccagtcctgccaacgacaagactgccaccacaccacaccgacgtcctgccatcggccgacttcattgaaccaccatccttgagagctggctcaggacccctccgttccaccacccgctgccctcctcaccagatctgaccgaaggagaacctgggactgggtggcattgcttcggcaacctgagcttctcccgctgacaagctaccacctcaatccagcctacaaacttcccgcaaagaaaaggaggagcaccaggaaggtcgagggtgccgaccaacaacgaaaaagatgacccaccaccgctagctcctgttgcactaccatctgggcctgcaccgacaccggaaacgctaccgctccggctctagcgccggcgccccctttgtccggcttccttgatccacctagccgcgccgcgccgcccacctagccgcagaaggcaccgtgacagcttcccagctgcccggccgctgaggcctggccacgccatctcgcgcctgcaccaggcctcgccgttgctagtcggaggaggcgtagggcggctgctcgtgctgggggcggaaaccgtaggtgggctacggaaggcttgtcggcggagtagtgtggggcatcgtaggaggtggagggagcggagcaagggtagccggactcgtcggagggtcggagcgggcggccatggggcggcaacgccgccgggcaggccacacccctgagccgccgcgcacctcgttcacatccacctccgcgtccagggcggccgcacaccttgctgccacgcaccaccgagccgccaccgccacccctagatggttgataatgtcacaacgtgtctttacaaatcactagctccatttttacctcctgtccactgtccacttcattctttcagtggagaaagatagcttcagatctccgtgattgctgtattttggaaccgagggagtgatgaccagagtttacattaccgtttccaacatgagaaccgttttcgataaaatgggccacgaagtatactcttgatctgggtctaaatttctatagtatcaccctcttaaagaccagtttaccattgttgacgagcccaacaaggcatatattaaccatcgaaagtagcccaattaagaaattgcggaaaaaataggcccagtccaattagcccattctatataatccccagccgcccacttcttccgcccttcacgcatctagggtttcgccgccgcctcttcgtccccgccgcgacgatggtacgctcctcgatctcgcgcccttctctcgtggaatccatgccggccggccgacgtttcgctgatgtgatcgcttgcttgtttcgtttcgccgc

SEQ ID NO: 19695 - DNA, 1501 bp, Oryza sativa
tgatgtggtgtttctttgttcatttagactccatttggcagcatgggctggcatgttgagcttgtgaagtgcctttgcaagcacaaagctgatgttggagctgcagctatggatgacaccgctgcgatccattttgcctctcagaaaggccatgtagaggttgtccgtgagctgctggcatctggtgcctctgtgaaagcaaagaacaggaaaggcttcactgcgttgcactttgcttcgcagaactcccacctggagcttgtgaagtatttagtcaagaaaggtgcagacatcgccgcaaagacaaaagggggtcagacggctctacatgttgcagagaaggatgatgttcgtgatttcctgaaagaatgtgagcagtcattgaagaagggaggtgagcttccatcggagaagaaggatgattctgtgtcaacgattgctgagaagcctgacgatgacaagtcctcgggtgaggctacaaaagacgaagatgaagcggggtttggcgagaagaggaaaagcgatggcattgctgctgcactgaggtcaccggaactgaaaaaagccaaagtttcacttgggcatctaataagtgcaaatgacatggaggaagaggaagaagctgactagactaatgtaggacgcgagaatgcaatttgatggcaccctctacgttttgttatatatcctttgttctcgtatggcaagctgggatgtggacagaactgtatgagcgtgatactaactgtgtttcttactgaactagcagtaagtataactgattaccagcttgagtactcgatggtgtttttgtctccttttctcaaaagaaaaaaaaactccgaaggtggcaggcaaacggagggaagaccattcacctcgacctctaactctgctgctgcctttttttccttctttccactagtacattcgtttaccaattaaccagggggtaattcgatgcatcgtgtctcaggcccttcggacatgggaacgtctcggaaggggatttttttggttaatcccgagggagtataaaagtgagatatgaatcgttctccgttttattttgcaaaaatattcacaggtaaaattaatggtgaagatcgacagttgaggaataaaaaacagcgtgaatattgtgcaaggaaacaaattcaaatttacgtgaaatatatttgatttgatgtacggcataaattgattttaagttcacgtgcacaaaccatataaaaatatttttactaacataaaattttaagaattattaaaacaaatataattatattgtagtgtttagcatggatatattactagttttttttaataaacgtattcaactataaaactttttttatattataggacgaatgtaatatatagtaatttataagaaaatccaccccaaacccccgtcaagagacaaagagaaagggcaagagacaagggcaacccaaccaagaagtaggttagccgagggcaggatagagataattgcgag

SEQ ID NO: 19696 - DNA, 250 bp, Oryza sativa
gaggtgaacctatttttcctatttcccctcccctttagccaccgccaccatccatgccggccggagctgagctatttctgcgccgttccggccatctccctcactccctttgctttccaccaccctcctcggttgcgcgttactcgggaacacactccgccgccaacgccatcattccccttcctccggagcaccgacgccctatccctctccctctctgttgttgctcgacctggagaagaagaaaccg

SEQ ID NO: 19697 - DNA, 284 bp, Oryza sativa
tgtctatatcgaagtgtgatgtgtcagaatagtttgtttaaagaaatcatttgtcagaatgttgtggcatcctactggatggttctttagatgagaccaattttaatacgaaaaggaaagggaaatcattttggtaacagtaaataaatgctggacatgatttttatgaacttcccctatccctagatagggggaacactaaaatgaagatggaatgaatggttttaccatattggtagtaagaggtgcacttaatctgattctttggtatttcagaacggagg

SEQ ID NO: 19698 - DNA, 1501 bp, Oryza sativa
aagatgaggctagaggatttcactattttttttttattttctgaagaatatctagacatgattacattttagaaggggggaagtatatggttactattgcagggtaagataaactttgactcccatgcaatgtcaaagtcctatctcctaaaatataataacttaatactggataggatcgaaagaaagacgtctactatgaatctggatatgacacaaagaaaaaaatcttgaaaatactagtatagaaaaattggagggagtacctttttttttctctttttcacgcggcctcatttgtatggagcccaatatactagtattcgtcggcggaaaattagttgggccgggccgggccggaatctttccttcctttcttgagctgcaagaagaagaggaggaggaggccggccattagaagcggaggacacgcgcacggcggtcgccccgcaaacaaaaactcgccgcggttttacagccaacgaaggcgcagcaaagcaaacgcggcggcgcagcgctcgccgtcgccggacttcctccccccccccgctccgattccgtccaggcaagtgcttccctctccctccctcctctctctctctctctcttcggtggaagcggcgcggctcggtgtacgctcgcgtcgcgcctcctcctttcccctcctcctagtcgcgccgtggatcgcgccgccgggatgggggttttgatctctatgcggtaagaccattcggtggccgattaggatccaaccatgcctaactgtgatgattccggtggttgtttcggttacctgtgcagatgcgaagattttgttacctttaggattcagtgaaggtgcttgtaatgttaaatccgtaaatgtagtagcattatggactatctatgatgaagggattaagaattttcttgctattagttttcatgaaaataatggatttttcccccacacattatgtggtttgattgtgctatttatcttaagcaaacagcaaaattagaccttttgttgattattactacgcatgtcatagtgcaatcttattagtacttgagttcagcaatactgttccggaacatcctttttttttaaaaaaaatgcagagcatctaaaagtggagtgtaaaataaggacaaactgatcttttttttaataaaaacacatgtgccgagagaagcacatctcttactagctctacaactagtgctcagattgttctgcacatcagtagcatagcaggcattaattagtgctgaaattttactcttgggatgtttaggctttccttgatcttctgtttcatagctttgaaatgtttcttaccgcagtgtttagttcagatagatagctatattttcttattccgaaaagaaaaataaagataggtagctagctatacttttggaccgggggagtaatagatttacaagactatcagttgattcatagagagattgattatttgatatgttccctttgcccttttgcctcctcatttca

SEQ ID NO: 19699 - DNA, 1307 bp, Oryza sativa
taactgcttctttaaatgtttaattaactatttcttactcttaataattacttatcatcaactggagtaaaagcttatacacttaattttgtgcccatcagcatcagtcgggccacctggagcttaagccaccatgtaattaaggtggccacgtatacacttaaattacccactggccagtctccacttccacgtgatcatgcatatatggacgacgcatctgcacatccaccattccatcgccattcaaccaattgtaaatctcctcttctgtagccaccagttcattgctactccttgactctacgagtatgtacgtatcatgcatctaggatcgcccatggacatactagctttaacaaaaggatgtgtttttttgctcattaggataacaaaacatgtgacctctttcctagctctttcttttcctagattataattaattagcataagattgtgctctttcattaaatatatattgggagaaaatacaacccttaaggatgtgaaaaggggaaaagcaccttataagtcatatacactgtttggtaagaactcccgaaatcactttgctcatgccagagcccaagtacgtcctagcttctttcttaattttatcaaagaggttggctgtcatggtctccttgtgctaagattcatcgcttcctctcatttcagatcacccaaacgacgacgaggattaaagtgcgcaatccccattttgaaacacttgtcatgtttactagtgtctctcattagtcttgccctttttgggttgcttcccaaagctcaagatcgagctgatgataggccatccaagtggttaccgggtttcatattcttttcttttcgtgtatatgcaattggccaagaggtggagagtcattttgacttctctacagcaaagaaggttagtgacattttgtcattctctggttgcgagccgatcccaagtctaaaccatattttgaatgaccaaccacgtgcagaatttgtatttccctggcgtccatgttttccgaatcagtgaatcgaagcccgtgctttgttgcccctagacggcactgtgcctggtagactgacgatgctggagtaatgcccatgcacaatttgatcaggttcctcaccctccaactggatgtttcctagctagctcttcattttctcaaatattatcacgatgttcttccttttctaaaagaaaatcgtgtgtgatcagataagtcatggatgatcccacctcaccagcagacagcagtaagtcaactttcctggctatatcaagctgttggtgtgccattcagtga

SEQ ID NO: 19700 - DNA, 1501 bp, Oryza sativa; identical to SEQ ID NO: 19675

SEQ ID NO: 19701 - DNA, 1501 bp, Oryza sativa; identical to SEQ ID NO: 19676

SEQ ID NO: 19702 - DNA, 397 bp, Oryza sativa
gggtgtagaatagttattctaagggaggggtgtataatagagctactcgtatatgtatgtatgtatgtacatatatgtatacatatatatacatacatgtatacatatatacatacatacatatatacatacacacacacacacacacacacacacacacacacacatatatatatatatatatatatatatatatatatatatatatatatatagagagagagagagagaaaaactattctacacctgggtatagattagctattctataccccctcctctcccaagggccaaacccacctcccacctcagtcaaaggtcggttaaaagcatcccagttagtcaaaccacggtcaaaccacctgctaactcctcccaccacccacctcttctcagc

SEQ ID NO: 19703 - DNA, 231 bp, Oryza sativa
cgagatgtcgactagaggggggtgaataggcgatttaaaactaaatgacaccaaatcaaaactaacctaagttgctaggcttggtgagggtcaactctaactaagcaactaagttatgttttgcaaatctagggtgatagaggctcaattatatctctacgaaagtaaatcacactcctatgtcaatgtttagcaatcctagggtgatatgatctcaagtttgtctctaga

SEQ ID NO: 19704 - DNA, 363 bp, Oryza sativa
gtacccccattgcattaatcgtgcatctgccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaaga

SEQ ID NO: 19705 - DNA, 1501 bp, Oryza sativa
atgcagagatacgcgatgtctgacgaaattacgtttataaaatttactactccctctattatatattataaatcgtttaacttttacatagtcaaacttggttaagtttaattaaatttataaaaaaatttagcaacatataaaatatcaattagtttcactatatctaatatttaatatattttaataatatgtttgttttgtattgaaaatactagttaaatttgaatagatttaactaggaaaaaaagaaaactacttgtaatatgaaacggatgaagtagttgatttggctgtgacttattgacataagatcgaagatgcattctttttattattattgaaacagagcagcagatagatgcttctcgggattttcagaacgtgtcatgaagataggaataccagaatttatacactactcctatcatgtgccttaggatagtacaggcgtactataatatattgagttattcaccatcaattcattcagttttaaacccctttaaaaatcatccatccaatcgtggcatttttaaataatgttttgtttttgaaatttctttgcatgcatataaaataaaaagggataataataacaatactaactatcatcatttgtgccactccaagaaagaaggaatgataggaaggagaaaaaaaaagaaaggaaaaggagagatgaggaagagaatgttcagcaatttggcccatatattaccgatgggccttccaaatacgtataacgtggcccatcaacctggttcgaattacgtatgcagcccagcaacatgcgtccggatacaacacacacaaacacatgctatgtttggcctaaaggtctaaaaaagttataacaaaataataaatataaaatgtattcatatcctaggtagagtttaaatatttttatttaatttgtagaaattaaatttaatgttgtatgtttgtggagtgatatacggataccttgttaaatgttaataaaatttttaaaaattttgatagctatttgggtaccttgaaagaaatgaggtaacatccactcgaggaaaaggaccatattctaataattatggataaatttaaacgcttatcatttttatatttgtttacctatggagtaaaatacttgtattctgattctacacaggcctgatcaacgatgtgcttattatgctttatgctacttgtaacttgctaatgaagcgcgattacactcgtgactcgtccctgatgccgcctgtcgcacgctcttctcaagccaagaatcgcattccttccttgcatacatagcatcatttcatttgcgttttcatgcatgcccccgtggggcccaccttagtagactgcgggcccaccggtcagcctcctcttgtgcattaattcagcaatcctcccgccatgcatgtgccctacgctttcacaccgttaatggttagcttagctagcccccgaagcggccgagctccggtcatcatgtcttggtccggcgagctgt

SEQ ID NO: 19706 - DNA, 1501 bp, Oryza sativa
agggggcggcggcgacgggttggaccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagt

SEQ ID NO: 19707 - DNA, 1501 bp, Oryza sativa
cgcatagcatttcggcatcagaactagaacttaggattcactagaccaagacaatgcttgtatcaatctacagcatggcaaagatgctgaactatccaaagaccaaactatctgaaaaacctacataagagaggtgcttctcttatgctttaccctttgagaactgcagaaatggtgacagaacctgtcctagttttctcatgagtgtaagtaaaaatggttgctggttgtccccattaggtgattgatctgtgctctcctcatccaccggagagctccagtcagtggccagccattgcttcaccctgtcgcgcttggcgacaagccggcctttgttcctcatggacagcctcagggggctccccatcctgctcagaacctcctgagccagctccctcaccttgggctcacctctgacatcgctgtgcttgccaatgccacacaccactgacacctccaatggcaatgcgcggcgcgccttcatcgcatccacccactgcaaaatcaaaacataggctgcaattgtgctgaatccatggaggttcagcttcacctccgactccgaccaatccatcgccttgtcgagcaccgaagaggatgtcaggagctcctgcaccagctcagcttctgctggccattgagatgcagacctgagcttcttgaccaactcagccgttgacaatggcagtgattcccccaattcttgagccatcgaagctactgttgggcatgagttgagcacaaagttgaaggccttcgtcgtcggcgcaatccgcagcttcctcatcctcctcagccatgccagcatcctggaatggtcacggcaggaggtgtagcacgagagcacgatgttcgccgcgccggtgccgaggcggatgccggcgtcggacatggacgagatcaccctctccatctcggccatggatcccgccttgccgtagcacttcgccaccaatccgaactggaacgcctccggctggtgcccccgagacgccatctccctcagcgccgcctccgcctcgccggcgaggcccatcaggcacagagattttatcatcgccgtgtaggtcttcttcccggacagcggcggcgaggctcgcagctgggagtagaaatccatcgcccggtctcgcatcccgcgggaggagaaggccgccatgaggtcgcagtagaagagggacacctcctcggaggaggaggaggtggagtggaggcgcgagatggagtcggagatgagggatcttgattcctccgcgctgccattgctctcgagcagcgcggcgacggcggcggcgtggatggagctccacttgaaccaccgcgcctgggtgaccacctcgtagaactgcagcgagaaatcaaatcccaccccaaattcgtgacgcgaaatcggcaagaaatcacaagaataatttgggacgcgctcacgcacgccgcacgcgcaccgggatggcgaaggggtcggagtccatgagcaggcgggagagcgcggcgagggcgg

SEQ ID NO: 19708 - DNA, 201 bp, Oryza sativa
aaaaccaccgagtcctcgcggacagcgtgccaaacgcttcgcctcacccttactgacatgggcacgaaagtgcggggtgtcccctccgagatgcatcagccttcgacttctccgaatggacccaacaggctggtggttcggtttccgactgcgccaccgcatacggcgattgctgtgcacgcgtatgagcggcctttacca

SEQ ID NO: 19709 - DNA, 1246 bp, Oryza sativa
agagaaaggtgctctcacagctggtacagtagttcatcaccttatattattagctacacgtaaaacgagaaacatgattagcattttaattaggtattaattattaaaaaaattaaaaatgattttatttgattttttaaagcatattttggcccggtctagttctcaaaattttttgttttggggtgtcatatcggatatacggacacacatttaaagtattaaacgtagtctaataacaaaacatattacagattccgccaagaaactgcgagatgaattttttaaacgtaattaatccgtcattagtaagtgtttacttagcaccacattatcaaatcatggtgcaattatgcttaaaagatctgtctcgcaatttctgtcagaactatgtaattggtttttttcacatttaatactctatgcatgtgtccaaacattcgatgtgatagatgaaaagtttttgttttgtgaactaaataaagtttttatatagaaaatttttgcacgaatattagtttgaaaaaacgtactgatggaaacgagaaatagctaagctgaaccagctgtttagaacacggccctaatgtctttatttgattgatcatctggcatcaatcaatcggctcagtcgctaacaacaaaatactaatactccctactccctgtgtaccataaaaaagaaatctaaaattaggatatgacagattcttagttttaaaatgtattatatttgtattagattggttttcagacagatggagcacatctcaataaaaccaatttaaaattggatttaacataattctatattggttttttgttaggacagagataaatttagaattgaatttaattagtttttattgggacggagcacatctcaataaaaccaatttaaaattggatttaacataattctatattggttttttgttaggacagagataaatttagaattgaatttaattagtttttattgggacggaagaagtagagcgctgcaccctcctcaaatctcaatgatcagtatagtagcagagagatagagagagagccaaaacacacgggttacaaaactccaagcgccaaaaagaaaaagaaaaaagaatgtagtagtaggctgtagctggcctgcactgcacgcctggagtcgtgcagccagaaaggcaaggctgcacacttgctgccgctctcgcctccccatactcagtacagtagctaggaagaaggcaagggaagggca

SEQ ID NO: 19710 - DNA, 1501 bp, Oryza sativa
caccactaaacttggcaaattcgggaactctataatttcgaggaaacgacacattatcataataatcaggatatggctttttgtaagctctagcatgattcctagtttcaatcccgaatctattcctcataatatcactaatcatatcctccatgttattaggcccttgtggatttggcggtgggtttggtggcctaataggatgtgtttgtggcgcaatatgattatattggccttgcatagtatcgggaggatagcctctagaaacatcattataagcattaggaatatgtgggggaacttgaggattagtggtggcagtagatacaggaggatcaaatgttttaaagtgatacaaataactagcattagtcattggatctatagcctgaattgggacgattgtgccggtctgactggcccagggtctgaccgccggggtaatacccggtctgaccggccgtctggacggtcagatcgacggctatgttgcggtctgaccggccgtcaggcccggtcggaccgaccgtgaacgccgttccgtcggttttactacccattggatctataggaggttgatcaacagtggtataggctttatcctttaatgtgtaatcatccataaaagaatcgagcctactccttaaaaaaccatcaactttatccttaaacattacatctaatctatctttaaaattagccatagatgaatctattgtagatgcaatttgttgttggatagattgtgatacctcgtcattacttaccacgtcgggagtgagcttgggacgtggcccgggcttgatgatcatgccttgacgagtcctagtagttgctctcatcaacgcctcccgtgtgagctcattgatgtattcctccatagctttgcgatcttctccttcgaagtcatccaatgtgactggcatcacattagatggctccacctccgtcttggatggcggcttcgtcatggcgaaatcgaagttgagttgacgatgaacggatctcctccccagcggagtcgccaaaaatcgtgttggcaacttttttgacaagttgacaagcacgatcgcagcatcttaaaccttgcggtgatcctagagtcgccaaccacctcgatctagcaaagagctaaacctagatgggttttgataactaaaccggctagcggagccgatttctagatagctacccgtctcgtgggaaaaacggaaggttttcaggacaaaccgacaaagagatgtcgcactctcgcagcggcgacggacggtttacggtgcaaaccgataaagatggacaaactaagagaaaactaaaagcaatataaaaaacgattcgattgattgattgtagattggtttcttacaatgaaccggccatgtcccttatataggggttggtcttgccctctataggccctcctccacgtccaactcggggtagaaaccaaaggaaacccgaaacatgtcttcctgagcaaggaaacttcgagacccgacga

SEQ ID NO: 19711 - DNA, 1501 bp, Oryza sativa; identical to SEQ ID NO: 19679

SEQ ID NO: 19712 - DNA, 1501 bp, Oryza sativa
tttgtgaagtttttgagggtgggttggagcagattgatgaaccctagcttcgtcggcgcggttctgtactgtagcatggagtggggaatggcgagagtctcggcggggaagacgaaacgacgtttggacttcggtatttttagggtatcgggagtactaatgggcctgggcctgtacagtacttcagcccaattatgttttcagcgtggcccgttgtgatccctagggacttaggcgctttttgctttggcaatatgtgctcacaatgatgcggcccgatgctgttaaaattctttttaacgcgatttaataattctttggaattattatgatgcacatgaaaaggtgcccgacagagaggtgttataccatttttgtaagcttttttaggctgcaaaagctgttgggttaatttgagatgactggtttattagtagtcattctcctagcatgttatatgcttattttgattatggtaagggttatggcctaggatcattttaagagtttcttactcggattcctaccaaatatatctatttttagaccttttgagtgtttatcattcggcccttttcatattttttatccttgatatattcaagtgagaagcagtcggctgggtattttattgagtaccatgcatgcttcgatataaaatcactcggttcttgactatatgtttagtttttcaactaatcacatagtcgagggctacacctaattaggtgcatctactcgatgcaccatgttttattttcgcccttcacagtcttttagcactcggcaagccggagcaagttgaattgaagcacttggattattgttttttggagattattttggtcaactgcgaaggtctcgggggccactgtggagattatggttaccccatatctacatggaggttatattccagttggatatatggtaccaaatatagatagaatatctttatgaggacttgggttagattctaaacttgtatgtcaagaaaatacccgggatcctagtcggttacgattgtattttatctgtaatcccatattccgttaggatatggactgtactttgtaatacggaccccttcccctatataaggaggggtccgggttcctctcgggacgattctttttctcccaatcatacaatcaataacacactcggcggaatcatccccggacaggagtagggtattacttcttgaataagaaggcatgaacctgtataaaattccttgtctccaaacccatccactttcctagcttgatagccacccccttttattattgccgaaatttcgtatcggcccatttcgtcttcctcctgctagaatccggttcgaatcacaccatggccgcctcccatccgtgcacggcggcggcgcagccatctctccctcgcgcccatcgtttactctattcagcatcaaccgatgccaaaatttaaattttaaaacttggttttgaagttttttttcgtcgaagattgtcgtttaagt

SEQ ID NO: 19713 - DNA, 1501 bp, Oryza sativa
gtaaacgatgggcgcgagggagagatggctgcgccgccgccgtgcacggatgggaggcggccatggtgtgattcgaaccggattctagcaggaggaagacgaaatgggccgatacgaaatttcggcaataataaaagggggtggctatcaagctaggaaagtggatgggtttggagacaaggaattttatacaggttcatgccttcttattcaagaagtaataccctactcctgtccggggatgattccgccgagtgtgttattgattgtatgattgggagaaaaagaatcgtcccgagaggaacccggacccctccttatataggggaaggggtccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccaactggaatataacctccatgtagatatggggtaaccataatctccacagtggcccccgagaccttcgcagttgaccaaaataatctccaaaaaacaataatccaagtgcttcaattcaacttgctccggcttgccgagtgctaaaagactgtgaagggcgaaaataaaacatggtgcatcgagtagatgcacctaattaggtgtagccctcgactatgtgattagttgaaaaactaaacatatagtcaagaaccgagtgattttatatcgaagcatgcatggtactcaataaaatacccagccgactgcttctcacttgaatatatcaaggataaaaaatatgaaaagggccgaatgataaacactcaaaaggtctaaaaatagatatatttggtaggaatccgagtaagaaactcttaaaatgatcctaggccataacccttaccataatcaaaataagcatataacatgctaggagaatgactactaataaaccagtcatctcaaattaacccaacagcttttgcagcctaaaaaagcttacaaaaatggtataacacctctctgtcgggcaccttttcatgtgcatcataataattccaaagaattattaaatcgcgttaaaaagaattttaacagcatcgggccgcatcattgtgagcacatattgccaaagcaaaaagcgcctaagtccctagggatcacaacgggccacgctgaaaacataattgggctgaagtactgtacaggcccaggcccattagtactcccgataccctaaaaataccgaagtccaaacgtcgtttcgtcttccccgccgagactctcgccattccccactccatgctacagtacagaaccgcgccgacgaagctagggttcatcaatctgctccaacccaccctcaaaaacttcacaaaatttctccccgcgtccaccgctccgattccccattcctctccagccatatctcggaccaaatttaaccatccagttcacattca

SEQ ID NO: 19714 - DNA, 1501 bp, Oryza sativa
aagtgaggttaagtatagttttgacgtggccaagtgtgataagatttttgattaccttttgcaagaaaaacaaattagattacctaaaggccatgtcataccatcgcaagaagagttgaagcgtcgagcatattgtaaatggcatgattctcattctcactctactaatgattgcaatgtgtttcgacgacaggttcaatcggccatagatgaaggacgattgaagttcaccgatggctccaagatgaagcttgatcatgatccttttccggtgaatacaattaatttcaatgataagaaggtgttgattcggccggagcaagccgaatctactaagggaaaggaagtggtcattggtgaaccaagatcaaagatgatggtgccaaagaagccggaggttggtgtttggaaggagaataagagtggagcttcaacttataaggctcctaggaagaccaaagtgacctttgatatgcttttggagaaatatgagaggcaaggtggtgagaaaattcgcaacaaagggaagagaccaagatcacctcctagggaacgatttggtcattcaccaagacggtcgcattcaccttcatatcatcatccacaagacatgtcatggggtccctatccgatgccgccgccgggttattcttatccctacttcatgccatggggggcaacgccgccaatgtaccatcatatgcctccaatgcaattcaaccaagggtggggaggaccaaggaggacaattcatgagcgtttgtcttcgccaaacaatagccggttctatggtaagaatcgggctaatgaagaaaagagggaaggaaagcgcgttaaggtggaagagaggacttcggaagtaattactatcaaagtgggtcccatgatgtgcctatacattctgtagatggagttggaaagtccccaagcaaaaaatccgaagccggtaccagctcctcgcagacggtcggtctgaccaggccctctggccggtctgaccgcggccatgttgccggtctgaccgggccatcaggccggtctgaccgtcgacccgatagtggtccgaccgacgcctcaggctggtctgaccgtgtgccacacgtcggtctgaccggcgcgactggccggtctaaccggtggtctacggccggtctgaccgggctccagcgccggtttgatgagaggattgtaaagagcgatgtgagggcttcatcattttcaagcaaagtcaatagaggacattatttacctcctggaacagagccgaatcctaggtggatgcctaaggatttgacggctactcaaaagagaaggttgcaacgtcttcggacccaagaactaagggagaaaaaggccgaagatcaaagggataaaaggttcaatgagttgcgaccaccaccgatatggaggcctaaatccatagagaaggcaaaaccgattgatgtacaggagaaggaagaacaatcggttgataaaagtgatttatctccaaaagaagaca

SEQ ID NO: 19715 - DNA, 1501 bp, Oryza sativa
tagtacaagaacttgagaatgtgacgtctaagtgcaataacttggtaggtgggtgcgctttaatacaagaatttgataatttagtattttggtgcaataacttggctagatatgctattttggttaatgagtgctatgaaagttcacgatgttaatatgtcatcacatagcattcccgtagatataatcttatataatatgtaagaatatattgctcacctaatttgcaccatcgatttagatatttttttcaccatctcaattaccaactagaaaatttctgcatggtaaaatttgtttgaccttgaattactagaatgacaaaaaaaaaatgcttgtacaaatctacataagtataaccttgagtaggatttaagcacgggtttcgaaccgtctacttttccttatccttatgggaatttaagagagagatcactccactgagtaaccgagagagaagattcaggcaagtattatcaacagagtacgtaaaagctgagtacatatagccaaaaatactcaaaataattaagtttttacaccacttctcaagttattgtaccaaaatcatacccacatttcaagtagttgtacccataagctcatttattaagtttttgtactaggttgcacccacttggtaagttgttgtcctagcatgctcatttctcaagttcctatactaaattacaccaacttactaagttgatgtaccgtgaatgcaatttactctttaacttttatatgtatatgagcaaaactagaaagtcttaccatatgaaacatgtggagtatataggacttgcatcgggcaaaacgagaattcaagcccatgcatcaacctttttctaagcgatattttgaatcattccaaaaattattttgcatagtttaaattgcctttgctctcttgacattaataactactacttccaattccgaagaatttaaattaagaaaaatcaatccgtggtagcatggtaggacaaggatacaaacaatggtgtgggcggtactatagtaccactgacctgccatgccactacgagtggtggtactggtgtagcaaaatcacaccatgatattacaccaccgtggtaaaattgttataccttgctagtgaaaatagcgtagccaaaaggatacaaatctgaaaataagttctcaaagaatttatattgagagtaaagtccatcaccggtcactaaaattgtatcgttgtgtcatcccggtccataaactcgcaaatcgaccgttcaggtcttcaaacttgttcgactgtatcatcccggtccctaaacttgtagatcactcatttaggtcctccaacttgttaagttgtgtcacccccgtccctaaacttactcatgtgaactctaatgaagacaaactttatatcaaatttgtagccctcgacgcgatctacaactttgtagttgatttttttttattttaagtcatttttttgtcccaaaatgtaattttaaaattaaaatatcaa

SEQ ID NO: 19716 - DNA, 1501 bp, Oryza sativa
aatataaacgagcagtaaaatcatgtctccagctatctgaataaaaaacgatattccctcaaatatttgtagaaggaaggatttaaatccaggtaggcttgcacatcaccaccagatccaaggagtcccctcttatccggtacacatatagacctaaattaatcaaaaagcctactaaataagcattgttaaattttgataaaagcatatacgtaaataatgtaagttgctacttctattttatattataagacgctttcattttctttatttgaccaagttcataaaaaatataaacgttttcaataataaacaaacatcgtatcaaaatatattcaatgtttggtttaactaaactaatttggggttataaaaatgattatatttctctataaatttgattaaaattttaaaaaaatgacaaatcgatttatatttagaacggatcggaggggccgggtatgcgaaattggtaaacggtacatcgacaaggcatgttttccatggtcgatggcaagctagagcctagaggtcatggtgattgtaacggagactgtaacggtgattctcatgttataagccattcacaccaatttctagctagtttcctatgcaagatatattgaatcaaacgactaaaaatcatgcactgcaggttagaactgacttgacaattacaaatgaattgccataccgcaagtcattcgctatcaaggatttaagctcaccatatagtcaatcataatgacttgaaaggtcccattcacaaagtcattatgtaaactatactcatttgatagtaacctttttttaaaaaaaaaatcagagacattctagaatctaatatacaaccaagataaaaaataaagcagccagccaactttttttgagaatttgttgttgatttttccccctcagccgcggagtttaggaggaggaaaatcagctacaaagtgctcttctagactttgaaagacgatacgtattggatctatcagtaaaaaaagtggaaacatgtgtttttgaaactccatcaggtcaggtgcaaatatatactacatcaggtattatatagcgtgagtgtttaggcactaataaaaaactaatcagttagtaaaccgcgagacgaatttattaaacctaattaatccatcattagcaagtgtttattgtagcaccacattgtcaaatcatacaacagttaaacttaggccctgtttttttcagcttaagattattataatctagattattgagtcagattactataagctagattgttataatctgtagtagaataagctgttagttgtttctttcctagattattagagcctagattattgggtttgcaagtctaaatagggagtggggtggcatgatgggtaatttttcacccaataatctagaaaaagctcacctaaatgagcttatcaaattatagcaagctgggtttcatactataataagctacttcaataagttgtctgtttctttcagc

SEQ ID NO: 19717 - DNA, 1501 bp, Oryza sativa
agtccacgacgaggatcagcttcctcgcgcggaggaggctcgccaggttggcgctcgtcggctccggcggaagcaggatcgagtcgttgctgatggtgtcaagggaaacagcggaggccgcgtcgtcttcgtcggcgttggcgcctgctccgctccctcctcccgaatcctccgcgtcatcgtcgtcttcctcttccccgcgccaagcgagtagccgaccggtgacgccccttgtactggcgccgttgtcctcctctccacgcggctccatcccacccgtggtggcgtggtagtcgtcgtcgtcgtcggcggcggcggcggcggcggaggggtccatcccggagagcgaggcggcggagaagaggtgggggatccgcaccgcaacgggaaagcttgcggtggaagggaagggtgcgggtggaccccgggggaaatggaatgggccaccgcacgggcagacgcggcctatttattctcggcctgtctactttgcctgaggcccacgaaaacgtggcctgcttggtttgcttgcggcccacgagaagatggcccgttgtcttccccgcgctgcggcggcctccgcgaattcatcacactactccacgccctaattcgccgccgccgcttactcacctcctcgcctgtcgcctctcggtgcgagttctactcaccggcgccggcgacggcgacgaccctggttggcggttgaatcgtcgtcctcggcgtgtgatggtggtggccatggcgacgaaggaggaggagggtgggccgtcgagccgcgtgcctcaccttccgtggatgcggaaccccgtcgacatcgactccttctccggctgccccgtcgcgcaccttccccgtctcgatcccaggtgagctcccccccccctccacacccccctctttttgtatactttcgatcacttgaataagcgattcgctagcttggacgcgagctcctaggcgtcgtggcactgtgaaagttttatgcatggaatgaacttagctgtcgataactatgcggtgaggatgctaattagtttgcatcctcgtggggtatgaactatcaagtaggtttttcctttttttttttttggtcacggttgatttgtaattctgggattaggcgatttgtgtgtgaccataagatgttactccaactggacatcaatggcgttgtgtaatttcactaagctaatagtgttcagctggtgtccgagtattcagagttggaatttgtacaagttcggttagctctaaaacacacatatgcacccatgacccatcttgtttggttctaagagagtttgtaatttcagttgttttgcttgcgaatctcctttattccctcgctattcttgaatgcgttttcagtgcagttaattttgttgaggtacttagaaaggatgcttttaatacttcatgctgttaagaaatactaacatgtttactcctgtgttggctatgttttactgctttaggttggtgaagccattgcagagaa

SEQ ID NO: 19718 - DNA, 1501 bp, Oryza sativa
aaagtggaaacatgtgtttttgaaactccatcaggtcaggtgcaaatatatactacatcaggtattatatagcgtgagtgtttaggcactaataaaaaactaatcagttagtaaaccgcgagacgaatttattaaacctaattaatccatcattagcaagtgtttattgtagcaccacattgtcaaatcatacaacagttaaacttaggccctgtttttttcagcttaagattattataatctagattattgagtcagattactataagctagattgttataatctgtagtagaataagctgttagttgtttctttcctagattattagagcctagattattgggtttgcaagtctaaatagggagtggggtggcatgatgggtaatttttcacccaataatctagaaaaagctcacctaaatgagcttatcaaattatagcaagctgggtttcatactataataagctacttcaataagttgtctgtttctttcagcttactcctaataatctggattataataatcccaagctgaaagaaatagggccttaaaagattcgtctcttaaattagtcgcaatctgtgtaattaattatttttagtctatatttaatacttgatacatatgttaaacgtttggtgtgatagggtaaaattttttttggttgagatctattcagggcctaactgttcaaaaattttcacaatttgaccatttgcaaaaactatttttacaaatgaaccgtccgcaaaacttatttcaaaaataacccttttgttcagcgccaaatcatgtggcgctgagcttagacacctcaacgccaaatagcgtggcgctgaatatgcgttggcatgctgacttagtctcccatccgcgatggcacgacattcagcgccggttgacatggcactgaggtatctaagttcagcgccgagtgatttggcgctgacaaaaaaaaaaggtcatttttaaaataagttttgacggcggttcatttataaaaatggtttttgcaagggtcaaattgtgaaatttttagctaactgttggtatataaacataaagactagaaagcgtcttcaaaggaagttactccgtggccacgtcaccggtaatctaataatgcacgcaaaagaaacaaaaactaagaagtctgaactagtagcagaatactagatggacggctggcgttggagcagagaccgttgactacagatgtgaaccgtcggatggtggctgcctccctcacgacgtccccatttttgcttacgcggcaagaaagaagggaaggcaacttggcatccaaggaagatgcgcgccaaacgctcaccgccagcgtggccccgcgtgcgggtgggcccacatgtcggtgagcggggtgtagggcgtgagcggtaggcgaagtaggaggatgggacacgacaaaggcgtggacctcgcggcccaataattccaccgccgcacgcctctctcccttcctcccctccttccttcctcc

SEQ ID NO: 19719 - DNA, 1501 bp, Oryza sativa
cctcggattcgctcggatttaatcccgcaaagttcgccggcgcatcaatggagcccgagatcgccgcgccggtttccttcctccccggccgccctctctcgctcccgtccctatataattgttccccgtgcctcactcctccgtttccgccactcgccgctcgctctttccgtcggattcgtgctcgcgccgttgtactctctctccgccgtcgccgccgagctccggttcgccgccgtcgtcgctccggacctcctcccgtctcggcgtcacctccttcggcttcgccgcatccccgtcaacctcgtccaccccttcgtttcgcccgccgaccgtcggagcgccgccgtcctcgtcgatccgaaccgcgccgccgtcttcctccgctccgatcgtcgtctccgccgccctcgtcgtcccggggtgagccgaggaccgccgttcgctttcccccttccctcctctctctcgggtgccgctccgccgcgtcggtggtcgccggcggtgaccatcggggcgcgggcgcgccgcctcccgtcggccgtgccggcgaggccgccttcgggcgcgccccgcggctgccaggtggggcccggccgtcagccgcccgcgcccgcgggtgcggctgacgcgtgggacccacggcgccggccggcgtctgccgcgtgcgcccggtccaccgtggaccgagaggctgacgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttcaattcccgcgttatcactgttttatttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaa

SEQ ID NO: 19720 - DNA, 1501 bp, Oryza sativa
tttagccatgcctatttacctttgttaagacattattattgctattgttattattaccttgttcaccctagaataaacaaaaccccaactagtgggtactctattcctggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtctgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttctgcaaaacttaacccctatattatttaccccttgtacccccttgcattaatcgtgcatctaccggtgtgacttgctgagtactgtggttgtactcattcttgctctatctttctccccccttcagtaagagaagcttcagagaagatgtcttaggtggagtcctggcttataccccagttgagcgcctgtgaagatggagccgtaggcccgctagtccgctgctgtttatttttgtttgtcaggcctgaagcgcctttgtaataatgtaaatattatcgatataataaagatgtgtcttttatatcatgtttgtatggtgtaccccggcttttcctgggacggggattaatacactggcgttcgggaaaaggcaattttcccggtcgcgacaagatggtatcagagccatctcgactgtaggataagccaagtggataaaacctaaggacatat

SEQ ID NO: 19721 - DNA, 1501 bp, Oryza sativa
aattgaaagttaggactcccaagagaattcctcatgaagctaaaagagagtagggattctgaccaaaagggcaaagtccaagtgggagaagtagtgccaaactttattttctgatggctctagttcatggaacttgatccctccatgtacatttcaatggcaagaaaaaagaggtcagattttgcatttacaagaatccatctttgcatccaacaccggccaactttttcgacagtgtttccacattgctgtcaataaaaactatattcgagcttatcactagaagaatcatgtgccattcaagaccaaattatatattgctagtacagtagtacttgttggttgctgtgtatgttctcgaaggaccgggcataaactctcatgctcttgctgatgcaaaatgaaatcaatggcacctacagttcgtttgtcaccagtgatttcagatttgtgttgtttgtactaccatcagttaatttactacatgctgcaatgatttattgcagccaaagatgttcagattgcagaaagaacaaaatacttgaccgttactcgtcttctgaaagtctaattgacagtgattgctgcaggtgttctcttgccgactagttctgaacataatgagtttcttgtcgaatttaattaaagagtagcattctgatttctgaacatcaaacataactatattgggatgcagtttctgaagagatgagacttctcaaacttatccaattatccatatgtcctgatcctggcaagtggaaagcattccacaagctgccatgatgtattttagctatcacccaaccaaagaatcgtaataagaacatttaatggtgataatcgaattgtttgtatattccatgtttaaatctgcagttcaaattcagcatatgggttttgtagctatcccttttcctttctgttgtgcctgtcctttttatcatgtgacttgttgaactcagaactctgaagcgtggacgacagagtaacattgcatcagcaaatatctcacacagctaagcttttttcgattcaacaacctcttacgtttgctgtctgctgtcaatggagagggaccagatcagctcaaggctctgtctcaccctgttcatttgaactttttttttttttactgaattaacagacaagttctgaatttcactcagaactcatgtaaaagaggttcttgtgaacattttatctccatgattataggtagtataaccaaaactgtcattgcgtagtttgagaggactcatcgcaattgcgattacttgcgtattagacaacaacatttgtattggagttagaaaactctcacacctttcttgcaactcacctacccacaacaaaccttcagagcaatataggtggagtgattaagtaaagaattcaaaattcaactagtatcatacataatttgacagccatttccgaagacttggtatcaatacatcatcagatagccatggctaaattcagaggaacacacacatgt

SEQ ID NO: 19722 - DNA, 1501 bp, Oryza sativa
ttgccacccaggtcaatgagcttccaatgccagaagagcaggttcccttttgtcatgattgtagagagcaaggacactatgccctgaattgtccatgggtatatgtcaaagaagccccttcccttggtttagcagggcggacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccgtggtggcagagtatctgatagtgaagggtcagatcaagtctcctcggatgaagaagatgagtctccccgacatctcggcgaggaagagatggaatccaaagcatgcccccgttgtggagaaattggacacgttgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcccgctgcacctgactctgcaataaatcatagcgataataccttcagcaccaaccattctctgcaccgacagcctcaacaaagaattgtcatcgatggaagaagttgtgtctctccccgacctactccaggccgagccaagggcaatcaacctccggagggcgataccaagcagaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaacatattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttctgagaggattcttttggaagatgcggatatgtgatcatgtgtataattgtttactgacaaaggagacctagggtctcgtgtcagaggaactatattctaacctcgagttaataaccaacctgtggatggaaaagaaa

SEQ ID NO: 19723 - DNA, 1501 bp, Oryza sativa
acttttagtctattttgcgagattaatctaacgagatatattaatccataatttactacagtgatgctacaaaggccaataccaaagacgagacgagacgagacggagcagagcaagggcagggcagggtgcagacgaaggatcaaacaacgcacacaacacaacaaaagactgggcagggtcgtcgtcggccgcccatgcatcgtctcatccatccatccatccatccatcatgtgcaattatgcatttccttgccctcgttgttttggccggtgggctggtggagccatgtcctcaccatttcatcctcttatagcatcaccaacagattatctataattttcttctaaaaatttattttttttctaaattaaaaatagaaagtgaaaaaactcctccctccaatggatagcctaaatttaatccccaaaacttaaaagtggacccttctgttaaactaccaagagaaaattctgtttttttacgggaacgaaggagagaggcaggattgtgtgattgggagcgactttcgcacccgcatataaacggagcgaggaaccgggagaaggaaactccaaaacttggtaggagagtaggggatctgttgaagctgatttttggactaaaatctcttaaaattagttttggaaatcatataggtagactgttggtgatgctcttaacctattttttccttctacctccgtcctatttaaagaaagtgcatacgtcagtttctatgtttaacgtttgacatatgtttatgattttttaaacagtcatatataaaatagtattcatgttttatcatctaataacaacaaacctgctaatcataaaatattttttaataagacgaacgataaaaggtttattctttttttaatggattggggggctgtttagatgggactaaaatatttagacactaattagaagtattaaatgtagactattgacaaaacctattccataaccctgaactaatccgcgagacgaatctattgagcctaattaatctatgattagtctatgtgatgctataataaacatgtgctaattatggattattagaattaaaaaatttgtcctgcgaattagcaccatttatataattagtgttataagtagtttatgtttaatactttaaattaatatccaaacatccgatgtatccaaacgccacctgagtatattcttttcttttcttttcacaagatcaaagagattaatttctcttatctctactttgcaagcaactttccaactccgcattttgctggattaaaacgctctgagggataaaatgcctcacaagacactgctttgtgggtcccacctgtcagtctctcttccttcgtggttgttgggctactgcagtttgtaagcgcgtgggctttgttgggcccccaaatatccccaaactctatccgcatcgtcatcttcttcttcttcttcttccttttcttctcgcaacaaactcccaatctccggagatga

SEQ ID NO: 19724 - DNA, 1501 bp, Oryza sativa
gctcacggaagagggcgacgatgacgtcggcgatgacgtcaccaccggcggcggcggctcggcggctcggacggctcggacggcgcacgcttgccagtgaacggcggcacttcggcaagaacggtggacaccaacgggtagcggacggcacggcgaactcaccggcgacccaagcgacggcggaagaccaacggacggcgacggcgacgaggaagaagcgacggcggagatcgggtcgacgacggcgacgatgctccggcggtctccgacggtggcgaaggggcggacgaggacggcgacgacttggcgatcccgacggtggccttcccgagcgatgacgacgaccggaacggcggcggcgcacggctggagcgacggcggcgatggcggctcgaggtctcacgacgctagggcgctaccggcgacgagaggcgaaggcgagggtggcggcgggtagagaagagctcgggggtccttttaaaggggctcggaggcagcggcgaaggcccacgacggccggcgacgagaaggaaagttcgggaaaatcgaatccgaaacaaactcgaatccacgaatttccaaacgattttagccggtgtttccaaaggagaaaaggtagaggaaatcccgaagatcatttcccctcttttgattcggccggagaaggaaaggatcggccgatttggaaagcggcggcggcggcgcggcgctagggtttcggccggaggaagacgacgactccgacaggcgggccccacctgtcagcgagcgaggacgcgcgcgcgggcggctgcggctgcggactgggccgacttgggccgaggagagagagaagggttttgggctgactttcggcccaaagccaaaagaagacttttcaaaacctttttcaatttaaattattttttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaatttcatttaaacaacaatttatatattttgaattttcagggtgtgacaacaatcttctcggagaggtcaccgggcaacttctccacaagccgtctaggaggcggcatcctccaagagtaacaagcaatgacccggcgtggagatgatcaagtgccacactagctctacaatggaagcaaatgcacttgactcttggctaatcaaccctataacactagatggatgaacacaaagctcaagtgagtgtgagagaggtgcaaggggtgtatgcaattgaattgggtgccaagagagtccccttgctgctggtgggagagtatttatactcccacccaccaaaactagccgttgggggcgaaatcccccaactttgtgctctgccggtctgaccggaggtatgtggccggtcatactgt

SEQ ID NO: 19725 - DNA, 231 bp, Oryza sativa
tttaaagatgagaatcggattaaaacacttaaatcggggaaaattgaattatgacgcaataatgaattatttttgaaaaggaaaagaaggtttattgcgtcagcggctagggtttcggtggaccgggcgcacgggcggcggttcacgcgaacggacggccgagatcgatccaatccaaaacggacggccgagatcgacggtccacgaccggctcacggcggacgaccccga

SEQ ID NO: 19726 - DNA, 1501 bp, Oryza sativa
ccaaacataaacagcaatggcaacatctgccttgacatcctcaaggaccagtggagcccagctctcaccatctccaaggtaattaacaacacaagaacaacatcatcatcagcagcagcattgtgaattggtaatgaactgatgatgattaatagtggatggtaactcactcataattggtgcaggttcttctgtcgatctgctcgctgctgacggacccgaacccggacgatccgctggtgccggagatcgctcatatgtgcaagactgatcgcctcagatacgaatccaccgcaagaggctggacgcagaagtacgccatgggctaagcttagctgcaagctagctaattgcagctgaaatggcaattggatttggatttggatgcaggggacaatcagtcaatcaccagcatgtcgattagaattcagaaatatagatcgtgccataaaaaaagatagtaataattcttgcttgcaattattaggattgttgttgcaaatctgaatcatcgttatcatctaacctataatcaaaaaccatcgtcttcttggtgaggaggaataataaaagtctgcgattttgacggaattattgttcgtcagaagtgaaattggaattattgttctttaaaagtgaaaatttttcactgacacaaccgacgctttggccgagtggttaaggcgtgtgcctgctaagtacatggggtttccccgcgagagttcgaatctctcaggcgtcgattaacttttttattttttttccaaccaactcgtaatatttttttatatatattttcactttctttcagaatccctacggttacttcgagacgatttttttggggggggattttgcgttacccttgtgtgaatcgaacgctaccacagcccaattgcgaacagtccagctgctggattgaaaaataaataaatataatacaacagctctcgatattataatccatgtgtttgtaactttgtgcttaaattttgcagcgacatcgagagctaaatttaatcttagaaaaacaaaaggaaggcctcaatcgggtcttttgaaatcaggggacaattgccaattaaccagttgagatatatatatcttggttccaggcacttccagctgagttttatttaacctggtgatcttctgagatgataggttttgactgattgttggtgacaaccacccaccaaattgcatccagtttaacaattttcaaacatgtacgcatgtatgatattgattctgctaggctgttgcatagatggcctttaaaaatgtaactggcaaagatacagaattccagcagattccacatattataatttacaaacaggcctctacttcaaagttcaaacatgctctccacaatctccagaaaaatcattatgttactagagctagatgttgactccaggtaaccattggaagttgagtaggccacttgtatgcaacaattggacaagtcagaagaacatcacagatcttgctccat

SEQ ID NO: 19727 - DNA, 1501 bp, Oryza sativa
ttgaccttaggttatgccaaatggttacccatagaagccctctaaaaatattggaaaagtagaactgttctcctccctttctcttttaaaccaaactaatggcacatgcacttcataatctcttttaatggttctcattcaaaatttatttcagtgttattagtactgtacatctattactgtactaatgactcatttaccagcaaaagttttacaatattgttttatttaatcctgctgcaataaaataaatttagcatgtcgattttataactttcttttatttctgttaaaacctgatgatcaaaagtacaaaaatttgtaacctcgttttcaactatttcaacttatcttgcaagcttggtttactttatttacttacctttttactttgattttccaactttattcacattaatccaaaaacttgtgctattaattggataaatgtcttaactccctcctttcacttgtctttagatgccgcgctacaagcctgagtacttgtttggtgtggagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatattccctcagtgatgttcgaagctggaggaagaaactacatccatgcgtgtcaggaggtggcaaggatcgccataggagagcttcgcgatcgctacagtgatcagttggccgatacggagtatcgctaccatcctcgtcaaccacagggaagtgaccgtggcaattaccttgagactgaaggaattgagaatgatgctaccacaaggcatttggttgagatgctgtgggctatggatgaaagtcgtgcggagactgtattagcggctcaagatcgtgaagaccggaatcgtggtaagatttgcaagctagaagacaaggtggatcgtttggagaaggaattagccgcattgaagggagaagcaccgccgcagaaggccaggattcgtctcactgcaatgaagagagctctatttgtccctcgctatcaattggcgccaaaggttcgtgtggtggagaatgaagttgccccaaccctagcagatcctccggtcatcatcataagtgatgatgaagaagaagaatccaagcacacccattccaagattgagtgggtagtaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattccctgtcct

SEQ ID NO: 19728 - DNA, 1501 bp, Oryza sativa
atcaaccattatggatgtaaattgttgccactacagctacaaaccaatatagattaatactgcaccagtggctaccgagcacatatgtagccaacaatattcattaggactgaatatagcttttatatttttctcgtttattcaaagctttgtttgggacattgtaaaattttacaggattttcatatgagtcaatttttttcattaatatcctttgtttcagtttcccatggagaccatattacttgctaatgtgacagtactactacggagtatataccaattgcaattggtagttgtgtagttaattccagctcacctgtgtacaaactgtcaaatggtaccagtgtactgtagcttttacagatgttatataccggtggttgatgacttgatgccattgtcctaacctggtgtactcgttacattgtcctaaccctgtctgtcaggccgagaaacatatatatgtgcacatatatgtagtactatcatactccctccgtaaaaaaaaaaaaaaaaaaaaagaccaaaccctggatttctgtatccaatgtttgaccgtccgttttatttgtttcaaatataaaaaatattaaaaagaaaagtcacgcataaagtattaattatgtttcatcgtctaacaacaatgaaaatactaattataaaaaaatttcatataaaacagacagtcacacattagacatgaaaacctagggtttgtcttttttttttttggacgaagggagtatgtcaaactcaagcttccaaaaccatgggaatgggtgatcataaataaataaatgtcaatttcatactattgtaatttttatcatgtgttacaatcatcatattataataaaaatagttgtattataaaaggacgatttgttatccctatcgggttgctatttggattttaaaactggtccatacaccgaccttttacgtcaagaaaagtttttaagaaggcattcacaaccgccctgaccttatttatgtcatttctttcttctttttgatgattggatttattatttttatcattttacgctttacctactttgttcttttatattttgtgcctaccatctgcccaaactgcaccatccattattgccttatttgtgtctttttcttctcggcgtttttgccaactcagtaatcaactgctcagcagtcattcattgtttttttggcacaaatttattcagtatatatacagaagaagatgctgtaagttcaactaacaaaagttgctgaaaaacctttagaggaaaagtgaaattgttagttggaagataatacttctacatcaagtgaagtgaagttgatgcatctcatatgttgggcaagaaatatgatttctatttcagctctctttggtcatattataagttctaagattgatacatcgaagaaaaatatcaaactgtcctgcattgaaatgcaagtattatatgatttgtgatagaattggacaaattgacatgacaaacttttc

SEQ ID NO: 19729 - DNA, 1501 bp, Oryza sativa
tatcagctaaaatttaattttcgaaccttaaatttggagttgattttatggtttttcatcgaagtttatttttcagccttttcttttagatcgttaagaacacgtatataaaagttttatttgtaaattatttttcgtttgcaaatttgttcagcctaagttttagagctcatttggggcgtaggattcttttacgacgcggagaattttctacatcctccggaatctgaaactagtccctgtaaagtttctgtgttttatgacttgtttgacatacagtactctcaaaatgaagcaaaaaagggataagaatatatcatcagagtatgcaataatataggatttaaaaacaaatgaatgctgaggtaaatatgtttggatggttacgcaaaatagtactccctccgtcccattataagtgcagtgataagtttctgtgtccaacgtttgaccgtccgttttatttgaaaaatttatgaaagatttttaaagttaagtcgcgcataaaatactattcatattttatcatctaaaaataataaaaatactaatcataaaaatatttcaaataatacggatggtcaatgttggacactgaaactcacaactacgcttattatggtacggagggagtacatatgattcttgtaggaaaatatttgcaactttctagtaacatatatgcagaagacaatagagacggaaaggtaggccacattttatctgttttcctttttattttccagatttttgtcctaggttatttggtaaacgcttctagaaaaacttatcaaaaataatttctcatattgcattgttaatttctcctaggacaaagtttctttcataaaaacattgatttaacacgctaatcaagcaatctgcctcaacaatccacataaaaatctgttcaaaaaggaccttggtgtgcattggacttgtcaaaggacaataatagaatactaagaggtaatgagctcatgttaaaattccaacgaaatgaaggtatgtcagaataattttgccattatatttcttgttccaaacaatcctggcccaatttgatggatcttatatgaacatttaaaacacgagaatttaaaaaatgaaaaacacataagtagaatggcatgtcagtgcaatcctatggaatatcaaaatataagaattactccctttgtattgttttgataccacataagaaaatactcctattacagaaatttggagagagaggatgacttttggtgaagtttctcaatgctctaccttttgataaacatttattgtgagcagcaaaccgttttagatgtggttaccgtcatcctatagtcaaaatcacttatattttgagacagagggagtattacagaaatttggcgaaagaggatggctttttggtaaagtttctcaatgctctaccttttaataaaaagttattgtgagtagggtttaccaaactgttttagatagggttaccgtcatcctatgatttggcagt

SEQ ID NO: 19730 - DNA, 491 bp, Oryza sativa
cgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacataaacaagcatgaacagtacatgtggatatttttattgtgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagggatttattgcgtcagcgggctagggtttcggtggaccgggcgcacggcggcggttcacgcgaacggacggccgagatcgacttgatccaaaacggacggccgagatcgatcggtccacgaccggctcatggaagagggcgacga

SEQ ID NO: 19731 - DNA, 433 bp, Oryza sativa
agttttcaaaaaggaccaaaatgtaaaaatttcatacggagggagtatatatcatataggagtactactttggcagttcggcccaaacctcgcgccgcactgccgccgccgccaaagccgcaagccaaaaggggaacacccgccgcaaaacccccaaacctctcgccgttctcttcccccatgtctccctccgcgccgccgtccgccctccgcctccgggggcttcccaaggcttcgctgccggcctcctcctctttcccgccctccgctcgcttcccccaccacctctccatgtccgcctcctcgtctcgccgccctccgcccctcgccgcaacggcggcggccgccgggaccgggagtggcgcctccccatccctcctcgcagccgacccgggccaccgcgacgccgtcctcctcgccgctcgcggcgcca

SEQ ID NO: 19732 - DNA, 1501 bp, Oryza sativa
cttcccacggccttatgcggtttgtagttgtgtttgccttaggcttttgtgtcttctgtgtaaaatttttgccggtttcactttagcaaaacgcgcagttgtatgttatttggcccggttttccttataaacagggtcacacactatctttctaatatattcggcaatactcttgccgcttccacttaaaaaagatataaaacagtcgattacatatacacacgtacctccatactgttgataatactcgatgttgattgaaaatatggttgaagtgtatatgtacctaaaaaaaatatctcatactaccttttttttaacacaattgctgttcataaatttggttaaatgaacaatgtaagcctacacaaagtttcacgaaacatttagggctgtttggttggttgtcacactttgccacgccacactttagccatgccacagttttttaggcatgtgtttggttcgctgccgcaattgtgttataccacactttcttaactttgggacccacatgtcatgctctcaaatttagagctaagcatgacacacttgtggccaactatttctaagccacatttatgccaccatgccacaactagcctaaacttagttatggcaaggttaggcatcaaccaaacatttccttaggcagcattcgagagggtgagagagagtgagtttgtttatttcgttttccgcgcgcacgtttcccaaactattaaacggtgcgttttttgcaaaaaaattctataggaaagttgctttaaaaaaatcatattaatctatttttgaaatttaaaatagttaatactcaattaatcatgagctaatagctcacctcgttttgcgtatcttcccaatctcctcaatccccttctcctcaaacacaccctaagtggttttactcaaaatctaaggtttcttaaagaaaaccacaatatttgtggtttgcatgacagataccctaaacttggtggtttataaattttgcttaatgataaatgacactgacatctttttcatttttacctgtatcacattgtaggatgaaaacacaaaccatgtcttcatactcttgttttctcagtgaatttcaaaaacactatgctatggtctatttagcaggacttccaactcctggagttgagtttaaagcggagttgtggagctgaacaccgcttcaccttcttagtatagtttttcataccacttaatctactccaaaccatttggttgaacttcagtttcgagatagatgaagctggaactgaagccctgccaaacatatgtctgcatttgacaaagatgaattgtggatgggccgtgatagggactcgaggcccatgtaaagatctaaacgaaggattgggccggagaaaaccccgagcttttctacccgacctgcgccgccgcgccgctcgccgtcgcttcccccgcggcgcttcggggctccggcgatctctgctcgagctctgccgccgttggtccatccacgtca

SEQ ID NO: 19733 - DNA, 594 bp, Oryza sativa
ttcattgcgtgcgtgattatgtgcgtacgctcgtgtgttgcgtcagcgtgtaccaccacgtaacagagtttcatgcctactactccagtttagaggtgcaatggatacaataccggttaccgctgggttttcttaccccgtatcatctccaaccatacctattcgaaacagtatcctcccacatagtcactgatatatggatccgtgaacggtgaggctcacatgtcaattaccatgtccttctgactccatgttagaaaatcgcaatcccacctatccgtaggtacaagattctctctatactgtatatgtgcgggcaataactacccgttgcaggtcggactcaggtttaaccaaggtcttaggctaactcaatgcatgttgagccaagacatgtctttttacatttgtgaaaatgcatggtttatatggggttttaggcctaggtccgacccatggcctaagtggctcatgacctaggtctgtcattgacctgccgggtaccgatacacgtgacactttgagcacttgcaatttacactatagtcaaatgattagcaatcatccattaacatcataatgtcaggtatacaa

SEQ ID NO: 19734 - DNA, 1501 bp, Oryza sativa
atatagagcaagggtgagtacgggagtactcagcaagctaggggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggcctagctgatcccgtcagctgctgatttttcaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccacacgacattactaatccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcctagggggtcctctccgacaccaccccggcgaatccacatgtctctcggcatcatggctcccctgataagctagttactcagccaggggtgtcccattccacccatgtggtcgtacttgtcctatgttcggatgaaattccaaggaatcggtccttaagtgcgggagcgggaaaaccgtacacccggtacgttccccggtccgcggttttagaaattcatttagttcgcaagcaccgacctaggtgtcgggttttccaagtcttttgtaaaacccaagttttacccaagttgtttctcagattttaagtttgaaggtgaccgtcgatactcgcacagagtgcacgaatatcgaggcgcaactgggtggttacaaggggacatggtataacaattaaaaaaggaaggatcaaatgcaacaaattaggcaggtccgccaatctgccttgcagacggaacaacagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccggaactacacgcgaaatgggacaactcaacaaacggcgaaaataaagccctattaatgacctctaagcgtgccattagatagatctcgagatttggggaattttggaagttgaacggagtcaaacggatttacggtagggaagatattgaatttctaagattattggatttttggtctaaaggaaaaggatttaattaaatcctttttggaaaagaaagaaaagaaaaagggagagggagggaatatagacttccctcgggcggctagggcgcggcccgagaga

SEQ ID NO: 19735 - DNA, 333 bp, Oryza sativa
tattttggtcatttggacaaaattgtacagtactaacggagactaactggacggcaatggtaaatcatagaagttaagtaaaagtcgatggtatattatagaacgtgacaaagtcagtggcaaatcgtagagctatgacaaactcagtggcatataatggattgtctcttaaaaaaaaagaggtagtatcagactcctttaataatttacttgttcattggatcatgaaattgacagccatccaagtagcggattatagcttattgatgaattgtgttaggaagaagaagaattgcacagtgagtgagagtgacattgtgtttaaatcaattg

SEQ ID NO: 19736 - DNA, 1501 bp, Oryza sativa
ttatctcacatgatgtcttaaatattgtgtagaaaccatgtctcatgcaaaacatggtttcattctcttttctcatttattcacatgtcacatcatttttcatactaggtgacagcttatttaagggcaacaacaatgtatatagcaaaagtagtccatatagatgggacccacacatatggactataactattgttatcttcacaatgtatatagatagcaactagtattaagaggggagaggaaatagagagaaataacatgttttattttatatgggcaacccatatgcttatagttggcttttactattttcttgctatggactggttccataatgttgttaggtggctgaatggaatattttattgcttatggactagttttagactacattgtggatgccctactgatatagacactattctagtcattgagttgaaaattgccttaggccattcccaacccaagacactagacatagttttcataaactccacatcataaaaaaataatagtactagacactactattccaatgcaaacaccactattccatacttaaatttaatgccacctatctcacataatgtcttggatgttgtgtagaaactatgtctcatacaaaacatggtttccttctctttcctcatttaatcacttgacacatcattttttatactaggtggcaacttatttaatgctattgacacaatcctagtcattgagttaggaatggtcttagtacctattaattaataagaagatgatatggtttaaattagatgtggcattcaaatcgactataaaacttcccctgagtagatagatagatgagacttgtaaagtgagatttataaaagcccacaccactacaaagctttcttccttcctttttaaacccaacctcccaacacctttcctcactctcctccctccctccctccctctccaacacgctcacccatgcaacccaacgcccgccaaatgcgcggcggcggcggcggcggcggcggcgggcaggacgacttcttcgaccagatgctgtccacgctgccggcggtgtggtccgagctcggctccggcaagcccgcctgggacctcacggccggcgccgtaggaggaggaggaggagcctccgatgaccactccgccgcggcgttcgacgactccgcgctcctcgcctcccgcctccgccagcaccagatcgacggtggaggcgacaagcccatcatgctccaactcagcgacctccaccgtcatcacggcctcgccgccggcgatgacagcggcggcgctgccgggttccttcccctgtcgctgttcgctgaccggtcgcaggacgacatcgacgccgccttcaagtcccccaatggcgctgtacgattctatatttctatcgcttgctatatagctcaacgattacaacttgaagggtgaattgaagcttcggtttacttgagctatatatggtgtttctttgggttctcttcttcgcaga

SEQ ID NO: 19737 - DNA, 1501 bp, Oryza sativa
tacttgaactggaaaaaatgattctatccccattctctgcaatggcttcaccaacctaaagcagtaaaacatagccaacacaggagtaaacatgttagtatttcttaacagcatgaagtattaaaagcatcctttctaagtacctcaacaaaattaactgcactgaaaacgcattcaagaatagcgagggaataaaggagattcgcaagcaaaacaactgaaattacaaactctcttagaaccaaacaagatgggtcatgggtgcatatgtgtgttttagagctaaccgaacttgtacaaattccaactctgaatactcggacaccagctgaacactattagcttagtgaaattacacaacgccattgatgtccagttggagtaacatcttatggtcacacacaaatcgcctaatcccagaattacaaatcaaccgtgaccaaaaaaaaaaaaaggaaaaacctacttgatagttcataccccacgaggatgcaaactaattagcatcctcaccgcatagttatcgacagctaagttcattccatgcataaaactttcacagtgccacgacgcctaggagctcgcgtccaagctagcgaatcgcttattcaagtgatcgaaagtatacaaaaagaggggggtgtggaggggggggggagctcacctgggatcgagacggggaaggtgcgcgacggggcagccggagaaggagtcgatgtcgacggggttccgcatccacggaaggtgaggcacgcggctcgacggcccaccctcctcctccttcgtcgccatggccaccaccatcacacgccgaggacgacgattcaaccgccaaccagggtcgtcgccgtcgccggcgccggtgagtagaactcgcaccgagaggcgacaggcgaggaggtgagtaagcggcggcggcgaattagggcgtggagtagtgtgatgaattcgcggaggccgccgcagcgcggggaagacaacgggccatcttctcgtgggccgcaagcaaaccaagcaggccacgttttcgtgggcctcaggcaaagtagacaggccgagaataaataggccgcgtctgcccgtgcggtggcccattccatttcccccggggtccacccgcacccttcccttccaccgcaagctttcccgttgcggtgcggatcccccacctcttctccgccgcctcgctctccgggatggacccctccgccgccgccgccgccgccgacgacgacgacgactaccacgccaccacgggtgggatggagccgcgtggagaggaggacaacggcgccagtacaaggggcgtcaccggtcggctactcgcttggcgcggggaagaggaagacgacgatgacgcggaggattcgggaggagggagcggagcaggcgccaacgccgacgaagacgacgcggcctccgctgtttcccttgacaccatcagcaacgactcgatcctgcttccgccggagccgacgagcgccaacctggcgagcctcct

SEQ ID NO: 19738 - DNA, 1501 bp, Oryza sativa
taggacggaaggagtagttccttatgtcggtagaacatgtcgtttggggctttctgcaaaggtccagaaaaaagactgaagttttacctcattctcagtataacgactacgttcagtaaagaagcagtatcatttcccttaatttgatacaatatcaagatgtctcaataatcattactatcaaaatcattatgcaccttgtatgcatatacagatactcttgtactgtactagatttatttttgacctgaagaagcaggacttgatgattgttagcatcgttgttggtcaatggctattagtagtagctatgactgtgtttagtaggtcttggattccatattcagaacgcggaggataatatgtggtcatctggacacgctattgcaattgcaggcattgatatctgaagcgcgttgaagtggagtgccctctagctccctccctgcttgctgatgccgcagttcgtacgtgagttttggttaacgtttgagtaaattaagataagcacccgtgttaagtctcaccgaataaactgaataagaagaagaaggcacatccgatcctatcacctatggcgatgtttgttcaatacttgagtccttttttttagataaatacagtacttcggtctggtgtattttgtggtgcaatttaactccataaattactttcagaaatgtgcagacctagcaatgtaatttcaaggtctagtaatgtaaatgagtgaaagaaaacatgaagaaaatgaaagctgctagggtttgctggcaagaaagagaggattgagaaccaaaactcgtcaaaacaaacacaagtgaaatgatttggttccactaatttcgtgtattattaattgacagttttgtgcgaaggaaaaaaatacaaaggggttttctacacaattctagatgcaattttttaatcctacaaaatatgccatgagtacaaggtatgctcatagatagttagatggataaatgactctttttatttacattagtaatttaaatgtgtatttttaaagtaaagtgacttgtctaaataagctggattaccctttatacattttactttaatctctttgtctcctttatcttgcagagactgtaaattcatgaggtgatgagattattactgcaaattggatatggagaagttgttctttttttcttgtgaaagagcgagaagttgagactgagaagagcagccagcaatggacacaggaaatgggagcaagaatcttgctatatgtacgaccgagccgtacgatttgtttccgaccgagtcatgcaaccaatcactgaaattatgcttatacatacaccagtccaatggatgggtcggacgtatagcaatttcgtgggagcaaatagggatcagtagtactgtagtagtagtagattcgcttgccgtcactctcgtcccgtttgccgctgcactgcactgttgccctcggccgctggctgcctggattagtggtggtgacccaaaagtcaag

SEQ ID NO: 19739 - DNA, 1501 bp, Oryza sativa
ccctacccgctgctatcgccgggcttccagcacccggggccactcacgcccaacttccccgcgctgtcgccgctgccgggcactgggatcctgggtccagggcccatggctccgccgtcgcctggcctctggttcccgcagtcgccgtcagggctgctctcgccctccgggttcttgccaattctgagcccaaggtggagagagatgtagtgcacatcgctcgccgcagcgcagcacaaagctcccgtgaaggccacagccgggtaacatttgacgctagggttgtagctactgtgaggtgaattggtcgctgccccggagatgggcgcaggtgggttgcagcttcggacaccactatttgttgctctcacttactgcttgtgtgattagtcagtcattatatcagtcagtctataaggtggttgctcatatatttgtaattgtataactgggaaagtttttaattcattcacttctcttagctgcaaaaacctggacagcaaaaactgggcatgttgtagtttagactcttgagtgattaggcttgaaacatgtaattgtaaaactttagttcattaaagattagccctttctcactgttattttgcttacgagtgatgtttggtttacctactcttgagcagaatgtttgccctacctttttctttcctagggggaagctaacttttagacatcagcttgacaggagatcagcaactctgtcttatttgtaccaacacctatcagatgagagttgaggtttagtacatcattgttatcgctatcactttttgagcgcttgccagatatactcatatatctttacagtaatatggaattaatattccttatccctaagtgtgtgatgtatatctttacattgtgatagataccgcagcaatgttactttcgaatttgggaaatgccacaatgtgaatcatgctagtcttttcatgcatccatggagcttgataagcttggttagttggttgcatatccatggttgaaaagtattggttactggtttctgccagggatatatatacctttttggtcccagttattagcatccaaaaatgtccatatacctttttgtacgaatggggatacactgatatactctttggctcttgtatgctactgattcattttcttgtgtacctacaatgtgtgatggacccaaaagttatgcaacacactaccaataatatatcctctgattgaaactttcaatgtgcaaaaaaaaaaattctagataaatttgatatttcttgaaatggtgtggttgatgtgtattattctgtgcatcacagaaatgctgttgcttttgcaagtgagggttcctgggttatcttaattttcttctaggttctagccttttgagttatatggcttattatagtctgctattcctctgttctaggattaatttgacatctccttgtgaatcctggccttgtaatgataaggtagggaataacttaagggtggttcgtgttgt

SEQ ID NO: 19740 - DNA, 1501 bp, Oryza sativa
gcctcctctgctttcgtctccagctccgactggaggcgggacacctccgccgccagggtcgccgccttgtcggcgttggcgtcggcgatctgcctggccgtgttcgtggcctcgacggccagtgccagctcgtccttgaccctgccgagctcggcggcgagctcggcgcggcgcaggtcgatggcgtggcacctggcgttccagtcgcgttctttcgtctgcgccaggtcgatggcgagctgctcacgctcgatggacttgaagcgctcgaggtcgagggcctcctcggcggcgctctgagcggcgtgggcgtcatcggcgaggcggcgggcgagggagaggtcgtggaggagctgggccttgtccctgtcgatgacggccaggtgttcccgcgcgttcttgaggtcctcctgcaccgcgttcagctgcgcctgcagcagctgctccgccgccgacgccgccgcgggcctcgcattcgctccgcgcgctttctgcattctcttcgatccaccacatatcaaccgatcaatctaagaaatctataaaaactgaattcgttgatcgatcgatgagaatgcatttgatccaagttagttggggaaacgtacatcgggagttgtggcccgggatgccttgaaggatcgtcgttctggcttgggtatgtccatggaagatttgtcgagcagcgcattcgcattcgcatgcgcattgttggaggtggaagcagctgatgatggcctgacctgctgcagcctagcaactctaggcaccgatgaggaagccctgcagacgatttagctttgatcaccatctatccatcttgttactccaattaagagaatcaaatactagacatgaatacatatctgacgactgactattgatgcagcagcagcagtaataaagctagtattagatgccttaaaattaacacagtgcaaatgcaatgcagggagatgcacacatacttgggcttggatgcttgctgcattttgttggccggccggagcgtacagttttaagttgagagatggagcatgctgcaatgcacacagacaaatgatctctcgtcctatttgttagtatgagctactcctatatgatagtatcgatccatcgatgatatatccaggtccagtatggcaacaatggacgtgctgggctgtttcgtcccttaataattatggcatgcagaccactactctaatgttatacgcatgttgagctggtgatgatcgatacgatcagtgcttttgcctgacgttgatgcccaacactaaacacgattacatcatactctttaactcatggccccatgtttgacacacgtactattcttcttcaaggttttattttgcttgatgatttcttatttaaaataatggcatgccaacacaaacctgaattctaaactctaaaactaaggaattttgtggcttccaagttatggcaactttgaggaataaaaaaaatatagttgttgatgttttatatgtgaggt

SEQ ID NO: 19741 - DNA, 463 bp, Oryza sativa
cctatactacttacacgagattggaggcactaggcctcagtacatggcacgcgtgtataccttattaccgccgggaccaactgaaagaagtcagtcccggataaagaggggaaaaaaaacccgggcgagggacgagcgtcgagtctagggggtcgaaccagactcgtaggctggtcggcacggagcgagccactggctcctgccacccgcgcgtagcggtcctcgaatcaatcaatttcctcccacgggaactccatggtgatggtgggctgggccagtccgggccgtgttaccatctgcaacttcgtgccggccgggcccagtacgggaatcccatcccaacctccggcaggagcccaggacggcacggcgcaagtatccttgttcctccggctctgctcctcctcctcctccttccaacaagagttgattctacagtacagatccctccctcctccaagct

SEQ ID NO: 19742 - DNA, 1501 bp, Oryza sativa
cactacttagattcattgtccccattccgttaccaaaagtgggtgatgccgaatcgcaattgaaaggaataggggaaggggaaaatttctcaggcgtaccattaggagtaaacattcccgcaacacctccgaactgctcctccttagctcctccttgaacacccgaagcacttgcagcagagaatggttcaaacttgacttgccgcatcgtgttgccttccagctgctcgaccttggtgctcaaggactgcagcgactcacctagttcttccaccttcttctccatcgccggtatgcggccctcgaccgtcttcttcaactccaagtagtccgccctggtacgctcctccgcctccatcctcttcttctcgttgtcagcaatggtcttgaacaagagatcaaacttggcgtctagatccatggctagttttggaccgtaatccctcacatgctctccgaatttagccaaccagattgagggagccgaaacttttgtggatttctcaccgccgaagcagccaaatcccacctcgctctggagaaaaatttacagccaaatcaagaggaaatgcagcacggaagggctctgataccagattgttagggctcacaaggattcactcaagcacacacataatttggcaacactatgatagtttcctctcagatccaacaggatcgagccgccgccgcctacgcctccagttgccaattcaatgtcttaattcagtttacagaacagtatttaactaacaccaacatcacgccagctcacaggcgagcaagtgactcacgcaacccagtctgggccttggaccttggtattgggcctcctcagacgagctggatgacggcccaagtcttcagcttgtcttcctgcttcttctgccttctcaatacttggctcccttctcttgtccttgtcttcttcaggatcacactccctgacaattacttgctccttgctagttggtacttccttcacctaataagctaaggacaggatttccacacaaattgcaaattcggtttcttctggcactagtatggatcagtcttgtaattttggtcacatattatttggtggagtctgtatcgccaaggtaaacagaagaacaaaataataaacaaaggtatcacatgagctagctcagcatgctatacgctgccgtagtagtgctctttggctagctggagtcgactctggacggtatcaacgtctattgcttgaagattgtaatgctccttatgttcaattaataagtctctcttaccctcacaaaagaaaaggacagaaatttaacagcccaaatgcatgaggaatttttttaaaaagtggaatggaatatgggccaaaagcctattatcattccgctgcccaacctaacccactggaaaggaaaatatcctcttcccaatcccacctgcaaatcaaggaataagttcacttaggatcccttgtcttgacgtagagtttgaatcacgtcctggtaccacagta

SEQ ID NO: 19743 - DNA, 1501 bp, Oryza sativa
atcattattaaatcgaaaaattaggtttcactaggaaaacaattggatacgtacaagcaacagagagatgataaggtcctaggcctagcaggaaaggcatggggggaagaagatggaagatggtgtaccttgaggtgagcattgtggcgcttgccggctctccacctgcggacctggccgtcattcatgactctgaatcgaaacttcatggagctagtagtaaaaaagtagtaagtgagaagttgataatagtgattgaatgatggaagagaggagtggaaggagggatgcgtacgaggggggcttgatcttgtacttcttgaccttggaggtggtgggcgtccgtggcgcgcgcgatctgtccttggcggcgaagtggcgcacctgctgcgtctgccattgcatcggcggtggggaggagggatggagacccagaggaggagtcaagaggtggtggcgggaggagaagggcaatggcctggggctggggatgaggtgcgccggaagagggcggtgggcaggggcggagacagaggaggagaggaggcggcggccgaggccgaggccggcggcggcgcaccaccgccgcatcgtgcaatgcctctctcttgtctgttgttgttagggtttgttcgagaaggggaggagtccaagagggatcgagcgacgagagagatgaaggcccatattgcatccagcccaattgatatccggcctagtgacgtgggcccagttaagcccatcagtctgtgtcgctttctcgtggctgtcgtgggtcaccaatccttttcccttataaatatatgtataaataattgaaaaagaaaataaaaatccccacgaggtcaaaacagcagctcacaggttgcaagtggcagtggagtagtcatcaattttccgtggagtattgtatttgtatgctactacctccatagttttgcactatttatgttcaacgtttgaccgtccgtcttatttgaaaaatttatgaaaaaattaaaaacatttagtcacacataaagtactattcatgttttattatctaatagcaataaaaatactaatcataaaaaattttcaaataagacggacagtcaaacgttgaacatgaatagtacaaaactgcacttattttgggacggagggagtagtattaatttactactctatccgtcccaaaatataagtatttttatcacactaataaatcaaacatttttaactttgactattaatagaaaaaataaaaaaagttcaatcatgtaaaattgatgttactaaatttattattaaacaaactacagtttttttacttaaaacatctcgtttttatagtatatactattggtcaaaataatatagatcgtattagagtctagaaatgcttatattatagggtgtagggagcaagttaatgaggtgacagagaccgtgacgatgcaagccgacaaatacaactactaggagttggggtcttgttcgccaccattacaccattcca

SEQ ID NO: 19744 - DNA, 1501 bp, Oryza sativa
gatgtggactattgaatttgtttccatgtaaaagaagagagtgctagtattgcagcctaattattaatctctgggtatatacggctggtttttgctggaatagccgaaggagaccatccaatattattaagataggaagaaaatgttacaagaaaagttttacattgacagttggctatcaagcaaggatgtacaccagagcacacgccccggatcatgtgccaaccacctaaacacatgctacagagagggaagccgggcaccgaattggctatcgctatgcgagaccgatcaccaccaccacggaacgaagactctaaaaattacgccctcaagaggtaaaaattatgccctcaagagggtcgcgacaccgaaagacgccgtcgtcgtccgtccaaaaaactagacaaggtttacacccagagctctttgctaagagaggaggggtacctcaacagtgtcctctggagggttaacacgcccaaaagtatgatcattgttggcccaatgacttgggctaagctttcgctcggaacccctacaacccctgcctccatggtccgtcgcccaaccctaaaccaccatccaaacatcggcaggttatactaaacatatacggccggttataccacagtccatgcacttgctgatctactgcacatactacatatgctctgagttttaactcatggggttgctagctgctagcttaatttaatcgatccttgtccattcattcattctaccttgtcgtctaatccttggaaacgagaatccaactctagctactctagctagcagtgtggcagctccaaaatgcattttgtttgattaataatttttacagatatctacacaagaatcatgggtcaggcatacatatatactagttggcagcccgccccgcgtctttgccatgggttttatagatttatcgtcaaacaaaatcatagttttaaatggttaagtgcaactctatgtatatataaaatatatgataatgtggatttatatatgccttatgttattacaataccattcatgttttgttttttcaagtgtcattgtgtattgttataatatatgaatattatcttcatgcgcaatatgggtatcgttgtagttaaacagtttgcatctctctaccccactcaagttttttctgaaaatggattcaggtaactatacctaataattatatgcaaccttatcatgcataataaaataaaacatacatattaaacaataaccacatattatatccggaaaacatggtgttatgcataaaatatgtagcagtgctacgtgtgactatgaggtggagcaaagggaggtgaatagatggataactaataaatgattgaattgaatgaataagtagcttcttggttcagcggttgttatctttatactaatatgatctgatggcttaaaattgttgattatgtggctttatagaagtaaatgcttcttaatgggtaccaactatatataaagatag

SEQ ID NO: 19745 - DNA, 805 bp, Oryza sativa
cttacattgtgaaacggaggaagtagtacatagggagtactactgctgcagctgcaaaaataccagccgaacacaaaagtgtttctacctagaatttttgtagatatgctctcacctccctccgcccgtcgcctctttcgccattgcagcagccggcgcgcgtgaatccatgcagctagcaacggtgtgagatcccgtacggcgcagggatggcgatggcacgaatccagcaaggagatggcagccacgtttgcgtatggagaacccaactgctggttgaatcctcgcatactaatactagtggtattcataaacttcaagtcttattactactccatgacttaaaacagatcgagattcgagcagtacccaaatccatggggctcaaatctgatttgagggagttgggcatggcagcaactagtagttggattctaccacattcaatccaactatagccaaagttcaatccatgcccttctaccgcgaaaccagatatagaggatcccttgttccgtgaaaccagatatagagtgtccctcaattattaaaactagatcaatttaggttcctaggcggttgtgatggtggttttgtcatgcgtgacgtcaatgttggcatttcaattagaataaataaataaatgaaatatgcagaccttacatatcattggcatcttcttcctctgccctctctctctctcatatcctcttatttctctctccatcggtgggggatgggcatgagataaagcgttctccgtcaacgggagcaccatgccggagcatgctctcgatgacagcca

SEQ ID NO: 19746 - DNA, 898 bp, Oryza sativa
cacgccctatactactcaatcaggaataattaactattttccacttttacgaatggtcataaaggatttgccattaaactcatatgttatagacacatgatggtacacatgtcataaatagtgagtgttaaatccgtaattgtcacatcttaaaaaaggcaaatagttaaatgtaacactcaatcatacttaccccatcccataaaaaataaatatagaattgaatgtgtcttattttaatataggacgtgactacatatctagtggtaattgttttgtctaaatcaactaccacatcatctatgagaaaccctatccatctatacttgaaataaaatcttctcttaaatacttatccgatttatgattcgattacaccgttgtgttcgtaacaattaaatctttataataaaatctcacatggttatattttgatgaaaaattataaattactttataatatatctaaattacttttagatttcactaaattacttcttagacatataaaagtaaattcaataaagcctaaaagtaatttacatatattatagaagtaacttataacaaagagaaagtaactttaatgcatacttttttcattgtggacgtgactacacagttagtgatagctggtttgtactccatctaatgtcacattttaacttgaaaaatgcaatagtatgtatctttttctaatccctttaataaattatatattttaaatcacatattgtttttaagatctatttgcatcattgtactccacccaaaatatgtgacaaaacgagattcatattgattaggaaaacgtacgaattaccccccctccgaactatcatggtcgtctgaattacccccctgaatcacaaaaccggacattcttcacccccaacta

SEQ ID NO: 19747 - DNA, 690 bp, Oryza sativa
catgctatataaccaatttttcctttaaaatatagctatttctagcatgatgtcttgttctaaaatgaagctatttctccacctaccttctcctcacaaccaattataaccattcttctttaactactttttttttcaactaatcataatcttctttcaatcatttccacatattttcttaatatccgtactaatctcaaaaatactatattttaggacaaacaaagtacgagactttacaagcaccaaggctacatagttacaggtcatgcccagcacgatgatgtgtcgagtccaaaatctggtgatttcatccccaaatttttgtcggaatgctaatcccaaaagaaatagctcatgtcgtcctttgatcaacgtgatggcaatttagcagatgacctcataaataaaaaagggtcgcaactgccatcgttagcatgaacaaaaaaaataccaggattttcttgctacctgcgatcaagtcggtaatatttcttctgattaatgaaagttttgaccttaaaaggcccaaagtagtggctactacaatacgtccataagtaatgggtaatgccaaggagctcgttctgacaatgtaactgctgaaatgggataattagcaccgaaaacaaacaaataatcaacaattgcaataaagaacctactcgagttcccacttccaacaccagt

SEQ ID NO: 19748 - DNA, 242 bp, Oryza sativa
agacaacgtggtagccaacccgatgagccaaaaaaaattcgaaaaaaaggagaaaatcggtagcactagggcttttattaattgatgatgtagctaagaaagtacatcaccgatcaaatggcagcatatgcgggcagcacacagtcctatggtgacctatgtagctacggtgggggggtcgtcaatagcatatcaggagatagtaccgtcgcagaatgatgaaccacttcaaataactcagc

SEQ ID NO: 19749 - DNA, 1501 bp, Oryza sativa
ctatacaggaagtggtagtacatgtggggcagtgagccgcagatgcaagtgcagtggcagccgcagcgcagcgcatgcagatgcaaggtttccgtttctgcccacgccaaagcggccaacaaaaagcgcgacgtctcctgcagttgctgctcttccattccacctcgcatttactcatcccttctctccctcgctcgctcgcctcctcgcctttttctccatctccatctcgcatcttctctttctctttctctttctctttatctctctctgttgctgctgatcaagaagcttggagagagggagggagagatggatcggtgcataggcatatgactggaggttagtgcttcggagtggtctgtttgtatggatggatggatggattggaggaagggaagggggattcatctgctggttttggttgtggattgtgttcttcttcttcttcttcttcttcttcttcttcttcttcttcatcaactgccctgcaattctgccctgtttcttgcggtttctttgatgtcgtggttgcgtctcgatttcaggatgggcttgaccgctgttctgtctgtctatcttatttcggttggctttgatttcgcggtttggtttatgtttttgctacatgcttcgtctccatcgtttgtttgattaacttcttggcataatttcgatttcgagacaaaagggtatgaaatgtggagttcactgcaaatcaaatcatatgactagtttagtagcatgaattaaatagtttattactacttccttttcttgaaacggacagagcatttgacgttaaaattcacaagccttttgtgtgggggagaataccctgaattcattttccaaggtgcgatgcgaccatgtgcgcagagtgatcttatctctatcttttccctgcagcgaatgggagccaaaatcttatttcatttttaccctgaagaattcagaaagatggtgtctttggttggatctggataatgatttgcaactctatgcagtctttttttttctttttgagattcttggggggctaaagatccatgaatcttttccagtcaagaaacaccaccagagaaaaaaaattcttctttttctatcacctttccccccttccctcatcagctttgctagcatctaattcttctgcatttcatcacacaggaccaagctgcataactccccctttttttatcctaaccttttggtattgcctttgcttccattgtactgctgaccctctggatgctgtctccttgtctcaatactagcattactcctcttccataaagctggagttcactttgttgttgagtctctctgtgtgtgtatatcttcttgtattcattcatactgattactgctgcatttgttgtgtgtagtgtaggcctatggtaagtgtggaggagaggagagaaagggagatggagattttctgagatcttttgggcatataaccttttggatggtggatatggagaagaagagggagaag

SEQ ID NO: 19750 - DNA, 1501 bp, Oryza sativa
atcctctgaattatccatatgtttccctacaaataaataaatcctcaataataggctaggtggagtccgctatttgcaaatctctattgctcaattgctttcagcctcaagtgcaatttccagaacacgactttttaacgattagaacgtcgcttacattttgtaatagctgcatctgaatagtagtgtacgcagtacacagtgactacacctcttagatctggattatatatagtaaatcaaatttctgatttgtatatgctgcatattgccacggggtggtttactaaccacacacacgtcggcacgcatgagtcctgcagcattagacacggggaatatgtacgcatacttacacgcgcgcatggaattatctacgtgcaataagggtcatcaacctgtacaagtgtacaggacatttccaactctcgatcgatcgacccatttttcatctctttctgcaagatctgtacttcttttttacctctcgatcgatcagtggatggtgaccaagacttgctgataagtctccattaattgttaaatcttgggaaacttgcagtgattaatatctaagtcgggttcacaatctcattaccggacaaaagccactcacagtcacatgccgtatctggttttcgccaaaaccattattaaactggcaaaaaacgacgaaattcagacatattagtcaacaaattgaacttcagtatgaaatttcttgtaaccaactgtttttttcttatcaagccagtttaggaagtatatatgcaagatgcaaaattgcaaaaattcagtatgcacagcagcacacatctcgatctacatgcagagatcaggccggtgcatgcgccgacgagacgttgccggtcggtcgaccaggccatcccgccggcaacgccgcagaaggccggcaggcacagcctctgcgccgccacaatccgcgccggctcaccgccctgttccgagcagtatataaatgctgaacaattagctggaattcatggagagtttaactaatcacttttcagtctcctcttgttttcggacatgattaataatgtatatccggagatcgagagccttagcaatgggaggcccaagaagatgttgggagtatacatgcgcctcgggctcggagttgggttacgcgaaaacaacgctagttttagccagtccttcagcaacaagacacgagctgcaggaatcaggatgctcgcaagcctcaagaacagctaagcggctagcctagccatcattctttttcttttatggagtggcaccctttcggtttaacataacccgtgtttgatcttgcgcaatcgatcaataaaagggcgcacaaatgaagttgtgaaacaccaggtaaaatgcatctgttgaaacttgagggcgaggtaggccgttggtacagagaggtgtgaatatttacgcaaagcaggagaactctaaattctaatacaaacattatttcttcggattatatatgacttatgccttc

SEQ ID NO: 19751 - DNA, 240 bp, Oryza sativa
caattgggaaaaatgaagataacctgcatgatgttaggcatttttttatggttaaaaactatatcattacggcaacgccaaattgaccaacataaagcactagctccaaacaaaatcattttttttgtgggtctaggcactccccttagccagtcaccaaaaatatcttttgcattgtggggaggggggatgttgaaggcaaagaagacacatcgccaagcaaaacgtgcaacatgatag

SEQ ID NO: 19752 - DNA, 373 bp, Oryza sativa
agaggcgactggcattagatatcgtgtgtaactttgtactccggtaactaaagaattttatcttttgaaaggttgtggtacagtttttagtttcaccgtactccagtttagataaactaatcgtttagaaccaataagcacttcatccaagtgtttagttcagagtctttttaaatagtttttgttgacaaaatatttttaaatagttaagaatcagatgacactcttggaaataatgcactattcatctgatgaaaaggtgtacagctacagaacctgtatattaaaaaaaaagaaaataaaagcaatatatagaatcatttaaaaaggaaaagcaggaggaaaaataagctcattggtgaatgtcatatca

SEQ ID NO: 19753 - DNA, 1501 bp, Oryza sativa
taaattattcttggtcatggtgcacagatattatatgatcaatttgggatggaggtatgtcttagacttttggatagagggagtattaattgggaaacttaaagcaattgagcaatagtaatttgcaaatcagacattatcttctgggttactttcatcacatcctactacatttcgcacaatgcatagggagcaatactgtaatattgactttgatcgagttaggcgcccatgaaaatgctcgaactcaaagacaaaggtaaaaaagttccaatcacgtcatttctatgcttggacggtagcactagtgcactacagtagtagtacctcgctaaggcattccttaacctcaccttcatgtttgcagtaaagaaaccgagaacgtagcgacgattccatttgggcaaactatgcatttagcctcggttcatgtgaagcatgtactgcctgcattgcattggacttggagttggcagatcagtcaaataagaaaagccaatgacactgtcaaaaactccatgtctgaatctgtcacctgctttgtttttactagcttgtaaccttctcttctgactttttagatcttgcggtgcttgtgtacagtcatatacagagatgcaggtggcatacactgcatatatgcatgaccagaacatcttcaccagaaccgatgcagtacaacatgcatgcatgaagcatgcctggttgattaggatacttgggaagttgggatccgtggtagcagagagtataatatttcaagtcaaaacaattaggaagcaactgttagtgcttgtaaaaaaaatgaacagtaatttagacatggacgagggttcaaattaattttgctctgtgagctagaaagattgagcagttgcacaagattgatccttaagagcaaactgcagctaaccatcaaattttatcggtagaacatcgtgaatcccagctcttgcattataatctagaccatgtactgcttaatttgattgggtaactacgggctctgtttgcccaagtttttttttagataaattctatctgtgataaagggtggatcacatatatgatatccagataaaattgggatcatgtcatcgtaaaaaacggtttcatttaaataccatcatataaatgggtttgaaataccattataaaacatcgcctttatactaagatgcatttactctttcaacggataaaaattgtatgtggcctcggctgtatgcggtggccaaggtgggtcgccatggtcaacgggaaggcggtggaagtagcatgcgaaggctatggcaatgtcaccatgtgaagttagagaaggggctagggacagtggcatcgatgggatgctagcgaaggaggcatggcggctagagagaaggtaagcgttgatggtgtgaaggcccacacactgacataatggaattgacaaagcctcttgcagaggcccgtgaagatggcctagccgatcatacaatgtctcagcaacgatgctagagga

SEQ ID NO: 19754 - DNA, 1501 bp, Oryza sativa
catagctcgagatgatcaaacacagccgtgtagcgctggtcatttattatctgaatgcaaaaggctgttgctggtcatacatgatttatcttttatggggacaagagtttatgcgtgtctgacatgactttgatcacttccggttggatataggtgaataattgatgtgtagttttagtgagaaacagccatctctagtgaatctttagcaagcaactgctaattctgtgtatacatgtatagttcacaatgccttcaatcagatttggtaaaatgcaatcaagaaccccccccccccccaaaagttttttgtgtgctcttgctctatgtatgtttttttttttttttgtttacagttcatttcacacaaccaggaattcctcacatttgttgccaccatactttcaggtgcccttggtagctcaggctcatctttcagcagcatcgacagcctcagacgctcctcaacccttgagcaagctagggggtacacatctcgtcccctaggagctgtgcggccaaagatgctcccatctggatgccgacccctgcacacaagccatcctctgtcggctcctgttgctaaccgccccctgtcaccccaccttcctctgaagaagccacagctgagtgctacattctctatctcgcaccgtatatttggtgctgcgttgggtgctgccattatatccattcctctcgccaccaagttcagcctcatgtttgatgtctgagagagaaatgtggtctgcatgatgagaaagaaatgctatatttctgtgactatctcagcatctgaatttgccttgcaatgcaactgtagctgccgttggaataatatctttgctgtgcttgtagacttgtgaataataaacaaaacatgcaatgaccatactccctgtgagatatgatgttttatgctaagtgttaattttctctaccctttattgttctgctgccttgtggaattccatgattcatttttctcctggcaaaaaatgcttgccatgcgtgcaatttattcactatgagtttgcgttgtttgtataatgctccagttgagctgtagttcttttgctgctgcaaggaagggttggagacaattgaaatgcccaatgagcttatagtgctgaattcaatgtcaatgatcattgccaaaaataaaaataatatattttagtatgtgtaaataatccttgctgaaatctaacataactatttgcacttttttttgtatgtacatcatcattgctaaaatctttaataagtatttacactgttttttttttaaaaaaaagtgtttgtctctgttattagtagggggagcagggtggtagtacctggaaaataaaagttcggtgcaatgaatcgcgcggcgaggtcgaggtcgccggaggacgcgtcggtggcggcggcgcggaagctgcacctcctcctccgctcccgggacctccgcccggcgctctcctacctccgcaccctcccctcgccgctcaccctc

SEQ ID NO: 19755 - DNA, 1501 bp, Oryza sativa
gatgaatggagagacaaaaatagtcatgctattggagatgctattaacattcccaaatataggcatagtttgaacgtgtggtacggctggagctgttcgtgactcagaaaaatggaacgtatcattaacacataattaattatgtattaaatattataaatgtgaaatagatttatttgattttttaaaaaaacatttctatatagaattttgttcacagaacgtactatttagcagtttaagaagtatgctaacggaaaacaagaaaaataccatttttagtttctgaaaagaactaagccttaatccgtaggcacctactggcttgcagagagcttgccttcaagctaagttcggttatctagcaatttgatttctaataactcaatttcacatcaataaataaatattgaacctatctatctacttattataaatatcttgaaaataaaacatcacctccgccctaaaggcaacaaattatcatattaatcgaagaaagaatatattagccatatgttcgatcgaccgtgatagatctatagaaattatgatttgagaatatattagccatatgttcgatcgactgtgatagatctatagaaattatgatttgtagattgttataacttcctaacgttgaatctgagctaaaaatatgtaaatattaattatgaacattagatctattagaactagttatgaaattgtacttctttaatgtataatttcataactattaattctagccttcgatttaactctgatatgaataatagtaactctggacttaattttattaatattacatatattcttttaaaaaatgtttgcacgtaaaaaattaagaaacataactgatctaaaataatggtgcacataaatatgtatttgagataaacgataacaaaaattgcacttgcgtggcagagatcagctagctccaaaattgttttacagcattctctgcttgcaattcagtcaaacaataaaaatcatcatctgacttttgaaaaagactacctttttttatctcaaatctaaacatacatataattatcatcactaaaaaaagtaaagaaagcgcccaaaaaaagagtagaaaagcaaaacacgcgtagatgctagctattccggcactccctttgctgtgactacctttgcaaagttcttaatgcttgtatgaaccaaaccgagaaatagtttttcttttttctttgggtgcggagacaaaccgaggaatagttggccaaacatattctcttttcatataatgcaatttcctgaggcatctttttagatggcgagaattttacttatttccacgaaatctgaattgattttgacgaaaactctacatttttttaacaaaaaatacgatgttttatattgatatagcaggaaaaaatacacgaatataatcataggaggctataaccagggaaaaaatagaaaaacacacagccacatgtaaaaactcctaaacacaaaatcaagggaa

SEQ ID NO: 19756 - DNA, 1170 bp, Oryza sativa
tttttgggactcaagtgttaactggtaagttgaaactaaactgtgctaataagatgaaactgactgtcaaccttgtttatcatactttgaagaacctgactgcatattgatggagaaaacctggtggatttcttcaccactggattatctccttcactgtttttctccctgtttggcagtgcaccttatttctgttttttccttttaatttgcttctcagattgaatgcccttgtatttatcatgctatctagagtttcacatgtctcatgtctgagtccacctaccttcttaattttactgcaacctctatttttattttcagtgtttactggatcggggaactatgatatcatttctgctgccaatacatatgcacaggtttgtacatgtcagcattctctcattaatttcactgtttagggtgttttcattgttgccctagttgaatgagcaagagaaatcatgttttttttaagaacacgcaggaaatctgcgtatcatttcatcaagatagaggaaaaaaggtggatggcattagatataaactctgacatccacccacccagaagtacaacaccaacaccacacacccacaagaagcaaaacaaacctagtgcactagctctacagccctagacaaaagatcacgaagcttagaagctcctgctaggcaccaaagggcgccctcactagcaatggcttgaaggacatctgccatgcttggggtagcgccaagagaaatcatgtttgtctggcaattttgaattgcttgtttctttcttgaatataactgtataaagcagtcaaatagtcaataaattttgaggataaacaaatatggctaaaagttcaattgcatgctatctatgaactaaacctcatagagctatactatagctatacatatacaaggaagtggaaacatgatgaaattttctagtacctctgtatggatactgaatgatgaggcacgctgattacatttcctgcactgaagtacaaacacgaggatgatcctgactgcaaacctattgatttcagaaacctatgcaaatccatggatgcttctgactgcaggcatattgcataccttgttctgtactataggataattctatgcactatgctataggatgtaagtttttgacttccatgttttatatgaagt

SEQ ID NO: 19757 - DNA, 1501 bp, Oryza sativa
tagaacctcgtagcgcaacacatccgacgggtgggcacacttacacataccacctcacttattctttcatccttgcttcatgtaaaagggttaacccgagagtgatatggttggagtgtcatgcctttataaattggtttcacccttgctaaactagtattgtggtactaaacatacgcacacaactctcatgggctacataggtcacgtcctaattagcgtatgacatgccatgacatgtgcctcacgcgccatatgcccacacattgattcatacgcacaatcacgagggtcggctacgcagacagttctcatgggccacataggccacatcctaattggcgtatgacataacatgtgcctcacacagagcccacacgtgtcatgcgccatgagcccgcacattgattcgtacgcgcaaccacgagggtcagctctgataccatttgtaacaacccaccctccaaaaccgcagagcccaatgggtcggcccacttacatatatcatcccacttacactttcgtcctcgcttcgtgtaaaagagttaactcgggagtgatatggttggagggttaggctcttataagttagttctacccatgctaaactagcactgtgatactaaacatgcgcatgcagctatcatgggccatacatgccacattctaattggcccgggatgtcacaaacatccacaatgatgtgctagagcgtgtcctggacagtcgcacaccgcaccaggagcttgagcttgactagagtacaccgtcgtgcaaacctgcttctccgcatgccaccaccctcgctaatgtagtgagcctgaactccgccaatgatgatgtcaatgctcgtagatccaacaagggcgcatgggatgagacgcgcggaggcacgtagggtgatgagataactatcgttgcccgcgtgcatccaaatccccatgtcgttccgccaccgctgacagcggcggtcgagcttgggcacaaccacccttctcattgcctgtggtagcgcacggggacttggtagtgtccattggacttcaccatcttcttgctccatggggggggggtgcgttgtcaccttcatgtccatcgctgcggccgtgcaactccccatccttcctcctcactcccgcctttcgatcttgctcgtcgatgggcacgagcaggatctccggcggcgcgggcggcagcggcatcgtgttcaccatcgccaactgtggctagggagggagaggagggaaggggaagaccacatagcttgcgcccgccgttctttgagctcgttgcgctccatcactgcccacctttagtagtgagaaagcggaagtggcggtggccgatcggtgagggagcatgaggagggagggggaatgttgggagagagaggggaaagaaggtgccgcccgccaggggagatagagaggtgagagtgaagtgggggaagtaggacccactgacaagcattttgtttatttttttaattttgcttataatg

SEQ ID NO: 19758 - DNA, 1501 bp, Oryza sativa
ttcttttttctattcctttaataatataatagatagatttagtgaggttttgagatttgctgccgacctctggctatttgagcacgtgtttaggggtgggttcgtggatgtgtgaatatggtaaaccttttgtataatcctcacaggatattgatgactctaatcttactcctccatccaacatatgaaataccccatgcttgcaggataccaagaatcctttttaacagaatttcttaggtcgccttagtacagcgactccatatgtgacaagccctagctcagttgctatccttagagcaaatcaatctaaatcgttttcgcaccagtattttgaattttttttaaagaaaacatgaatacacctagaagggaaaatgctaaagctatcttcacgaaatctaagacaaactatgaagtccaagggaagagccaaggtagaacgaaactagtggggttagaacgttaccaagagatattaaaaaaatatatcctcaaaaaaaaaatttgagaaccctaaacagaatttgatgcatgaaaatagtcgtcttttccaatggatgcctaaaactgattccctacaattgataagtgagctcggtagagaagaaatctgatttttcaatataaaaaatcacccattcctaccaacagttcctcgtgctcgcgttcggatccgtggatagaaacaaggaggactcccaacttatggagagcgagatatgtggagatggggtttttaatttttttttggcacctctctagtggaactggaatcctatttaacacatatgcactagcaagataagtagcgcacaccttatccaatctcctttttctcttgttgaaaatttttaactcggatttaaaaaccttcaacttaagatttgaaaacttttaagttaagttaacttaaaagttttaaacttagatttaaagactttcaggtcaagatttaaaaacttttcaactcagaattgaaaactttaagtcaagatttgaaacttccatttcagatttgaaaacttttaaatcaatatttgaaatttttaacttggatttgaaaactttcagctcagatttgaatttttgagttgagagttttaaattttgagacgaatgttttgaaatctgagttcaacattcgaattgaaaattttcaatagaatattttaaaatttaagatgaaacatttaattataaaatacaatgaaaaaattgccaaaaatcggcatgctaacgctaatcgctattaccttaacattaatctctactagcgctaagcgtaggaggtatgctgcgggcgggcttgctggtgtggtgtgctctaggaaaatgcggaaatccaaaattatactccctcagtaataaaaaagtcaaatctagtccataaaaaaaatcaaatctaggacgtacaacgaatctggacaatcagattcattatattaaacgggaaatctatttcgagagcgctctcggtttagctgtatagtgcgacaca

SEQ ID NO: 19759 - DNA, 1501 bp, Oryza sativa
acaaatggagtagctccctactgctaatatttgctgaaggctcacccccaacaaaaaaaaaaataaagaagggaaagggaaagaaagactgctgctgagtttgtgacagcagcaatgtctgtcaaagtttcacaaaggaaagataaagaaagactgctaagacggttgctaaagtttcggcacgtaggaaggaaaggaaaagaaagactgttaagaaggcggctggtttgattgaccatgtgccgttcataggagtagtccatgttatgtagccaaatgactcgtatagttagcttggaggactgagctttgtgggtgggttggttggttggttatacaaagacgctacgagtccgggaataagggggcaactaggaagttcctcttcctcctccgagaacgagaacccacacctccataacttcaatttccaagttatatatatataaaaaaggcaatggcggacgatcctctctccaactccaccaccaacaacaaggtacttgtcgatcttgcttctaccaattccaattactactactccatcggctcggcagattgatttgattgtttgcttcttcttttttctgattgatttcagagggcagaggggatccagctccagcacggcgactgcgagagcgagagcactgcgcccttgctgctcgcgccacacgagtcctaccgcctctccgccgcaatcctcccgtgggttcctcttctcctcctccttcttcctcctcttcttccttggtcggtaataaggctggcaccttcttctgcagcttcctatttccagctttgggcggccttctctatggctacgacatcggagcaacgtctggtgctaccatatcgctcaaggtctctattactatactccactattcatcgattttgttaataatagaactatatattacttgagcgattacccatcattttgctttgcagtcatccaccttcagtggcaccacatggtacaacttgtcatcgctgcaaaccggccttgtcgtaatgcccttaccctctcctccatttgtttctctttttttttccttgtacactaccacaatttcatttcttcttcccaattctcgttatgcttatgcaggtcagtggctcactctatggtgctctcatcggttccatcttggcattcaacattgccgattttctaggtctaatacccccacccacctcctctcttttcttttaacattgccctagtcttctgttttcgcttatgcttatctcttaccacaggacggcgcagagagcttattctttcttctgtctcatatttgattggagctcttctcacagcagcagcacctaacttccctatcatggtggttggccgctttttctatggcataggaataggattggtaatcaaccacaattatcttattcatgccatacttgacactgcaaaacacatacaaacaccacacggtgtttatgacgcttacgctaactctttgctttcgtcaggcta

SEQ ID NO: 19760 - DNA, 1501 bp, Oryza sativa
tggctcatgccttaatgtgatccgagtggcttctccaagcagagatgttgacctgcagaacatctcagaaggaacacacctatatgagttcaactgctagtcacagtctatgaggtttgggcgatcactagatactcatgaaaggcctggagtttgacttatatgctccaaacagaggggatgcgaacggcagcccagtaccagtcaaggttctgagtgaaacctgatcacacaaaactgacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaacttggtggggattgttagaataattgggctaggcccaacttatcctattaaatctcaaaggcccataataagtgttaaggataataataccacctcaggatttaagcgaggaatatctcaacctaaatagggagttattggaggccccctgttgactggttgaggtggaggtcggaatgccacacgcgcgcgcgcgccaggccgaggccgtgggcgtgggcgtgggcgaggcgtggcgtgcctggctggcggcggcgtgcgtgcgtcacgtcgctattcttttgcagccactaaccacgttcccacgactctctccgcaacagcgcgtccacgttcccacgactgcctctctctcctgagagataaggaggccgcgagtccgatctgttccggacacttgcttctttcccggtgttagttcctcctcctccgcgccagtgctattatcgcttcctcgcttctgatctcttgcgcgcacgagagattggaaggagcagtgcctccgaaaccacatcttcgcctgagatctgcaccgggtaggcgggtgatcaggcttttggggagtgcctcccgcacgactgctcgccatgtctggagttgccgccgccgctgctggaggagatggcagaggtggtgcgccgccaggagctggagctggaggtggtgcgccaggagctggagccggtgccgcgaacgacaacatcaacggaggcaattctgcctcacaatccagcggagggccatcctcggagtatatccttctcctattccctttgttagcgctatcgctttactgttatgtgctctatgttcctgttcctgacattcatgatgcctctagcatgttattgcgttactgtaatgttcctgttcctgacattcatgatgcgcatggtatgctactggttatgttaagagcaccctacaccgcttatgccatgattattgctttaacattttggattaaaatatgccgattcatgactatatttccaacaatccaaaaatctgataggtcatttttggtagttggctttgctgctgcactgaaaccacatgcttttgatgattctaactataagagatggaaagcacgtgcactactgtggttgacagcga

SEQ ID NO: 19761 - DNA, 1501 bp, Oryza sativa
acctggataaattagctagctgaaagcaagattgatcgtgcatgcaagttaagagggaacatgcggagtcagtctagtaatgctatggcatgatgagcacaatcagtgaacccatcagcttgttaatatccatccatgggttggattttggatggagttgacctctggaaggtcgtctgaagaaagtcgaaaaccaataacaccaccactgaagtagtaatcaagttgacagggtcgagcggctggatttactgtttgttttggactaactaaacttatttatagcagcgaagaaggataagaaatttatttggaaatggtttgaaagagtagagagagggagacacatgtcatgcctgacctcgaactttcacaaaaaagtcatctcccgcccccttgaagggacactagtttattgattgattggtcagaagataatttggcatcaaatgcttgtatgcatgtatctgcgcatgttgtcatacaaatacagtagtatacaatagggaggttggattgcgtcgcgtggcattattttggtttttgacagacagacatttcaagaccgaccgggagggaggtagtcgcgagcacgacgatcttgatttggattccttgtgttgttgtgtgtgagtatgaagtctgactgaccacgaatccattcacgatggggggaaaacagcagcaatttccaagaaatctgcatggctttgcttgcagtggcaatcgacacgagcgagaccgataatcccatcgtgcgcgccaccaactaaactcaaccgatgatggaacaactaagaagaattaaggaagcaaacgatcgagcaggagggaggccatgaagggagcaccaacacacgcttgctgcctttggaccttcaaataacactacgccctctgatttctttcgacatctctcctcttctcttgcactgcggcttccactgaattctttctttcttggacctatctgctgtttctctctctcagactacccaaattaaactcgtccacctgcaatgcattgccccacctgaagaggaccaacaggtatcgattgattcttcttcttcttcacctgatttgttcatgttttggtcgatcaattgccactacaaattaaactagcttgatactgtatgtaatgttagtaatcctcgatcgattctcagggggctattataatgttgcatgcaaaataggaatgtaccaattcggccagtaaattactgcaagttttcaacccgcctgcatctaatttgtttccatttccatttaagaagcagagtcacatttttcctattattaggactgatgattttggatcgccattactggggtcgggtcaaagccacccaaaatatgcttgatgcctgaattgctgatgcttgattcaattcattcctattcatattttctagctagctagctgcatcacgttgatcggcggcgagacaagctagctagctatactctcttcttgttgttgttaccaatacca

SEQ ID NO: 19762 - DNA, 290 bp, Oryza sativa
ttcatcattgtgcagctcagtttatattccacttttgcatatgatattcacccatgctagcttgagattggtagttggatttgaaaattctcattgctgttactcttgtaggccccttgtctccagggtttaggctaagaacctttcttattttgtaaacagtttacagaactttgaactttcagacttgctcactgatagtgttacttattgatattgcctcatctgtttaagccttcctttttttatttgtgaagttgaatgtctttggttcttcttgtttttacagt

SEQ ID NO: 19763 - DNA, 1501 bp, Oryza sativa
gagtatccaaaattaatttataattgtactagattgatcatcaacatacagagataagcactatattgttcagcatgttaaactaagatgtctatagaagtgtgaaaggttttatggtattaatagttgtgccattggagtgacacatatgcacaggacatatagttccccttcaaacagagaaatgtgcatgtttgtaatgcaaacttgatgaggataacaggttttttttttcatttcagattcagataaaaacattagaatatacaaatgaacatgcaagtcttttcaaacttagcgaatcatatgatttatatgaatgctaatatgcctttgtcaaaatattcaatatatggaaatattttataatattttactcaagacatccttccattttgcaatatttgtccacagcccactttacacagaccaagaaagcacagtctaagaaaacataatgaaaatgactgtggatatccctaatatactcataatacagacaatttatcttttcaaaaatatttaagtaggtgggaaatgcatttaagtaggggcaaaatttgcaagaagtacatcttgatctctgcaatggacaagtattttgaaacagatactccagagataatgggacagatactgtgaaatggaggaaatagtgcaatgtcaaaacaatcttatatgaaatgttgcattggttgactataagagattctgcagcagcagctacattacgcactgcatgtgcagcattgcagggaaaaagacttagctcacaatttcatgtgcctaatttataactattcaagcatacaaaagcatggattattagattatctattttggcactcctacccttccattcctcaattttgacagtagtacttcagttacaagcatgcattgagctcctaatcccctttatcaaccccaacacgtcagaccagccccccaccccattaagcgccaacttttgcaatcaaaccattgtccagcataactggtataatgcaaacatataggctttcatcatgttctttagtatcgcaacgcgacaaattgatcttacagcgagaccaaaacaggctaactcacaaatttcatggggcaacaagcccagagaaagcgtatggacagagtgcaaagtaggcaaacggtacgtataaaccatgcatcagaagagaagagagctagttaccaggtggcgccgtgctagagaggttggaagggaggccgtacacctgcagccgcgtcttgatcacgtccagcgggcacagcaccgttgcggagatcacacctgcgcccaacacagccaccaaacgaagagcaatcagaaggatcaaaaccccacgccaccatcccgagaccgaagccaaaaaaaacccaccaaccctggctagaaccatacgcaggggagagcagaattaccagccgaaccgcccgcgatggcgttgcaggccgcctcccggaccatcactcgcgcgccgttacctcccctgccctc

SEQ ID NO: 19764 - DNA, 672 bp, Oryza sativa
ccttgtatacaaatgtctatagcagaggcgtttggtgcataatccagagtgtgtagtaggtgttggacagatgaagttgagtggtactgtagtgttgttgttctcttcccttgggttttgtctgtaacgtcgagagggagagatgttgacgctggctgaaagcacaacacaagcagagtgatattatactactactagtaatttacttattagtacctgtgtagtattatctatccattgttggtgtgtgtttatctgtcctcccaagttgtggccagcaatcccaatcccagaaattgaatgaatagtcttctagtggccggcgagggaagggagtttactccagatagcgagagaggctagtgtttgagggaggggaaggggatgagaggaggaaaacgaagcaaatcgtacgtatggaacagtgacggcagttgggcctggcaggaagaggccgtcccccgtgcagtgcagtgcattattgaatgatgatttgcgccttctccttgcccccgtcgctgccgacctccaccggtcgccgcccgcacgcatcgatattggaattggagtagtatatatgatcgagctaggccttcctcccggctagttgtcattaaactctacaacgtacgtatctctcctctcctcctgctcccgagcattccgtcccca

SEQ ID NO: 19765 - DNA, 796 bp, Oryza sativa
tactcttgcgagtatctacaatgttgtcctcctcaggattttcctcaggcgtttgatcattgtgttctatcggtgcaaagtgctcatggggcatgacagtttctttactagaagtgctaggtgtatgtttcatgggaaattcattatcaaagaatgtagcatctctggactcaagaattgtaccaacatgcatgtcgggtacaccaaagtttactattaagaatctataacccacactgtgaatagcataaccaaggaacacacaatcaacagtatttggtccaagtttccgctttttggctataggtacatttaccttggccaaacagccccatgtttgtaggtatgagagatttaatttcttcctttgccattcctcgaatggtgttacttccttatgcttcattggaattttattcaggacatgacaggcggtcaaaactgcctcaccccaccattccttggaaagccccgcagtgtctaacatagcattcaccatctcaattagagtatggttctttctttcggccatcccatttgattggggtgaatagggaggcgtcctttcatgaataattctaaactcttcgcaaaaagatgcaaactcattggaaaaatactccccacctctatcagacctcaaccgtttgattttcctttcaagttggttttctatctcagctttatagattttaaagtaatgcaatgcctcatcctttgttttcaatagatacacatagcaaaatctagtgcaatcatccatcagtgtcatgaaatatttctttccccttttagt

SEQ ID NO: 19766 - DNA, 1501 bp, Oryza sativa
tcacttatctttctcatagaattttttggttcttatgttcgaaccggctgtaagtttatagcccgtttctcctctcttctctcctccacctcagcatttagccagcttatagcttactattatacttgctctaaatgtgggttttcacgtccaacatttgacgtgcctcaaagtagtatggagtggattacatggctactacgaccaaatatacgaagatctggtaaaaggagaaattgctaggcgtgtgtttgctttgtgtgacgatggatgtttattgtttaattgcataatacctctctgtttcaggctataagacgttttgattttgatcaaagttaaactgttttaaatttaactaagtttatagacaaatatagtaatatttataacactaaattagttttatcaaattaataattgaatatatttttataataaaattgtcttgggttaaaaatgttgttactttttttttataaacttggtcaaatttaaataagtttgactttaaccaaatttaaaatgtcttgtaacatgaaacagagggaaacggagggagcagtaattgataaataagagggtgatgttaggcgtgcaatctgatccatacatacatgcagtgcccatggactgggaacggcagcggtgtcagccaaggagcctgaagcgttgcccttctgcgccatcgcctacgccctaacgggggtcgtcgcctcgttattttgctctcttccggcgatcaggcacagcttagtcttcatagctggcgatgcctctgcctcacaaacacaacacttttcttactagtattatttggatatatatttgtttgtctgtcactattcatgaaaaacagacccagtacagattgatattgtgattaataatcctacgaccgaataaatactgtatatacagagacacgtatatatggtaggagtaacatggaagggagaactatttgtatatgtaattaatttttgtaagggaggacctggacttggtggaatgaagcagctgattgcagttaaagcgaatgcagcatcatcaaaatcaaattaagcagacaagagtcaacacaagtcaaagtgattttattattattagcagagcagagcagatcaagaaagcagagagaggtgccacactcttgtattcaccgacaactcactctgggcatgggcatggcggattcacatctggatggggtgccggcgatgaggaagacgacggtctccagctccagcagcctcaacatcgccttcctactctccatggttgccaccaacctgctgtccctctaccacctctccacccgcgcatccaccgcaccgccgctcctcttgccggcggcgcaccaggcccaggcccaggacgagcagctcctccgccagctgaccgccatccgcgccaccgtctcccaactcaaccacctccgctcctccacgcccccgcctccgccgccgccaccggagctcctcctctactcccgcctggc

SEQ ID NO: 19767 - DNA, 1501 bp, Oryza sativa
aatttatccaggttttttataaagacaaaggacctaccttattctggatatatatctgatacaacagttcagacaaaaggttataacctgacaaatcaatagttgtatataaaccagattactcagttattcctgataccaatcttatatgtattcgcaaaaatcagcacctagtcatgccaatataaaagcctcaggatcaagaggacttttacggtacattctactgctagtatatactagcagtatatacaagggtaattttggtattaggtaagagtctgaaaagggctttttggtcatttaaattagagaattaatttcagccggattaattttccttcgttagtttttcctggggatgtcgtcatctgtttcttctcgtcacatctcgcgtctccggcgtcgctgcccctggtgcacatcgctcccgcgccgatgcctctcgcgtctccggcgtcgctgcccctggcgcacatcgctcccgcgccgatgcctccgtaccgattcctccggcgccgagagaagccgaacctccacgcgcccggtgtctccctcgccccggcgccttgcctccagccctagcctattctctcccgcatccgacctcccacagcttgtgctttgcccaaaccacggcggtgagagtgcactcgtcgagccggcagcctccccacgcctcccatctccgtcctggttgccctgcctgccctgcagccactggagtgctcctggtaagaagctgacctaaatttggtactattgtattgattaatttatgcaatggttgttttgttctgcaatttttgttgtgcttaaccttaatgtcgatatgaaaatttactatctcattatgaaaaagaggtgagattttatcttgttgattgactttgttttggacgatctgccttagaacactaggttgtatttgatgagacaagtaggatgaaaatctgcattctgcaactagaatcgcattaatcctaggtatatagctagatgagtgtgctatgtaaaattaatgtagcagaggtgcaaattttgcaacttaaatttggtttaaattaaggtattatccatatatgtaataaagctggttccatcgaacgtttatatcacaggttatcataaatcatttgttttaatatttgccaacagtctatcaagcctttattactttgtaatttgcaggatgtttttcgcaaagttgtatcacttttatcattattcttacatgcaattttcgaattgtgttgtgatctgtgtgtgaaaaatctcatctttgtagatacttgatttatgtgaagacttgcaaatttgtaaagatttttgttagtgatgtatgaaacgcaagatgttaacctatattttaattatgctgatatggttcttctctttgtgtatttttactgtgtattaacagtgttgcacaatggacgaggacgaagttagcttggaggagatggaggagtataacatggttgctagtaagctttttaga

SEQ ID NO: 19768 - DNA, 1501 bp, Oryza sativa
tacttttaccaaatatgaagactgtggagggctgaaaaataattgaatgtaaatttaggtgcatcgagtatatgcacctaataggtgtagcctccgaccatgtgattagttgaacaaaccaagcatatagtcaaggaataaataatctaactaactgagtggttttgataattgtaataaaccaaatgacttgatatcaatatatagcatatgcgatgtgaatccccgaataacatgatccaagtgatataccgactgctttgtaaactatgatgagtacaacctaaagttgcctacatcattaaaaattcacatagcaaaacagctataaagaagcttgaatgctgcgaataaagaaatttccaaagtattgggcatacgccatgcgcacactgctttaacagatgtgcttaagtccctaaaaaacacatggtttcaccatacctggaaatatatggcatatgtggtgtaaaatctgagtaaataaactcataaatgatttaccaaccgcctggaaaatgaccacaatgtataatcagcctaagccataatattagtcaataaaaatgcacacttacgtggcaaaaagcaacgatattgtatccaatcaattgcttgataaacccaaacagtgccttgactatataaaaaagtcagcgaggcagctatataaagctttactgtttgacaccttttaagatgcattgtactaactcctaaaaagttgagtaactgcggtataaaatgattttaaggtattaggacactttgatcacgcgcactttggcctaacaaaaatgcctaagtccctaaaagaacgtgacaggccacacctgaaaatatgggctgcagacatattaggcctaggccaaaaaatatgccttcgacaccctttaaaggatgacgcatataacatgctcccgagtaatacatcttccgggtgatatagaccaagtgtagctcatatcaatagtttctgatctgagtgattatcccttatgggatactccaaaatagatataataattgaatcccgactggcgcaagtattcggttgataacccttatggggaataataaatagtccagtctttgagcatagaaaatagacccatgatcatgaattcatgttgcatgtattcggagcaagtccaaattgaaggtatgatacttgtgtttgagctagtaagccctaagcacgtagtcacaattgttcattgatggtagctgacgcagttggcatagagacaagacgaccaatatagagataatattgcccagcagaggtggcaaaaatattggtggtagtgaagatagtgataccaatcaaaagtgatgaagttgcatagccgtggaggcgaagaaaccagtcggcagcagtcaggtcagccatcaatgaagatgaaggcgcctagcgataaagttgtgtagccatggcagcgaaataatcagtcagtgacagacgaggcagatcaaaggcgatgacgaaatccaccaatca

SEQ ID NO: 19769 - DNA, 1501 bp, Oryza sativa
tcggttccgatggcggtgatgcggttgcagcagcgacggtgtcgacgacgaggcgtggcgcggcggtggacttcccgtcactggctgcgccccctcgatcggttagggtttatggggtggagtggcggcggcgacgaacctcgttccttgtgtcgttatgccgtcccgtcctccacccctctttatatggcacagtgtgacgggggcccaccagccattgggctgggcgcccccgatcagggcgcgggtcaaggcccccttgagccgttgggctcaaggggagggagatccatctaacagatgattccacgtgtaactctccaagtgaagctgccaaaccgctcaaatcctccgaacctgccattgaagaagcaacttgcaactgtaagaaagatgacaaaggagaagatcgatcagacgagatgcagaacgaagtatgcaaaggataagagcgagagggaggtgtaggtgaccggctccggccctatcgctgggagcggagtgggctagacggctggttgcgtggctgcccagctggggcagcgtttggcgggctgccggcctaggggcgctatagcaggcagcagcacggcggatggatggggaggatggccagagacggggacggagaaggggagggcaacccgccgccggcgacgtgcggtgcgatgcgtgggtggggaatttcagtgacgcagcagcctgcagcgtgccagctagtggtatgggccatggctgatagcataagtgactttcagctcccacacatccaagcccaaatttcgtatcggcccatttcgtcttcctcctgctagaatccggttcgaatcacaccatggccgcctcccgtccgtgcacggcggcggcgcagccatctctccctcgcgcccatcgtttactctattcagcatcaaccgatgccaaaatttaaattttaaaacttggttctgaagttttttttcgtcgaagattgtcgtttaagtcgctaagaacacatatatataagttttactgtggagattatggttaccccatatctacatggcggttatattccagctggatatatggtaccaaatatagatagaatatctttatgaggactcgggttagattctaaacttgtatgtcaagaaaatacccgggatcctagtcggttacgattgtattttatctgtaatcccatattccgttaggatatagactgtactctgtaatacggaccccttcccctatataaggaggggtccgggttcctctcgggacgattctttttctcccaatcatacaatcaataacacactcggcggaatcatccccggacaggagtagggtattacttcttgaataagaaggcctgaacctgtataaaattccttgtctccaaacccatccactttcctagcttgatagccacccccttttattattgtcgaaatcttgtttcgatagttggcgcgccaggtaggggtagcgtcaagttctcgccgactaagtgcga

SEQ ID NO: 19770 - DNA, 1501 bp, Oryza sativa
gggaggggggagggggctcgtgagcttgcgggagatatggcgacgtgggggaagtggtcggcggtgtcggcccgagcggctagaggttagggtttggagctgataggtgggccctacttgtcggcgctcaagggaggagggaggtgtagtagacttcgcaatgggggaggaggcgagctaggctaggcatgaggaattggattgggctcgtggggagtagaatgaagccgaggccgaggacgagggagaaagagtggactggcatgaaacatttcttgtttgtaatgatgtttgtattattaaaattacttgttgagctctaaaaattcatggaaaattccagagagtattttagggcatggagaatattaaaaaaatattcaccgtcatgatttctaaaggaaattttatttcccacattaactttacttgataaattgctttaacatttaatgtaaaatctagaaatgcattattaaatgatttttaatccccgaaagaaaatcggggcgtgacatcggcgttggggcttgccagtgaaaaccagggttcaaaaaccgatggaatttcacgaaaattggtcagcttacgtgaaaccgctagattgacaatgcccccgtgggccgtggctggctttccgacattgtggaggcgagatcgtggcagcaaggaacaacagcagtagccccatcggcggtgcacttgagctcgagtgtcgagctgcagcagcagtagccctagtcagccttggcaatcacggtcgctcctcttcttgtggtcgcttagcaagccctagcgatgaccccttgatcacctaactgtcacgaagctcgagggagctgacggatgttcctctcatgacacccccaccgctagcttcctgatggcgtgacagctagatcggggcaagtggaccagatcagggcaatgaggagcagtagtagcagcaaccccagtggcagcggtggctcctcgtctcgtcatcccaacgagccccaacgccgaccctttaccactgccaccgccgacgacccctccaccactgctgtagatgtcgccctaccaccgccggccttgctaagctagaggaagagttggggaagaagataagtctgacttatgggtgccacttgtcaacctctaagggttgaaagtattttggtgcatacgaaaacacgttatgaaaaacccaatcaaactgtgtccaagacatatatagtagcatagttcaaatgttataaaatactaatgacacacaaccgaattgtgaataatagtgattttcaatttgacaagagttataataacatagatccaattaaccttattatatatggtacacaaatcatacactctctaattctgtggcttcttctgttcttacgggttgccaagctatttgaagccacttgccaataaaagtatttttttttctaaaatcttatttggaaataattttagaaaggtttataaataaaaaaaatatttttttgagagaaga

SEQ ID NO: 19771 - DNA, 1501 bp, Oryza sativa
tagtcctggattggtagtcccggttttatctcggtttgaaaaccaggactacagagggttatgaaccgggactaaaaagcacttctccaccagttataagtgccgtgctacttacgtgtcagggtctcagggacgactaatatggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcgaggtggtggtgacggtgttcgccaagagcgtggcggcggagcacgtgtccgtggacttcggcgagcagatgctgagcgtctccgtcgaggtccccggcgaggcgccgtaccacctccagccacggctgtcgggcgcaaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgccaagtgggagtattgatagtgttattattatatatatagtcgggctaattaggaatggatattgtccgtgagttgcaatgagattttattttaaaaatatttttaatccagtattagcattattttctatatacatcatatatactgtttcttacttatatgtggatgttctaaactctgcggggtaatttttaccttttcatataaagtagggagttgatagtgggggtggttgacatatagaccctctgaccctacatgtcttttcttttctaaaaagtagggagttagtggtgtcttttcttttctaaaaagtagggagttagtggtggaaatggtgacagattcacttttcttttctaaaaagtagggagttggtggtagaagtggtgacagattcacctatcactaattcaccaccatcattactctcttttataggtattataggtatataattcttgttatttgtaaccttatataatttttgttatttgtaaccttttctgtcagtatccttaaaaatgtggtactgtcttattaaggtatcattatacacatagtagtacatgttctttgttgggcgtgttactaatgtgctacaagtttaataaactcagttggaacttttattatgtgtaagttagcgattacg

SEQ ID NO: 19772 - DNA, 1501 bp, Oryza sativa
tctgttttgttctgcttctgcgcgcagtgtatagatgcatttatcccctgtgcgttgttcggttgttgatccgagcaggtggtcgtgagcctttttctgacgaattttacagccaaagtggattgaactgtcgcggtttgacgcgaatctcgagacgcgtgagagccatatgagaagaataagttctttgatgtctcgtggggcgtacttgcatccacggatggaaggtgtgtggtactactgttctgaaacggtatctcttcgacgtagctgggataattaaccgattacacttcagaaaaataaaattgcttgatcttgtcactgtgtggcaatgtctttgaaaaatacttagcagagaagattattcaaacgctactcaatttgttagaaagccagagatagaaaaacttatcggtctgatagactaaaagttaatgtattcatccaaggcttgaccaagaggggttaggtactgatgtgtgaactggagatcgatcaaaacctcgttatacaatgccgacgaaggccataaatacgtgcatgtgatggcctcaatgaagtggatcttgcagaatccttgctaagattggtctcgcacgcgcgccaaaactgagatccaaattagtgcaagttcactgttttgccatgagcacgcgagtctggatcatactatggtacagtccattatgtttacagttcagattctttttcacgtgatctctctccatccaaatttttagggccatatgtatttcaggattggaacttaattcgtaagttttgactatcagattgacaatgtatatgtttactgcatatggccatatatttgcattgtcaaaacataattcactagatttatgtttcagtatatttgcatgtcccactcaaaaaaaagtagatttgcatgtccatgattttgtagtaagttgctccctccatctaatagtgttacaatatactgtatgacatttaagaacaagttaccagctccaaaactcatagtatctctttgactctttcagaagggacatttggtccataccttctactactagtttggaatgcatggtctaattggttgtagtctttctcatgtagaaatgtatccagcttgggaccctttttgttggtctcgtaattcttctgggcagttcatgatgcactcgatattgaatgctgcgtcaataaattcacaactgcatttcagcaataagtccatctggaaattaattgacaatttcactcaaggtaacatttttttatctgtatattttgtagagggtttgttctgacaaaagacaacacatgaccggatagagatagctagagaggtggcagatgtttggatcaaaggaacaaaacacaacaataaaaacgtaggaaaagaaaatatatagtgcaagattggaaaaaaaacatatgaacaattatatagacgggtgtttggaatgcaagatcaatattagaagatagcactcttgcttttgttactaat

SEQ ID NO: 19773 - DNA, 1501 bp, Oryza sativa
tttgttgggttgaagggaatatcgcattaagggaaagtattgcatttcttacatatgcactacaacccttagaatgtgaacaaagtaatccaagtggtagaaatgttttcaaaacgcccattttgaccaaaagtcaattttttgagaaaaactataattcttgaaaactattacttggaaaatatttcaaaaggcctctaatatgttttccaaactttagtttgcaagaaaaagtatttgcaaagtaaaaatgcatttttgactaaaattctagtttctaggatcttgttttcgagcaaaactatttttctctctacagggatatctaaagagaatttgaaatggagcccaaaacaagttagatagagttggttatttcaaatgtttttggtttttgaaccttatccaaaagaccaacatattaaaagaaatttgatgtcaaaactcaccaaaaattttaactagaccatatatggtcactttctatcactttggtgagtttatttcttaaatctgaataattgtatctttttggctcaaaatcatatttgaacttcatgcatattagtttctctcaaatatcatctcatttgcttctttttgcacttttggaggaatgtatttgaaaagagagcttgtgtagcctttttctcaaacttggcctttagtatcaaaccttgaattcatgaagcaaaaaaggagagttgcatcaagggggagcaatctgaatcaaacccatattccctttgctcccaaacatgaattttccaaaaggttgcatccataccctttcaaaagagcctattttagacaaaagtcaaaaatcttatttaaatggcccatatatgtgaaaatcctttcaaatgtatcccaatttgtatttcaaatgtttttcaaggcttttggagtcaaaatttccatttgtcaaacaaaatagcaaaattggtctcaataggatcttttagggtcttgttttggttgaaaatattttatttctctaaatcaaaatctattgagttttttggaaaagctttccatacaaaacttttagagttggtcgtttcaaacatttatctagttcaatgtttttccaaaataccaaccattcaaactctacaaccatttgaatttcagcaaaaatcttgacttgaccattttcggcctaaacttgcttatggcgtgttaagcctttagagccaaatttctttgtgaatcttggcttgaaagtgtatctataatcctcctaaggctttacaaatgtcaaactccatcgatttcaaatttgaatgtgatttgagctctcaactcaaatttactcaccctaaaggcctacaatgctccttttgtcttatcttttgatagaaaaatgatttttaagaaattctttttggaaaagttcctcacaagtataaagatcaaatctgcaaggtttcaactcatttcgatttgatttgcaaagattttgactttttctcgttttgctcagcttgctgaaattttc

SEQ ID NO: 19774 - DNA, 1501 bp, Oryza sativa
aatattttttattaaaaatagtatactttttagtacatatttgaccgtacgtcttataaaaaaactttcatgaaatatgtaaaattatatgtatacatataagtatatttaacaatgaatcaaatgataggaaaagaattaataattacttaaatattttgaataagacgaacggtcaaacatatttaaaaaaatcaacggcgtcaaatatttagaaacggagggagtataaattagttaatatagatcataaattgataattaatggtataaaatgtagttgtgtaacctttattttaaaccgtgtgtttttaaaaataatggttctaaataaaattatgttatattgttaatataatgggtaaaataatagattccaaaaaaattttatttccaaagattatggatctaatttatttacgtatatattgtgatatatatataatctatgtttataaagttatagttctttaaaatttaatatcactaattatagttacgatctcatctatatatgcatagagaaaagaggggaggagatggaagcgaatgtaatttttaatgatatatgtaatatatatttatttgtttttaatcgtacgttgcattacagttgtatatgtattttttttggctttttgtgagcagtatgtaagtacctttctctagtcagtgcgctgagagagattaggtgtgaggttattaatagatttaatttaatgatctgagataacagatatactaatttaaataaaaatcgatgagaagttgttttacttttttcctcatattttcttgaattttttttctaatctattaaagtgcattttagaacttaaaatattaacagttaatatgtgtattaaattattaatttggttttctatctcatctaaccaagaagaagggaaaaaaggttaaaaaaaaaagagagtactatgtatgtatgtgcacgtatatggaacagtggaacattttttttacgtgcaaatctttcacaggtaaacatagttagaaaatctgaagatagatataggtgttagctaaaaaataggagtagttaccgagaaaataggagagagaggccggagggagggaggtatagcacgaacctgcacatgccgcatatatgcacgatggggatgagggctaccggatttttgtttcttaagaggtctaatgattaaaatatatgggtccaccgatttaacggaaaatcaatggctatatgtttattaaattttttatgatattctatatttaataaaagtgccacgtggcaactcgaaagtgtttatagggtgacacatggcggtttaaaaccgtttgtaaaaagtttaatagacttttagtatataatagataccaaatatttaattaatcatccattaatagatgttttgttttgcgtgccggggagaagccatggaagctacaggttttgtaccaccacctttgccaaaagtcgtcgcgcgacggcaacgaggaccggcgcggcctt

SEQ ID NO: 19775 - DNA, 1501 bp, Oryza sativa
ttatgtatatgatctattttaaattgttaactataacaccacgtggctcgcaatgtcatcaaaacagcatcctgatttaaacatggtgcgattttgtagctaagagaccaaaataaaccttttcgtatttgaagggaaaatgatataaaacaaggctatagttgatcgacaaatatgaacctttttcagtggcgcacaccaacgtatccagccgattcatgcatactatatagaaatgtacggcgcgtggctgtaacagtttcccgttgttactgtggagaattttgtttgcatgcaggcctggttgttgtttttttgctttcgtcaactaggccctgaaaatgatgccttccacgattcgatgttaacgttgctggcattactccagttgaaattaaagtagctgattattgactttgatgcatcactccagctgaaatgtaaactacagaaacatgcatggagggcgtgatttacatcccttgaaagcagctggctaggacattactacgtacagcacagtacgttgaacatctgaatgttatttttaggggaaaaaatgatttggtacagtactagtagcagatacgacaactgttaataaagatcagtttggtcggctttgtagtttgcggtaccttgaacaaattgaattcaatgtggtgcaatgtactttgcatgcgtcacacgcccttgtcaagaagaacccagttcctaactatactccgtaagtttggacatagacatattcaagttcatagttaactaaaaatcgatttgttttgtaagaaacatgggaaacactcgttttacttcaagtatatatgtatttgaccaaaattatatttgtgaaaaaatgcgtgccacacattgattcgagtaaaaggcgaaaaaaaaaagaaagaccaaatgtcacgatcaaatattctaaaccgcaatttaaaaggcgttggagccaaaccacttgaaaagagaagagcgtagagaaagggacagcaaagacatgaacgcgcgctcgcggcgaagcaaaagcacatactccacaacacgatacatggttcagagacaagctctagcgcatttcggcttgactcttgagggaagcggtgaacagaggaggagaaatggagaaagcgagtttgctatctagagagagatactgtagatagagagagagagagagagcgagagaaacaaagttacatcatcacctaggcgctgctgcttgctgcagccagcagcggcttgcctggctgccgctgctagctagcggcgcgtcaaaactggcagccagatggtgtccacactctgctgcatctcttatcccttcatctcggtcttaacctcgctaaagcttctcttagcctccttccatgctcagcaacacacacaaaccaaagactagacaaagcagctaggacagtaaagctaagtgttttcctagctaggtagctagctagctagacaagcttgccggccggccggccggcgacggcgacca

SEQ ID NO: 19776 - DNA, 1501 bp, Oryza sativa
tggatgcaccggatttcttaacttaattacctgggtttcgtaatagctacagattgattgggggctcgagtgctcgacgatctctagcctatgctatttgactttcgatttggatatacagagtcattgttcatgtccaacttctgatcatatcattttctgattatatcatttctggcaagtagcctcataagaatgctactttaccttatctatttcttagtattaaatttcggaacaccatacactgaacaggcatgagttcatgcggccaactctattatgaatttgactttccaaaaacaatgaattaatttgcaattaaatatgccccctaaattttagtcagaaaaaagctggataccaggagtacaattttttcctttataattatatcaggactaacttgacatcaattgaattaagagtgacgtggaaccaccaagtgaggtggaacgcggttgagtgcacatgcacgataactatatttgcacagttaaaatttagttgagtataacacatagagggggtgttcggtagtaccaattgtgactgaaagcggggcagtaactataataccagagcaaagatatatatctacggtgtcagccgcactactacggctgtgtagcagcagcttaacacagtgaaacacctccaaaactcttagccccatcggttggcctaataattcaaagcaaaaaccaaattttaaaattttgaatttgattttaaaatattttgaacttaatttctttttagcgttggcttttaatcactatgaacaaatatataaaatttttacctataaattaatttttattctctaataagctattttggcttattagaaaatatggacaactgataaggctcttttttctattattattatagaaagatgcacactacactcgtgtgcctcaggaataagaggagcaacacacgtccagatgccaacgataaatctctggtctcgctaaattattgaatacggtgaataaatttatacaaactgcaactccaatatcacattttctttctcttttccacccataaaattctcttcacttctaacgtagaaaaattccagctcatttaatgatatcacttcactatctcttttgtcatgctttaaatcgtgtgccgattcgtggagacgggtatgagtatgacaaccaatgccatatattccatacctcagtcgcatgatactactactagtactatttacacgaaatcaagcgatactgaatctgttgcatctgtagcaatcatgcgactaggtacatgaggtttgcatttgcgtacacgaactcctcaaatattgcgaatgcttgtactacgactctagatcacacaaattaagatcgcgtagattgaaactggacaagcagtacatgtacaaaatccgagcatccgaccacggaaagaggggaaagaaaattgcaaagccatggggcacactcccatcaccagtttattcctgtatttccacacg

SEQ ID NO: 19777 - DNA, 214 bp, Oryza sativa
attattttgtaattttaaaaaagatcccctaaatcatcaacatgtaaaatttaaataagtttatatattcaatacttcaaaatcttaataataaatttcaagttgacaaataataacgtaatataaagtaaaataatcaatataaacgcacgatagcctaggcttgcgagccaaaacaagctgctcgcgagctagctcggctcggctcatttca

SEQ ID NO: 19778 - DNA, 489 bp, Oryza sativa
aaagaaaacctgtttcagcatcttacatgttctttagtccatgtcttgcagatattgcccacaaaaagagtatcgttgtcatgactaggagcaacaccacattgtttgcctctcacctacagcatttaatgaattatgagattattacttataataataacacaccataatataaaatatccatatctttagaccaaccgaaggattctttagctctgacaccgcccgccttgcttgttctacagtcgcatatcgcagaaaggcaaagcctttatttttctttgtaacagggttcatcatcaaacgaacttcagtgatctcgccaacttcaccaaaaaccttcctaagatcgctttctgttgcatctttatcaagcccaccaacaaaaacttcaaactccttccgcttgcgatgctctttcaccatttcatgatgctcttcatcctccacatccacattatgctcttcttcggcattttcatatccttc

SEQ ID NO: 19779 - DNA, 1501 bp, Oryza sativa
tgccatcactggctcatataggattccatttttgtttcttttttgattttttttctcctacgaaaaaaatgacgtgttggtaaccccctgtagtcccggttttctaatcgggagtaagaatccgggactaaagatcgatcagctattttctactattataaaaactgaatatgtttttaccggtactttgatacattatccgtgtataaatcggtttttaagttcgtttacttttagaaatagagaaggagtcgtataaaaaatctctttaaaaaactcgcatgctaacttaatatgattagagttctaattgcatctcatgattttctaaaaaaatactcattccgtcccaaaataagtgcagttttgtactattcacgttcaacatttgatcgttcgtctaatttgaaaaatttttatgattagtatttttattgctattagatgacaaaacatgaatagtactttatgtgtgactaaatatttttaattttttcataaattttttaaataagacggacggtcaaacgttgggcacggatatccacagctgcacttattttgggacggaggtagtatatctaagcaaattctcacagtgaatttcatcttaactaaaccgtataataataagataaaatagacttcacccgttgcaatgcatgggtattttttctagtttagaaaaaaactcgcatttgcatggaacagtgcaaatatccttgaaccacatgacactccgttgtattttatccgaaaaatccccgctttatatctaggagtaaagtaatactcaatcgtcaacatttacttatagctctagcaaatcttaatcattttaattacatggcttaccttcattaattatatcctaacaatatttttcaatgtaaacattaaaattctttgtgaggagtatgcgctagtactaatatttcttcattggtggtggataaaaaaacgcacgtctaacagctctttgaaatgttagaacgataattattttgataaccaaaaattttgaatgataggacaacaagaaattgaaatggaggcgataacattttagagagaaaatatagtacgtaggcttcatagatcgtagtgcttgtagaagatcgatcttaacttcttctatagcttactccctccccccttccaaaattcttcgacattttaggcttggaatcgaaggatactaattgttgaagttttgggctccgcccgatcatcttggacttgtttgccgaattagggataattaattgctgaatttgacgcatgatcattgaatgcttcgaccaaattactccctccgtttcaggttataagactttctagcattgtctacatacatatatatatagtttcattaacatctaaatgaatatggacaatgctagaaagtattacattgtgaaacggaggaagtagatattaataaacctagtcacacatataaggcagattcattcattcattcatatatatatatatatga

SEQ ID NO: 19780 - DNA, 1501 bp, Oryza sativa
tagtaaaaatcaagctgtagcaatagcaaatatcatgcgaatactggatgaaaaggactaatcacacgaagaaccgcaccgccgcaccgtactgaatgaaaaggactaatcagtacgtatggctgtgttctacagcgcattttgcttttacaactcccccgtttatcacgagtatacttttcaaactgatattttttatcaaaaaatcttttatatagatttttttaaaaaaataaactattttttaaatttgtagtgagtaatattccctccgttataaaatgttacaaactagaagggtgagtcatattatacccattctacatcaacaaatctggacagtattttagaacaagaaaactaaacagaatcataatattttaggatgaagctaggatatacttaattaattatatgctaatatttttttatacgattaaaaagctaaagctaaaggcacattcgaacaaagcccaaatcagtgaatcactgaacccttcacgcgtccatgttccggacaccttcctgaggaggcggacaaatttatggacgcacgaagcgcatatgttcaggagtgcagacaatgcaggctgatgcatctgttctcgacttctcgtgtggtttggagaagttgatagttagggccctccatgtcgtgcccccctcatcacttcatttagtttgttttcttcctatcattgtgggggtactagtatctcttacccgtctctcatccagcaattttttttctggtggaattaagaggttcactttcagttgaagacaaggcctttccctgaagttctgagaagactggtacggcggcaaatctttacataggactagaggctggggcgccgcctgcacggactaaaacgacaatcagtcggtaaatagatgagggaaatctatgaaaatttgataagcgacatcatagattacagttcaactcttgtggatatcaatagcatcgtaattagtattgcctttttccgtaataaatatcctactacagatggacactttattatcaacgtagagcatctctgttgaaatttcggttcgttacagactcttggttcacatgaatatacaatgtttttattacataataacccaaaattaatagaaaaataatccctggtacacattgctatacactttgggtttttgcaaatagggtaactgaagaataatgggcccaacttttcaagattacattcagcatcccatcatattctgaagaatccaaacatgttggaatgtaagtacatgaaaacatacgttagctaatgaaatcatatattgagaagcacctgcagatatataccataccctaataaaaccttaccgcactaagtgcccgagcacacgaaaaaattgttcataggtcaatcagtgataatggaacaccaaaattccattgatgtttatttatgagctagcagctaattagaagtgggtaaaatttactcagctagtatacctcttacaggcacat

SEQ ID NO: 19781 - DNA, 423 bp, Oryza sativa
aattcgagctcggtacccaaattattatatcacagaaaagatcaaaccaccccatcctatggctcgtcgtcgtaactccaattcacgtctttacttacacgtaaattgtacatgatatatgtcaagtgtcaacgtctgatttggcctccgtagattgcagaatcactgcagtgagatctgtgtatcaatctatacatacggcgtgcccatttgcacgagacaatgagcgtcgtcgtgtgaaattatgctcgacagccatgaagaagagcagagaaggtaacctgaagcatgtcaagggttcgctctgcctcgtcccgcctctacttctcgcggtgttcttctacctgcagttccagacgctgggcctcttctccccgatcttccggtgcggtggccagtccgccggcggcggcggcggcgacg

SEQ ID NO: 19782 - DNA, 1501 bp, Oryza sativa
cctcaatttgaagttgcacttctcatccttcatgtttgcgcacacggaggcaaagtgtcccttctcatgacaaccaaaacatgtaatgtgaggatggttcttactcacatttttctttccatcatttcttaagtatgcatgcttccttgcatatctaggcatgtgtcttgtcttcttagcattctccttgcgatgaaagccaagtccacacttgtcatttgtgctcttttgcttgcttaggatttcgtcaagtgtgttcttccctttgtagcttctatccaagtcttcttttaaatctttgacttgggcttgtaattgcttgttttcctctacaaggttagcaacaatatacatagaggaggaagaacaagaattttcatctatgcttgagctacaaggtacatctaacaagtcatcacaagaggtggacacactagccttagatgtactacatgagctagctacacatggcatatcatcatcaattaaattacatgtgatgcctatgtccacctttggcttactaaatgcatttccaatgagaagagactcataagcttcttttatcttcttataagaatcacaaagttccttataagaatttattagctccacatttgagtctttcaaagagagaagagttttctctaaaatttgattttttcttcttctctttggcaatgtatttactagcctccctaagaatgttaaaaagatcatcatatgaaggttcatcatcatcaccaccatcatcaacaacacaagtattttcaataatactatcgagagaatcattctttacctcattcttacaatttgtcattaagcaatgaggtgatgtggatggtattgggagctcctcatcatcacttgaggaggtggagtcttcacccgacatcgattcttgtgtgcaaccattctcaacaagtgtgggcacttcatatttttctttaagctttacccacatagcatgtgcactcttgagattgcatacttcattaaacatgtcatcactcaaaccacaaaataaagcattagtagcttgagcatcgagatgtaggcatttatcttgcccacttgttggagcatggtcatccaaagcatgagaaaagcccacatctacaatccaccatatttttgggctcatggccgtaaaataagaaatcatgtggattttccattgtgcataatttgtgccatcaaacataggagggtcaccacccgtgtgtactatatctctagaagccatccttttctctcggaatagttaagtccacaaaatgagagaccaagctctgatacaacttgtaggatcaaggaggccgactagagggggggtgaataggcggttttaaaacttaatggcacttaaacaaaactaacctaagttgctaggcaaggtaaggtgcaagggttaactaagcaactaagttaagttttgcaaacctaggtgatatgggctcaaatatgtctctatgaatgtaaatagcacaaatgtaaa

SEQ ID NO: 19783 - DNA, 1501 bp, Oryza sativa
ttcttcaataaaataagtatttgagatttctttatggtatttacttttcttatttaagtaaggtagcttctcatcattgtgggctcgtcgcttcgtatttatactgagcactctagtactaagactctggatgaaaaaggaaattcttggtcgaggctagagtagtaatcgataacgtagatgtggtgtctaggttagacattaccttcatttattgtgtgctccacagaaagtgagacaggcggcaagtgatgatagtcatttccacccttcgtgttactccacgtttgggtacatcatagagctataagtcggactcagcctgaaaaccaaaggaaagtcggtgcccaaagcaactgatagaattgtaccttaaattaattaagataattaatccataagaatcatctctatcgtaagcctaccatttaattgttttccttagttgaatcatgttcttagattgtactcacatgttccttgtgattcgatatccttagaatattccaatgtgaagtgctacagcgatattcatgcggttgcggatttatctatgaccgtaacaaaataccaacatcgtcggactccagccatcacttattgtagttaccaggcatccccttctccctaacccctcccaacctttcctaggtcttgtgcgtccccggtcaccgctccccgcttgttgacctccgcgggagcgccgtcttcatcggtgtcccgaagcatcgctgccaatcctctccgccgacatgctccctttgtcactttgcccgcccacgctcagtgagatcccctcccttttttccccttcctttccaccgtctcccgtgcccgccgccgcacctttggtcatcgccggtggcagttgggcgcccaccgctgcctcccagttggcaggccggccgggggcgccacccctttcacttgcttttagaggtccctcatgagtgattgtcttacatctctcagattttgcttagcttataaaaaaatttgtattatggctatctaacctaacaatcttttcctcaagagatgtgaaactgacagatgctggcggtcagccccaacttatctttgcctcccaaccaatgtgatcggcgcaagaaaaaaaaaacagtacctacaattctattgatcacatagctatacaccgtatttggtttgtatggccatatggccatcttaatcttcgattcctagtatgtttccccaactatgtaagatcacatcaactccaaaccatgcttgctgctagggcaaaaggtgcatctacataaaaacacttatttttgctgtaccggtatccatagaagcaaacaatcgttttttcagaagaccacagcaacaaacgagcaattagctggttgaataatatagtcaacggtaacactgggaatacataacaaagggatatacaaaacattgtatccgatcccgatggctaggccttgtttcttgtaaaactctaggcgcatctgacaatatatggtcattg

SEQ ID NO: 19784 - DNA, 1501 bp, Oryza sativa
tatttgttaccttatttgctctatatttatgcaatgccatattattttatagtggaaacttttgggtgtcacattaagtctatggagaaaactttccttgataatatttgattatattttcgtatacagggttcaattcctactgcatatgagaagatataaaactcatgatatagtaacatttgttcaaacatataataagtaaaccttatataaaatatatgcacttttagattgttgatgtgtaatataagtatggttataaccatacccgagctagtaacatcctcatcacataccctcgctcgttgctacggggtaaccgatcacttgctaagcattgtacaatgatcgattctctatttaccaattaaaaagggttacatagtcacgggattaaagcccatataaataaaaaaatgatatcaatcaaattggtgcaagccatgaacctccaaaggcacaaagatggtgaaagacatatttagtcaacaaataatggttatttaagaaaatcgacaaataattattgaacacactaattaagtattacgatgcacctcttatcatgtcagtactactatgcacatataacttgtgtactaatttgcagcagtactatacacattatcaatttttgatgttcttaacatgtcagtagtacattagtcatataatctataccatatataaaattacaacccactaagtctaaaacttaatatgtataccatatataaaattacaacccactaagtctaaaacttaatatgtaaccataccatatcattatccactagcaataattacacatcaaacctcattcaagcatacaacctcatctatgatttattgaattctacaaaccgaaatgcaaacatattcaatcatcatccttcacatcttttccacaagccacaatattttaacatatatatctatcatatctataatacttaatatatatttatcaatatattctgcatcaaagcatggatatcatttgtctttttcacgattagtattaatgaactgtgacatttccttaatttcattttgctcttttgcttctagcttaattgttgaaaaaatattaaaaacctttttaagtaattcacgtaacaaagcgctttacggtactactttacacactacaaattgcaagccgttgccacttgctacctctaggcccaatggatgaatattactagaaagttgatttcaaagtatatgaaatgaataaaaaagggaaaggtaatgcactcaactagaggtgggccccgcacagatcggacggcccagattattcggctcggcatctggaatccacgacgggcagggcagggcaggtaggtcgtctcctctctcgtgtctcccccctggctcccttggctttggctccgctccaggctccagccgagtacccgcctcctcctcctcgctcgccgcggaatcttctggaagcttctagatccggccgctacgatcggcgaagaaggga

SEQ ID NO: 19785 - DNA, 1079 bp, Oryza sativa
aaaatgagagagcaacaaaattagagtgccacttaccaccacatatccatacactatgcacatcttgatcaagtttgtatgtcttgttttctccatggattgactctttgattttgcaatactaattgataccacgcgctttgctgtggaatatgtggatgaatgcatgttatacattataaaaatgatcgagtatatgtttaaataatgtgaaaatgatgtgaagatggtgatttgacattgcttgcatgctgagttctaaacatacaacaaaattacaaatgatatgtcatgttagcatgagatctaaaatactctagataataattgttagtcggtgatgatgtggcacacttgcatgttgagctttaggagttagtgggtactaactatatagaaagtatagatatgtgatgtaagtaatgttttgttctttcccctaccctgagctccacataatccttattagaagtaggataagaaaaaaaacgcaaaatcaataccttggtgaagaattatacacattgagtgatccgagacaaacaattaaggaataaagtagagttatgtttttatgagcaaaacgaaaaacccaatgtactcatcaggaggagtggaggtaacttgaatcaagaccgttccgttcttcaatcacccaagatgacgtggtagatacttcaagattcacaagtacaagtatggcttggaataattattatgcaggtatcattacaaagagaatcatatctttgttgtgatccatgatctttactcagtgacgagtaaaagctaagtgtgggggtgttgttaacagtccttaagtaccagatctgattgtgaattcatgcataaaagcaaatgaaagaatataaaatagatatcaaacttagaggtagtggttattactaaccatttccataagtcttggtgaatatttgtataaaggtgaattatgaacaaaaaccacccaccatgcgaagaaacatacctctggccaattagaagcgagtacatggattgaagggttcacaaaccatagcaaaactgacatatttgaggataaccatcgtgcactgtca

SEQ ID NO: 19786 - DNA, 1455 bp, Oryza sativa
tgcataggatatgttgccctcttatatatacctaactacctaaagtgtctggtgatcctgaccagatatggatcattttctctcaaatgtggttgccttctatctgtagatttcacaattcacatccccaaacaaatcaaggaaagtactaagtgcagatgtccatgcaattacactaaagaaaccaagagaattaagttgaatcaaactaggaaagactaattgagtcatgtggaactgtggattctattagatctatcaggtgtatattttggtgcattaatatgatccgataactcatatatgctctccatcctgtattataagttcatttttatgaaaaatgcatgctttcacaactcaagccattgtggaagtcaagtactctgtagttattgcagcatttgcggtctatatctctgctttatttgtagttattgcattatttcagtctactctttatttcctttttcgaagatgtagtacaaactgaggttaaattgttatttagacatgtatataaggtgtaaaatgggtttttctagtttgttacttcatgaagagcatatatgtaacagttaatatatttacaactaaggactgttataggataggagacaaaactatgggcaaactagatcatgatcctatattttataattttgctggaaacttaacagggtgcagagtgtgcttgggggtcatttattgtttcgtgcaattatagttgtaaaatcatggaaatgagaaacttcgattgagagtccgatgactttatgcacataagcaaatgaggagttaagcctcatctctatacctgtcttgtgcgcacatgcgcgcacacataatcctaaattctactcaataccataggcttattaataactaaggctctaccctacagaggtgggaacataattttttcatggacaaagataacaatgctatatctaccagtacgtgcttgttatggtaatttattggtttaattgcactgactgcttttgctagtggttgctgacaattacaaaactcaattacttcgtctttttttgtcctattacatactccgtattttgcactgtctttctgcgcctgtggttcttacgtgttaacattattgtcctttagttggcactagtatatatacatatgtccaaataaaactgcctctttctgtcagttgttaaataaagttacttctttctgtcagtagccacctcccgtttctcttaactagtccttatagtcctacagctgcagatgtcttctagttttgatttatggtcatagttatgcttttaattcagggatgattacttatattaataacatatatttgatgcatcaactgttgtctgcatgccttgtcataattttgttaatgtagagaatcatagtacaaactccggtaccaattcctaatcatttatgttcattatgcaggtgataaca

SEQ ID NO: 19787 - DNA, 1501 bp, Oryza sativa; identical to SEQ ID NO: 19713

SEQ ID NO: 19788 - DNA, 1501 bp, Oryza sativa
gcaagcacaatgggatagccacacatgtagggaaaggattgttcaaacaacaattaaactactagcagcaccaaatagcaaagctataagagtgtgagagagatatcaccgggattcttgcaagtcgatgtgttaccaaagttcaaattcttgaggggattctactctcctttgaagagctcacaatgagccgagtcttttctgaccctatcctctgaggctgcacaaatgcactactccttccaccaagagtatctcttcccttttgaaggtgagatccgaccttcacaaactccttcaatgtccaactccttcacaaactcctgggcaatagggccaagtggttcagaagtaaactcaaaatcatcaatgtgtatccaactcatacaaaattatttcatctagagggtgagtaaatagtttgaaaaacttcggcactgtagaacccatctaaagttaagatcttcttgcaacttctctttcacaataaaattcaagaaactcaagaaaagatgccggggacacaaatttttgttgttcatcaggtagatttggatggtcattagcctctgggtttggatggagtggcatccccgattctcatgcttggggtgtggaaactatcaattcagacttttcttcttcttcttcttcttcttcttcttcttcttcttttgcagtttttgtttcgactaattggactacaagaaataagatggacatagagaagaaatttgtctcacaaccctactgttgtgctttacatatgtaaatgtatttcactagtggaggaagacagcatgcaaggttgatctcatatgctccatggtgttagaatgacttcgctgcttccagtcatgatttaagcatcttaaagtttcagcttttgctatgttctccaaaacgccgatcttcatgtggttaggtgataggtcctgttagtgctcttctcctgtggactgtggtccttggatcatcgaatgcccaattattcaggtcatggaaaacctggtactgcaggccatacgacccatactgccatgtatccccatgatttttattgcctatctgaatcaggtctaagcaaaatcatttcatgaatcctctcaattgtattggtctgactggatgttgggaaggtggagtcttgttgttgggattgaagtcatccaattgcttctcattctcaggaaaaagttctctggtttgcgaggagtggatgaaatgaacaataaggctgcgacagagtatcagcaactttgtcgatctcactgaatgtttggactatgggactgtgaccttcttggttatttgctgggattaatgcttccaatccttcctggcctgacttgcaacgaatcacaaataaaagttccaatggagtaatttaatatccaatcaagtttaacaagcttgcagttcttaggacgaatatcgcacaagttaaaataaggtgcgaaacaaggaaataaccaaagataaattatatcacaattctttg

SEQ ID NO: 19789 - DNA, 1501 bp, Oryza sativa
gcatattcggctttggcatactcgtgggctttttcaaacatctgcttaaccgtcctgggaggtttacgcccgaacttgccgactaggtcctcgtggcgaatgcctttagtgaaggcggcgatgatgatgtcgtcggtgatgtcggagatcttgttgcgttgttcggagaagcgtcggatgtaatctcgaagggattctccagacttctgaacgacattgtagagatcaaactgtgtgccagggcgttcaaaggtgccctggaagttggcgatgaagtgatcacgaagttccgcccatgatccgattgtgccacggggtagtccgtggagccaggatcgggcggagttcgctagggccacaggtagatagtttgccatggccttgctgtctcctcctgctgcgcggattgcgagtccgtagacggtgagccaagactccggattagtggtgccgtcatacttctcgattccagtcggcttaaagccggctggccaatccactcgacgcaggtcattagtgaaggcagctactccatccacgtcgtcgtcgtagcgatttggtgaatggcggtgacctcgtgctgcacggcgctggttgatcgtgtcgcgaaggtcgacgggacgctggtgaggtggagagcgaggccgttcgactcggcgctccctgtgacgttcgggaggcgagtgaatagatcgttcgtcatgacccctgctcctgcgactagatcctgtgccgatgatgctgaggcttggctgatgataatcatgagatcggaggtgagggactcggctatcagtcggggtgcgggtgcttgcggagttggctggaaccgaggcagcgatcatggtcttcgtctggttcaagatgttgacaacatgatcaacttggttgagtgcgtcttccttgaggagggtgtcgaggagagtgattgctgcaaccgcgttctgctgggggtgcgaaagaccgctgttccatcgacgtcttgttgcccaatgagctctctcgctcggcgcccagattccaaggcgcgttgccgtcgatcttcagcctcctttgcaatccgttcgtgatcttgttgctcgcgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggagcgtgtaattatcctcatagctgtcgtcgaagttgtcgaggtcgccgtggtcatagtggtagccgaaatcgtcgtagtcgaggatctcggttggtcgagaactgacgccgggggagctaaggtaaccatccaactcttccgtcgagactgtcccaagaggttggagtataacgccaacctctctagatctagattggatcggggccgaagccggagctcgcctagatcttcgagtgggagatgtcttggcagtgaagacagcggccaaatc

SEQ ID NO: 19790 - DNA, 1501 bp, Oryza sativa
ggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggcgcaagggccgctggcagcggcgacgccgctccgctcggccgctccgcccggcggcgcgctagagaaaaagtgggcgagcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgtgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctact

SEQ ID NO: 19791 - DNA, 1501 bp, Oryza sativa
caaatacatacatgttcaaagtaatccagcaaattcctacgagctcgcatcgcaataaacagctcgaaagatcatccaagaaatgcttccaagaaacggaaagggagaaggaaatgggcacgcactagaggttcccgtgcgggagcgggagcgggagcggcagggtttggttctctcgccagagctccgccgtggaatcgcccacggcggcggaggggagggacgcaggaggagctccatcaagaggataagggaaaatctcttccctttctgtcgttggatgctgctgctgctagtagctcatatcgtcatctgctctgcggagagccgagccgagcctggctttggctcggctaacatagcagaccagctcgtttactgatgcggcgatgcgtgcgtgactgcgtgtggctggcccgcagaaatattgggtgcaaccgtgcgagattttagatagaaacacctttttttttcaacaagcagttctaaataggaaagggagaaaaaatatttgaagtatcctcatcaatggcggttttgctaattcgcgcagatgcgccatatgcttatctcgcatgcacacggcagatcaactgcgcatccaccttggtcccacacatgcatgtccctacacacgcatgcatgcataatcttttattttaatgttttcatcttaattaatttaggatgtagtgaaagttaaaaatttctattatactatctctgtttcaggttataagactttctagcattgtccacattcatatatatatatatatatatatatatatgtctagattcattaacatatatataaatgtgggcaatgttagaaaatcttataatataaaacggaggaagtaagatatttttaatggaaaatactttttataattcaaaaaatctgagttgaaagttttcaaatctcgagctgaaagtttcaaatttgagttgaaagttttcaaatctcgagttgtaagtttccaaatctcgagttgaaagttttcaaattttatattgcaaatttaaatttgagttgaaaattttcaatatttgagttgaaagatttcaaaatttgacttcaaagtttaaatcttaagtcgaaagttttcaaatctaacttaaagttttcaatctattagaaaaaataaaaagttcttgtaggcactaattatgattagcactaatcactaatcacatcatcattagtgctaatcacatggttagcgacggggcacagcgtacgcgtcagcgggtgtgcatgacttatgctcgcggcgcatacgcgcgcgttaggaacccccatgaatggacaggttacaactgacccaaaaaatattgctcattgttttatttcttagaagagaatagaaagtttgtacaacaaagagcgggaggacgtgagacccctctttgtgagttcggccaggggatagggcacgatgatcaagagcgtaacctcgccgtggattaggctagcgtggtggatggcgatcaagag

SEQ ID NO: 19792 - DNA, 230 bp, Oryza sativa
agtaggattttgttggaggcagggacaaatttgttgacaacgttcattgatccatagtaaaaccaaccgaatgcaataccttggggatgagtgccattagccaataaatctgcggtgttctgctaacataacctttagcatgtggtttatgtaattttcttgtttatgtgttatttctcttgattgggtaatatagttgtaactttacttttcttgtttcttggtataga

SEQ ID NO: 19793 - DNA, 1501 bp, Oryza sativa
cgcatctccttgttgccgaagaaggcgtcgaagagcttgcggaaggcctgccccatcccttcttcgccgatcgtagcggccggatctagaagcttccagaagattccgcggcgagcgaggaggaggaggcgggtactcggctggagcctggagcggagccaaagccaagggagccaggggggagacacgagagaggagacgacctacctgccctgccctgcccgtcgtggattccagatgccgagccgaataatctgggccgtccgatctgtgcggggcccacctctagttgagtgcattacctttcccttttttattcatttcatatactttgaaatcaactttctagtaatattcatccattgggcctagaggtagcaagtggcaacggcttgcaatttgtagtgtgtaaagtagtaccgtaaagcgctttgttacgtgaattacttaaaaaggtttttaatattttttcaacaattaagctagaagcaaaagagcaaaatgaaattaaggaaatgtcacagttcattaatactaatcgtgaaaaagacaaatgatatccatgctttgatgcagaatatattgataaatatatattaagtattatagatatgatagatatatatgttaaaatattgtggcttgtggaaaagatgtgaaggatgatgattgaatatgtttgcatttcggtttgtagaattcaataaatcatagatgaggttgtatgcttgaatgaggtttgatgtgtaattattgctagtggataatgatatggtatggttacatattaagttttagacttagtgggttgtaattttatatatggtatacatattaagttttagacttagtgggttgtaattttatatatggtatagattatatgactaatgtactactgacatgttaagaacatcaaaaattgataatgtgtatagtactgctgcaaattagtacacaagttatatgtgcatagtagtactgacatgataagaggtgcatcgtaatacttaattagtgtgttcaataattatttgtcgattttcttaaataaccattatttgttgactaaatatgtctttcaccatctttgtgcctttggaggttcatggcttgcaccaatttgattgatatcatttttttatttatatgggctttaatcccgtgactatgtaaccctttttaattggtaaatagagaatcgatcattgtacaatgcttagcaagtgatcggttaccccgtagcaacgagcgagggtatgtgatgaggatgttactagctcgggtatggttataaccatacttatattacacatcaacaatctaaaagtgcatatattttatataaggtttacttattatatgtttgaacaaatgttactatatcatgagttttatatcttctcatatgcagtaggaattgaaccctgtatacgaaaatataatcaaatattatcaaggaaagttttctccatagacttaatgtgacacccaaaagttt

SEQ ID NO: 19794 - DNA, 1501 bp, Oryza sativa
gtctattgctgagatgtacatgttttatagatagcactttacattaacattgcgggtgctctaagtgatcaaatatagtaacctttttcgttttagcaagaaaacttggtttctaagagcgggtacaatagtgctattaggaacgctccaaaacttgttaatcagtctaaaacgagattaaggaaagaaaatcagtgattgagaaagaagccgtcgcttgttctggcgccggcgcttgtacagcgctccacgctgtatcggccaggagatacaataaaaaaatttgtttgtgggttctactgcttgttaattcgtttgaaccaaggtagtttatagctaacttgtagttagcttgttgtatgagatgctttttaagttagctctacttgagacatgataaaattttagagcctactactagctgcactattgaccttgctctaatggccgcgcacacgccgactgcttaactcgggcaacgcccccctctcccacaccctgcgcgcgattagtgcaagacgcccgccgctaattatagtcattagtgataattacagtaattactgttaattatcataattagcatttttcaaaatacataaataattttaaatttgagttaattttttttaaattttgatatggaagttttcattaagttttcagttagaaatgaaaatttagaattttgagttaaaagttttacatttttgcgatgaaaatttttaattgtgagttgaaagtttttgaaatttgaattgaaagttttcaaaatttgagtcaaagttttgatttttgagttaaaagttttgaaattggagttaaaaattttcgaaacttgattcgaaagttttcaaatttgaatcaattttgagttgaacgtttcaaaatttaagttgaatgtttcgaaaaataaaaaaacgataaggaaacgagtggagtcgaaaataaggaaacatagcacgtggatttgtgggccgaaaatcatggcgaaaaaaggaaacaacaagtaggctggtgggccgaaaatcacgggaaaatgtgaaaacagcacgtgggctggtgggctgatgcgcgaccatactgacgcgtgtgcggcagataagaatttcgcaagtaaacaccctagagagaagtatataaccaattgctccctaagctaggaatatatcctacgaagtagttttctattttacgagaaattcttgattcacaaacgtttcccagccacactcggtcaaatcctcttctcgtcggctccggcgtgcatgccagcggcggcggcggcggcgagaaacgctggcgaggaggcagcggcgagcgcttagatgctagcgaaccagcgaagagggcactgcagcagtggcggataggcggaggctagaagggagcagtacggccagagagctagggtttgggtaatttggcgagcgaggagcgaggggaggcgaagggagaagaggggggggggggggggggaggagaaagagcgggggaggga

SEQ ID NO: 19795 - DNA, 326 bp, Oryza sativa
aggagcacgcccagaagacggttaaggtattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccgccaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaa

SEQ ID NO: 19796 - DNA, 1501 bp, Oryza sativa
attattccacataaaattgtgataaaaattcacctcaaaaactgtgaaaaaagacataatttcttactttgaaggcatttattctgaagttttatgtaatttactcaaagataaagtgatatccgtttaggagtgtctatttcactacctaatacatttgttggcaggggcggatccagcatgagggcggcggggtctcgagctcccaatactgccgtgaagactatgagagaacccacgaagagcccactaaatttttttaccataggtagataggaggagggactgcaactctatctagctagtttgctcagaccccactgctatttctttctagatccgtcactgtttgttagttgcacaaatcttcaacataaggaaccttgtttagtgatatagaatccggatggttttaaacaaaagtaggggttttagaatgcaatatagctcaggctcgtcttggctcgcatagtcgcatgccaaatgagccgaagtcgctagcagctcagtggctcactctggcgcttttctttaaaactcatgaactttattgaagattagattaaaagcatattacatgagcgatgattacatctcccaaagggagtgttgaaaggattcccaaaatgggactgcttggaggataataagcatgtatgtctattgttatgacaattcagatcagtttaaagttggctttgagatttctagccttttttgcaaggctatcagcgtgcttgtttgcttctcttggaatccatttgataatgatttgtgttgagttttactggaagtatagtcatcctgttgcaaagtttgaacaatgatcccgcaatcggaaaggaataccgtggttcccatagaaagtgcagagcatatctgataggccatgattattcctacaagttcagcaagcaaagacgaaatatagtttttggaatatgcttttatcagataaaaaattccaaatcatgcttcattgtccttccaatatgtgtaaacatagcaacgggtacctgtaggtaagggctgaacagaatgtataagtgtttggtcttgattgattacctgttgctcttgttgtcggttttgcataatgtgttcataagtttttgccatagcttctgctgcgttacagacctaaaaaagcttacaagtttttgaattgaaaatatggtcatttctagctttctagattttccatagtaaaactgaaatttttaaaagaggtttggcattagtgaagttgctactacctccatcccaaaatatagcaatttttggccatgaatctgaacatatagccagaaatacttatattttgggacgaagggaatagaagataagacaatgtctcaaatagcgtgtaaatggttaagggcatctgctttgagttgaaaatcatagatgaaccaaataagcctgctgaaataataatgaaaacgcagttggaagttttcggacataggagcttacacgagtaagtttacttaccgcacct

SEQ ID NO: 19797 - DNA, 1501 bp, Oryza sativa
gcggcccggatcccccctcagggggtcagacgcgtgggtaataaatagccaagaggcgcccgagtccgcctagggggctcggggtatcctgtcgcaccccgaggccctcactcggttgccacgtggcggtcgagtgggcggagataggggcgttgccaggcgtatttacgggcggcgccccaaccgccccccgtcgcatttaatgcggtgtggctggtcgtgcgccgcccagtgattgacgtgcatcaatttccttgaccgggctctgaccggccaccggcagatgggacaggcggcatcgcacccacgtcctaccctgtgtcaggcggcgtggggcaaggtatgccccgtctcatcaacggcagaggatcgatgttcgaccggtgcatcccatgcgcatgtacccacaaaagtctacaggaatttatgaaggaatgacagggatgtcccccgtgtcaggcgaaggacgacgctggggcccacctgaggacgagcggccaccttactttcggcctaaggcatgggcggtagctcgacccaggttgatgtgggcccctctctaggaaggagatgtgtagaggcggtgcatgtggtatccccttgaactataaaagaaggaccttgcccaccgagcaagagggtgactattgggagcttgagccttaggagaagactagccaaccgtctctcttgggtttgagatctcttgtaatagcgtaaacagaaatccacacaaaggagtagggtattacgcttcccagcggcccgaacctggataatctctcgtcgtcctcttgatcgccatccaccacgctagcctaatccacggcgaggttacgctcttgatcatcgtgccctatcccctggccgaactcacaaagaggggtctcacgtcctcccgctctttgttgtacaaactttctattctcttctaagaaataaaacaatgagcaatattttttgggtcagttgtaacctgtccattcatgggggttcctaacgcgcgcgtatgcgccgcgagcataagtcatgcacacccgctgacgcgtacgctgtgccccgtcgctaaccatgtgattagcactaatgatgatgtgattagtgattagtgctaatcataattagtgcctacaagaactttttattttttctaatagattgaaaactttaagttagatttgaaaactttcgacttaagatttaaactttgaagtcaaattttgaaatctttcaactcaaatattgaaaattttcaactcaaatttaaatttgcaatataaaatttgaaaactttcaactcgagatttggaaacttacaactcgagatttgaaaactttcaactcaaatttgaaactttcagctcgagatttgaaaactttcaactcagattttttgaattataaaaagtattttccattaaaaatatcttacttcctccgttttatattataagattttctaacattgcccacatttatatatatgttaatgaatctagac

SEQ ID NO: 19798 - DNA, 927 bp, Oryza sativa
ggatagctctcaaatgcatgggtctcaatcgaatctcttgtgccaagcaatctctcgggcaccgagatggtagaacgatttgtgccaagccattaattgggccttgacaatgagaaaaggcacattcgcgctacgagcctagctaggtgcaactggacctggtcacctgggcgcgcgttagtgttctcgacatgggctgttgcggtggtggtggtggcagtgtaccatcaccgagaggtgaccgagcggacgtcgccggaagctgacaacctcagctgtcaggttcgtgtgtcgtgacaacctcagctgccgaaatcatttttgcacgggacgtacacggtacacagcacggtgcacccgtatgccatataaaccggaagtggatttttgtccctcaaagagacatcctcttgtttctgtgcatgtcgtttacaaagatataaaaaaataaaaaaaattgtcaagatagatccatatatggtatatcttttcgcaaatatgcgagttaaaatttgacttatacaattcgaaaaaaaaacaaatttgaccgtgaattacgtattctattcatagttaaatttgttattttttatatacttgtataaattgaatttgaatttacatgtttgtaaagtgacatatcacataggaatattgatctatcatactaatttttttaaaaaaaatttaataacttttaaaatgacatgtataaatgagggatatccccagggaatgaattgagttttccatataaaccgccgtgtcgccgtgcacactcatcatcctcgcaatatctcattctcgggctcactttgttgatcatggaggtggaagcggcgacgacgcagcgacagccatgcaagaacgcgatcaccaccaagcagcagcagcagcagcagcagcagctgagcaccggtagactgt

SEQ ID NO: 19799 - DNA, 182 bp, Oryza sativa
ggatagctctcaaatgcatgggtctcaatcgaatctcttgtgccaagcaatctctcgggcaccgagatggtagaacgatttgtgccaagccattaattgggccttgacaatgagaaaaggcacattcgcgctacgagcctagctaggtgcaactggacctggtcacctgggcgcgcgttagt

SEQ ID NO: 19800 - DNA, 1501 bp, Oryza sativa
taatttcatcgacaccgacttcaatttacagggcaaaaacaaaatacagttcacgaaaagaccaaaacgccctctgcctcgcaggagaccggtcaacgcgtgagacaagtcttgatggcaatagcgtaaatacgcccgaacgcccagcgtcatcgcaggatatacgcctcgacccggagattacctaggccaaagggttccgttcctttccgtgttgcctcccaccgcaatctcgtttcggctctccggccctctcctagggtttcgattcctcgccccctcgatcctcgacgacgcgaggtgcgtacgcccatggattctatagcctcgccttccctcctcgattcgatccttggtccatctaaatccgtcgtctttgtttggtgatctgcaggtggttttccttttttttttggttttgtttgtgagagtggggggagatgccgccgaaggctaggaggggcgccgcggcggcggggaggaaggggccagggacgaggggcaggctggtgaaggcgcaggcggccgtggaggaggtgcccgccgaggaggttaaggctgcggaggaggccccgaaggtggaggagcagaagcgccagccgtcaccgccactgcagcagccggccgcggaggagaaggcctcgtccgacgctgcagcgaacggcgcgagccacggtgaaggtattgcttgcttcttcttcttctttcttttttttttttggtatagatcgtttatgttgggttgtactatgtcagttttttggtatattaagatgattgctgcattagtgtatttttatgtggggtgcaatgaacgtccgaagtagcatgtcatggatgtcttgttatattgactgttttccatttaatcctggttagcattgcttatggtcgcatggtttgcagttggaatattagatctatgagatcatttagtactgttccaacggttggtctttgattcagtctgagtacatggcattgcccttcaacaaacagcaacattgatctttcctagttttatgcaagcaaaacatagtgagaaccactcttaataaaacattaagatcatatgtttatggcaaaacataaaagatcgtatgtttatactttatactcatggctgtttttttggctatatttttattggatagcagttgcccatgtagtaaggttgtacttatttcatttttagatgagggaactacaaaagaaacatatgaagaggataaaggtgaacgattggaatttgaagatgaaccagaatatgaagaggaggctgctgtggactacgatgagaaggacttggagcaatatgaagagcaatacgaggatggtgatgaatggtggaatatactgaagatgtgattgaagaggagacggatatggtagacgaggaattggatggtggggacgatggggagggtgaaggatatgaaaatgccgaagaagagcataatgtggatgtggaggatgaagagcatcatgaaatggtgaaaga

SEQ ID NO: 19801 - DNA, 1501 bp, Oryza sativa
gatgataaatgaatacataaagatatttttctacaagcgaagatattcctaaattatttttataatatgatataactctaaccattattaatattattttttattaaatttttagttattatacagttaatcctactttgattcgctgggtgatcgaatgcaaacatacatttacatctacatgtaacgaagcgtaaaatcttaatacgaatccaaaacgtcatgtatggcctaatcagagaccaaaataaccgcacaagcgatatcatcggatttcttggaatcattatagaaaccaatgaaaacaaataaaatacgaataattaaaaattaaaaaaatcagtttattcttttaagttgactggaaaacatattttaattttgttatttttatacatattagttaaaagtgaaattcactgtgggaattcacttgaatatatattttcttagaaaattatgagctgcagttaggagtatgtgagtttttttaaagagatttctatatgactgtttttgtattttcaaaagcggaccaacttagaaacggagtcaaaagcgggtatatatttctaaatgcgaatgaagcttaaaaccgactcaaacacgaatgatctatgaaagtaccagcaaaaacatcttcaatttttataataatagagataaaaaccgattgatttgtattgtcactatagttgtgagcccgagtcccaataccaatggaaagaacaaatgagtttctttatttattggagctgattaaaccgagaggcttctcggtttagattttgtgttttaattgataacgtcgttgactttttgtcacatatttaaccattcatctcattcagaaaaattatgtaattataatttatttttttaagttattttatcacttaaattactttaagtatgatttatctcttatatatttgcgtaaaatttttgaataagacgaatgatcaaacatgtattcaaaagtcaatggcgtcatttattataaaacggagggagtaataattatgttgcaaatcgtttttaggcaacttactagaaaaatgcatccttgagcactctcagagtctggtgttattttttgtgttttcttttgcaaaacaaatgctaatgtatgtaggtgttgtcagggtgaggcacgttagattaacttttagcttgtatggattgtgtccaaacatgaattcagcaataataaaaggggtagtgcacgagacctagaagtggatggatgcggagacaaaggatttagacaggttcaggccctctcgatgagaggtaataccctactcctgtttggggatttgaatccgccgggtgtagtatagatctgacgatctagttgtgtctcatgccccctagagggcctcctgcccaccttatataggatggggggcaggattacaagatagaaatcttaaccaatacggtatcggtttcctaaatatattctacaatattatcaaatcaggactttaggccgctc

SEQ ID NO: 19802 - DNA, 1501 bp, Oryza sativa
catttaagagtacaacagtgagtctgtacaataaaattatgtttcttttcttttctctaatgcatctgaggataaaaatgtttgagttataaaaatatccttttatttcttctctcccaatgcatctgaagatcttatgtggatgggttcttcaaatacatgtcccttggaggatcttatacaagaatgtttgtctatgtgaatgagcatctttcaggtgctcccatccccttaaaaatgtaaatatttatcatggaaagttatcaaacaaatcacagcaacatagagtgtggtgcacaaaaattcaaaactttgcatgatgaaggctaaaaaatttccaagtaacaattcttgtttctccttatacaagttctgtttacatttcaaattttgtgaagtggcagatgtcaccatactctatattactaaacatttttccataaaaaatgtatttctgggatgacttttatttagtttatcctaggagcacctgaaatgtccttagcatatgtttattaatgacacatgccatcgcaccttttgagttttgtatgctgtgcacaaatctatgaccaattaactgtgcacgatgaatttcacaagactgatttaatatgttgggtgtaaggtatatgccacaggggtttttcctacttatcattttggcaccacttttttcctaattgttgtgatgccactggttccaccagcgagatcaatatgcctctccaccgttaacgttaattaagtagcactcacagtatcatatcaataggggttaagcatttctttgacaaaatgcccatggaaaagagaaaaagggccttcctctcttcacacggctatcagccctcctcactccatgcatgtggccacaggtgattgctgactaccacatgcgaggaaggcctcgccctgggcagctccacctgcctttgccacctctgtacctggttcgttaccactgcctggagccttcctcggcctcctcctcatgggctctgcgtcaccactctgcattgatgttagttacttctgcactggccccggtgccactaccctacgcctgcctaggccacttctgcccatccccaattttgtcgccgccattgcctctggtgtacatccccctaggtctagtttccacgcctagtagagtgatgatgttgaagactggtgtagctttccctgaccgaagccccccatacccagacctggttgccaacgtgatctaatgtaagaaccatgacataataaatctaatgtgagaactatgacacaataacacacaaaacatactaaaattaacacttcgaatttcatgtgtaaccaacttatgtgtcatagcaaaacaccaagttgtcaatttttagagcctgtagtttacgccatcatttatttgatatcccttgcattcttataaaaaccaagctattagtttaaaatattggaaatttaatatgaaaatatactaaatgataatttataataatttcacagg

SEQ ID NO: 19803 - DNA, 181 bp, Oryza sativa
gcgcgctccgcgtgctccctcgtcggatcctcccacgagcccaccaccgtcgcccgcaagcgcgcctgccgcgagcccaagcctcgcccggagaagaagaagaaggatccctcctccgatgacgcctccggccggggcggaggcgggggcgtggtccagacggcgccccccgcgagcggcc

SEQ ID NO: 19804 - DNA, 458 bp, Oryza sativa
ccaaattcctggaaatggttggcttggttgtctacattatgcacaattgcacatccttgaatgtatcacttatatcttaatgtctcttttgaaggtattgagctataaatgaatcctgaaaagcgtttaaacaaattcaaattcccatggaactattatttgtaaatattgcagatcagtatacaattccagacttgatatctccacttcctgttttactccatgtcaaggcttaggtcttttggtccaacaattccacgcttccccttcttatgtgattccatcttatctatatttattggttaatatatcagaaatatttagtttagtgcagttttttttatcatgactttgcaagttatgttgtgtggcatcaatctaagatcgttaataatatctatgttatctgttctataaccaatgtgctacttcagtaattccctttttttggttgcagt

SEQ ID NO: 19805 - DNA, 1501 bp, Oryza sativa
acaatccatacaagctaaaagttaatctaacgtgcctcaccctgacaacacctacatacattagcatttgttttgcaaaagaaaacacaaaaaataacaccagactctgagagtgctcaaggatgcatttttctagtaagttgcctaaaaacgatttgcaacataattattactccctccgttttataataaatgacgccattgacttttgaatacatgtttgatcattcgtcttattcaaaaattttacgcaaatatataagagataaatcatacttaaagtaatttaagtgataaaataacttaaaaaaataaattataattacataatttttctgaatgagatgaatggttaaatatgtgacaaaaagtcaacgacgttatcaattaaaacacaaaatctaaaccgagaagcctctcggtttaatcagctccaataaataaagaaactcatttgttctttccattggtattgggactcgggctcacaactatagtgacaatacaaatcaatcggtttttatctctattattataaaaattgaagatgtttttgctggtactttcatagatcattcgtgtttgagtcggttttaagcttcattcgcatttagaaatatatacccgcttttgactccgtttctaagttggtccgcttttgaaaatacaaaaacagtcatatagaaatctctttaaaaaaactcacatactcctaactgcagctcataattttctaagaaaatatatattcaagtgaattcccacagtgaatttcacttttaactaatatgtataaaaataacaaaattaaaatatgttttccagtcaacttaaaagaataaactgatttttttaatttttaattattcgtattttatttgttttcattggtttctataatgattccaagaaatccgatgatatcgcttgtgcggttattttggtctctgattaggccatacatgacgttttggattcgtattaagattttacgcttcgttacatgtagatgtaaatgtatgtttgcattcgatcacccagcgaatcaaagtaggattaactgtataataactaaaaatttaataaaaaataatattaataatggttagagttatatcatattataaaaataatttaggaatatcttcgcttgtagaaaaatatctttatgtattcatttatcatccatcatcagtccgaatgcggatcataaggatttctttttatcttggggtggattttgatatatgagaatctgaacaaattttaaatgaggaaagactggtcaaaaaagtaatttgaaaggtaaaaaagttggattcactttcaaatttctgaattgagtttgagaaaatttttggaaaatgtcaaagtacagatctaatgtttatcaaaattttagtttatcctgttgcaacgcacggacactttttccgagttatacaaaacgtaaagaactaattatggaattggaagggaggggataaggctaagctaatcc

SEQ ID NO: 19806 - DNA, 614 bp, Oryza sativa
  unsure (1)..(614): unsure at all n locations
ttattcggggattcacaccgtatatgctatgtattggtatcaagtcacttggttgactataattatcaaaaaccactcagttggttggattatttattccctgacttatgcttggtttattcaattaaccccatggtcgggggctacacctattaggtgcatctagtcgatgcacctaagtttatatttaattatttttcagcccccccttcccccaaaccagtcttcagatttggtaaaagtagttgggagaccatggcaaagatgattgaagcactcggctttggagtaatctggtttgagagaagattatcttttcgactgtgaaggtcttaggggctactgtggagattatgggtaccctatacccacacggcatggttatccgactagtcttaggggatagcttatatctatggaatatgtaacagatcattggnaaaacctttttttttcgtattacgtttccttttatattatggagcggcctaaaagcctgatttgataatattgtagaatatatttaagaaaccgataccgtattggttaaggtttctatcttgtaatcctgtcccccatcctatataaggtgggcaggaggccctctaggggca

SEQ ID NO: 19807 - DNA, 1364 bp, Oryza sativa
tcgcgccctattcccccgggcaaactcacaaaggggggcttcacgtcctcccgctagagaggatcactcctcgacacatgggctacgaatagacgaattatcataacatttctgaataggcacatttacaatgacatgatttaatttaccctaaaatctgcgggttatatagtacacttttttttcgtaccgtttcaactttaaaattgggtttcataaatagaccgctcaaaacaatacacattatgattttctcaaattaaccaactcatttaacttataaaatgttaacttagatttttttctgtaatcatagaatgaaacaaaaagcaataaataaaatcttagcacttattgctggagttacgatgggtaaggcatagaaaaataaacgtaacaatgaagataatttatagctaaaacttttatatttttgttgttaatggtttaaaaaccagagctgaaaaaacgactatatgtaatgaaaaggccaaaaaccaactctacaattgtgttttatgatttaaattttgacagtgtgtgttgataagccagcaccaaaccagagagttataatctctcttaaaataatgaaacaactttaggcaaaagataaaatgatacattcaatagttacatttctcacctaaataacggatacctggcatgtatttcatctagttgagaatcaacagccatagttaattattaactgcgcaaagtagtatgccaacaaatatcagctaatcacaactaattcttcttgaatgttcagcggatcggagaacacgaaaaggaagaaagcacaactacctaaaaggatctacaataagattccattaattaacaatgaattaagtttgtctctatcagaattttgctgatggtgatggaaaaggatactaattgaaaagttattttggcctatggcgtcatgaaaaggagaaggttgcagcacatgcatgttgtaagcggcagtgcaaagtattcgttcatgtatacaatatattcaatataagtattacactggtggtacttatttgtaaggtcattgtagaactgtcatggtgaaattccatactagtagatgataaaattttggattatcgtggcacgcttttcaaactgctaaacgatacgttttgtgcgaaaactttctatatgaaagttgttctaaaatatcaaattagtccatttttgaagtttgtaataattaaaacttaattaatcacatattattatcatatcgttttacgtgaaacacttaatctttatcttcatctttatctttagaagattcaaacgtaccttaggtatgctgatgacagagccaatgtcacaattgagtcttggtgactaacaga

SEQ ID NO: 19808 - DNA, 1501 bp, Oryza sativa
ttgggcatcaacatcatcccgtcacatcaaagtgtcgaaactagatttcggcaataataaaagggggtggctatcaagctggagaagtgaatgggtttggagaccaaggatttatacaggttcaggccttcttattcaagaagtaataccctactcctgtccggggatgaatccgccgagtatcttattgattgtatgatttggagaaaatcaacaacgcatatatgcccctagaggcacccggacccccttatatatgggaaggagtccgtgttacaaaagataatctatatccctaacggaatatgcagatacagataaaatacagtcgtaaccgactaagtctcaaggtatttccttgatgtgcaagttgagaaacaaacccaagatacaaataagatattctatctatattcggtatcctatattcagtccaaatatcatcgccgtgtagatataggatatccataatctccacagtagcccccgagacctttgcagtcaaccatcatagccttctcaaggataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttaagaataaaataatagcacaatcgtgcatcatacgacaaaagcatacacggcgcctaaagaggcattctcagccgactgctttttagccataattaaaaggaatccgagtggttaacactctaaaaggttcacgaatgaacacacttgacaggcatccgaataaaaagctctaaagattacccaccaaatattataaaaaattatggtaatgaataagtctaatagcctaggctatgactatttaccataatgaaaacaggcatataacataccaaggaaatgactatggtaaaaacaagtcattccaagttaacccagacagctttcgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaagtactgttcagcctaagcccattcgcacctccgacacccttaacaagaaatcccgagatccaagcgacacttcatcttccccgccggaactctcgccattttccccactccctgctacagtacagagctgcgccggcaaactagggttcaccattccactcgaatccaccttcaaaaagttcatcaaaatccttcccgtgatccaccgcctcaatccttcacctctccctagccatccctcgaatcaaatcagcgcattcggaaaaaatcaa

SEQ ID NO: 19809 - DNA, 1501 bp, Oryza sativa
tgttgttgaagtaggaactccttagttgaggttggtgttgacgctgttgtcgacgaagctggatgtcatagtagtagaaccttgagcaccaagtgcccctacctagcgcgccactgtcgatgggggatacccgtaaaccggatatagagggtattggggtacgctggtacgaggatctacatagtacgacatcaagcaaacaggaaacatggattatactggttcaggccccttggtacgtaatagccctaatccagttgatatgggattatatgatagaaaccacagattacaaagggaatagcggaactcgacgataccgtcgggatcgtagttgagttgatccgactagatctcccggtgacttggctccaacaagctccggcttcgtaggctgtggtggatgtgttggctctgagatttgatgccttaggtcctcccggggggtcccttttataccgcaggtcaactggtctccaagtaggactcggagatatcggacccgacacgatacaatgacgacccagttctatccgagtaggactctttccatctatagactccgtgatggacttccttaacttatgctgagaacgtctgtatacgcgcaagcataccatatcgatatgtgacgtatatcgaggggtagagggtataccttacccgtaaccctgacaggcgccatggccggcggcgagcccatgcggcagcagcctctcgccggcgatggattcttctggttcctccccgcaccgaagccaaccacctcttcccctttcatcgccttcctcctcctgcctcatcgctccacccatgccactcccccagttatggaggctgagaagtggtggagagggatggaaaaaaggagagaagaggtgaggatagaggaagaagatgaatctagcgggtgggtcccacgtgcagatagggaatatgatggaaaacatgacggcgatggcatggttacattttttgtaaaaaatggcacgactacgaatagacgaattgtaatggcatttatttagatagacacatttgcaatggcatggatcaaattaaccccttttgaaaagggagaaagagtgaaaaaggtgttttcaaattcagaaaattataggttaaatggaaattgctatgtgcattttggtaagtaaagtaccgttgatagaaaaaagatgcattttaattttacaaattctaaaatcaaagctaattttaaaccggacacttttcatctttcaacttttcaaatcgtttgctttattatttgccccgagttttagcttatatgacgatgataaacaccatacaaacaaaaatcatcttattttaccttgagaaggttggattgaatgggttggccccggaagtttagggatgtattgtgtatggtttggtcgtttggaagcttattgttgattttcaaacttgggtaaaatcgagggtaaattagatcatgcaattgcaaatgtgcctattcagataaataacattacta

SEQ ID NO: 19810 - DNA, 1501 bp, Oryza sativa
gaagaaatgcgagaagaccacgatctcatgtgtatcaggggtcggaaaagcctcaccgcacgctggccgccacccaatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggattttgatgtacttttcgaaggtggatttgggtggattggtgaaccctagttcgccggcgcagttctgcactgtagcaaggagtggggaaaatggcgagagttccggcggggaagacgaagcgtcgcttggatatcggattttccagttaagggtatcggaggtacgaatgggcctaggcctgaacagtacctcagcccaatatttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattatagtcatttccttggcgtgttatatgcctgtttccatggtaaatagtcatggcctaggctatttgacttatttattaccataatctttataatacttggtgggtaatctttagagtttttatattcggatgcctgtcaagtgtgttcattcgtgaaccttttagagtgtacaccactcggatttcttttattgtggctaaaaagcagtcggctagcatgcctatttaggtgtcgcgtatgcttttgtcatataatgcacaaattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctgtatcttcatattccgttaggaatatagattatcttttgtaatccggactccttcccatatataaggggggtccgggcgcctctaggggcagatgttgatttttcccaaatcatacaatcaataatacac

SEQ ID NO: 19811 - DNA, 1501 bp, Oryza sativa
ggaattttagaggatttcaatcctataggaaaatttcctatgaagccctttgaaacaaatgattgaatcctatccaatcctttgaaattcctatggaatggacaatcctatagagattttggaggaaatttagcaagagcttcaacctcttgctaactttccttcgagtctatctctctcatccaattcctgtgtttttcctgtggttcaatcaaacggccattcctatgtttttcctgtgttttgcaatcctctgttttacacttacattcctatcaaaatcctacgtttttcctattcctacgttttctcaatcctgcgattcaaaggggcccttaatttaaaccttgctatgaaggaaagcttagaagaaaaaaaatcccgcatcctatacaccacccatgtattaaggtaccacagctatccacctagaggtgtaagtgggcttgtccgcgaacccacttataaccaaaattagtacgtaacccgcggatttgaccagcgggttacctattaatttgatctataagagcaggtacaatagcaggctataaaccagctataaacatattttaaagagataaaataggagagagaatagcaggtacaatagcaggctataagggcatccacaatgtagtgtaaaagtagtccataagcaatagaatattccggtcctcatcggtaaccctacagctttggttgatcagccaaagttggctttttcagttcagcataatcagccgtaaaaaggtgtccagtaagatcggatccactactaatagctggtgtttattcagccccaataagctaactgatgggcttgtgctgaagatcagcctcagcaacagcaaaccgatgaggtcctccattcagccacctataaccattgtgcaactagtccatatatagaaaaaataacaaaaggtatccatatgcatatggactacccatatggaataaattatattatctatctctactcatctctcttctcctagtgatacattatatccatatacattgtggagattgccataggtaaaaactatttatatgggtcctatctatatggatcactttgccatatacattggtgatgccctaagccagctataaacatattttaaatagataaaataggagagagaagagcagcgggttacagatctgtagccagctgtagcacggactccaagacgtaacgtgtgtatgacagataggaccaggtattaatagtatagtaaacaactattatacgaatcgactattaaattggctatagatgaattggagctcgtagttggctatcctattaaacttgctctaaatgggtttatggatcgacccacttgtatatctagatgcggtaaaccgaagcacgacgtgaaaacccataaattatcatttatcccttcttcctataaagttatcctccactaagtgcaattaatctcctaaaactcacacctcaatgttccacgtcatcattaattcacaa

SEQ ID NO: 19812 - DNA, 1501 bp, Oryza sativa
aaagtgaccacgcaccgcgcgtggggcgcgactggtcactaatcagcgccccgcattcggatgccagttgcacccacattagctaaactagctaatacgctacagtcgagagaggaggaaaaaaataactcaagaaatttgtcattgttttcagtactccccaaacaaaatttagtctctaattctttgtcatgaatttacaaaatttttaggtttgatttttacgggtttttatttatttgatggttttcactgaatatgttaatgttgtattttatgtggggaaaatgtgattgttggggaggaggaatatttagaagaaatttttttattaaaatatttatgaaaataatttttagtttaaaaaatctacagatctagacgctccatgagggtgttttttgaaaatcacccttcttgaggacgagaaggggcctaactgtattcttttatttgtattaaagactattaacgcttgtttgccactctaattaaatttaaataaaaaggtgataaactacaaagcttatatgaaagtttgtctacatacactgtcgtttgaaacgtagatatgagattttgttagaaacaagttttagatttttgtaacaaatatttggagtcctaaacgatcttaaactaaaaggttattaactttgaagttgtaaatctcctcaagctctataattttaatgtaaagtttgatttcattggacttgatatgatatatttttaaattgtaaaatcacaacgttaacaagctatatggcaaaattgacatttaagtcccttgggtatatttctgtaattttaagaaaaataaaattttcaaaactgataaattctcaactattataaaaattgaatatgtttttgccagtattttggtacgccatccgtatttgagtcagttttaaagtttgttcgcttttggaattacaagttcgtgtatgaatcggattttaagtttgtttgcttttggaaatataaaagaagtcgtaaaataaattccttttaaaaaacttgcatgctaatttgagatgaaagtcggactcctaattgcagctcatgattttctaaaaaaaatatccaagcgaattcctacagtgaatttcatcctagctaaaccgtataacaataataagattaaaatagcattcatccgttgcaacgcacggacattttatctagtataaataaataaatttaagaattccacatctataatactccagcagagaaacaaataaaaacttgagaaatcggtttgctttaccggcccatggggcttaatgcccaaaacccatcattggcttctgctgtctgtgtacatgggccgccttctatctacgatgacaaactcctcttcgccgtcgtcctcacctcccgtgagagatctcctcttgtgcgggcggagatccacagccggcgggctcgacctcctcctcgggcgccatccacgcgcgcgcgatgttctccttcggcggcgggtcgtcgctga

SEQ ID NO: 19813 - DNA, 852 bp, Oryza sativa
aatagcttaggtagcgtttgggctcactaaagtgcttcctttttcttatcttttagacttccactatgaattatttaacacccataaaagaactttccttgcatgattttctttattatgaaatcaacatttatattgacaaacctgcttagcttcagttggacaatgatacgctgcagtaaggcatctcattgaaggacattggtggattctgcactgctattctattacttaacttcagtagagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggagtcaatggtacgcagtagtgaaaacatagttaggagttgcatgttatgttgatttgctattccaaaacgtgtttgaactgtagcaggatgtttgttcctattaaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgtagtattgcttgatgttaaaagtgggtcacaatttccagtgttggaatctaattcagtacatggcaatgaaatttcattgacctc

SEQ ID NO: 19814 - DNA, 1501 bp, Oryza sativa
ttactaggctccactgtaccagtccaggtcaccaccgattgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgctacagtgcagaactgcgccggcgaactagggttcaccaatccacccaaatccaccttcgaaaagtacatcaaaatccttcccgtgatccaccgcctcaattcctcacctctcccaagccatccatcaaatcaaatcagcgcattcgggtaaaatcga

SEQ ID NO: 19815 - DNA, 1501 bp, Oryza sativa
cacctcgccgcgcgctgtccttaccaccacctgcgtgtgaccgcgccgcactacgccgccgccgccgccgctccgactcaggaagtcaggaggatgagacccaccgaaccctaaatccttcattgggctgcgatagactaacatgggtctcctgggctgcggtagattgacatgggcctcctgtggtggaagaaatatataggcctcacgtgttgtgttcaatccgacggttcagatgagatctaatataccgatccaacggttgtgaattaatgatgacgtggaacattgaggtgtgagttttaggagattaattgcacttagtggaggataactttataggaagaagggataaatgataatttatgggttttcacgtcgtgcttcggtttaccgcatctagatatacaagtgggtcgatccataaacccatttagagcaagtttaataggatagccaactacgagctccaattcatctatagccaatttaatagtcgattcgtataatagttgtttactatactattaatacctggtcctatctgtcatacacacgttacgtcttggagtccgtgctacagctggctacagatctgtaacccgctgctcttctctctcctattttatctatttaaaatatgtttatagctggcttagggcatcaccaatgtatatggcaaagtgatccatatagataggacccatataaatagtttttacctatggcaatctccacaatgtatatggatataatgtatcactaggagaagagagatgagtagagatagataatataatttattccatatgggtagtccatatgcatatggataccttttgttattttttctatatatggactagttgcacaatggttataggtggctgaatggaggacctcatcggtttgctgttgctgaggctgatcttcagcacaagcccatcagttagcttattggggctgaataaacaccagctattagtagtggatccgatcttactggacacctttttacggctgattatgctgaactgaaaaagccaactttggctgatcaaccaaagctgtagggttaccgatgaggaccggaatattctattgcttatggactacttttacactacattgtggatgcccttatagcctgctattgtacctgctattctctctcctattttatctctttaaaatatgtttatagctggtttatagcctgctattgtacctgctcttatagatcaaattaataggtaacccgctggtcaaatccgcgggttacgtactaattttggttataagtgggttcgcggacaagcccacttacacctctaggtggatagctgtggtaccttaatacatgggtggtgtataggatgcgggattttttttcttctaagctttccttcatagcaaggtttaaattaagggcccctttgaatcgcaggattgagaaaacgtaggaataggaaaaacgtaggattttgataggaatgtaagt

SEQ ID NO: 19816 - DNA, 1501 bp, Oryza sativa
ttaacatcggcctttatcacgatcattaaaagtttgtgaaatgtaatcctgtaaattgtaccttacatttgacataacactaattttgttgatctcattgatcatgcctcgtagccacacaaacagtgtgcagatttgcagtgtagtgataaaattgctcgctactgatcgaaatttgcaacatgataggctaaagttgtaacaaaattacggttttaacgaaatggctacatttgtatgaaatttcactgagaaaaagaatctcaatggactgcgcttatactctcaaacctgtggtgagtgattgctttttctcttggtggtaaagcacgataatttaattagttattcgaaataaaaagtataacaatgcaagggccagattgcgattgttgtgctatcctgtgattatttttttcatctgccacggaagaagtagttgtggaacttaatcagtaactctgtctggcagatcacattaaaatctaacaaggtaaggcgaggaaggttaagaacaactacatctgcatgcatgcaaagcctgttgaccaaagtgattttaaatgtgaattttaccgatctttacaaacatcaagtcagatagtcaaacggtaaaatactacgactaaaaagtggtttcaccaccaggattgttcaccggaatactaaacatgccttgatagagatgaaagagcgagagatgataataaaattattatttttgttattttaattcatggcaatgaatttttgtccgtagtgcgccatacgaacgtgtcagaattataatacctccgttctgtaattgaaatactagaagcttattatgaacagtatctcaaagaatttgatattaaagggagttaccatggtaaccgtataaaaccgtgtaaaatccgtcttcaaatatttgaattcaaaaatcaacggtttcagcgtggtttctcgcggtaaccgcaatatttgcgcagttatcgtcaagtgtctagcaaaaaattgaaaaatcacttaaatgtgtctagaaattgggtataaataaaagaatatataggatatttgtaaacctaacttttaggtgtaaaatacaaaaattcagcataacattttctatattatggatttcgaagcaattcaacaacaatctaatgtactttcggtttcgctctcaaatttgaacttatcttactccttttcaaaacatttcttcaccatctaccactacaaatcaagaactatatccataatttttttcggaattttgaatttgggtataatttatcaaaccctactgccggtaacccttacggtacccctgatcacgatcaatacaattaacaaagaaattaatagcatgttcaaacacaaatacactgcgtatattcgataaactggtggtgctgggctctagctagctttcaccggtaatgagaaaccaaaatactcaagggattttctttagaaaaatgccacttggtagtaacaacttgtagctgaaaatcta

SEQ ID NO: 19817 - DNA, 1501 bp, Oryza sativa
atggagccaagatcgggcggaatctgctaaagccaccggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggtgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagagtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcttccagtcggcgacgttcttcggtctcccggacttggcgttgctcctccgtctcattattggccatgaaaacgccaaagtagagaggggtgtagttgtcatctaggcttccgtcgaagtcgtcgtagtcgtcgaagtcgttgtagcgagagctaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttctgcctaggcctacgggatgaagacgctgtcgtggtgaagacggccgctaaatcgtcggggagcttcatcaggactggtgggtaagtcccatcatcttgatctggtgtcgtcggagaagatgcgatctcggccgagtggtttgaagccgactcggttgagatggtcttgaagtagctttcagccgcgttcgggaatccaaacgggaccgaaagccggttctctcccgactggtctgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgc

SEQ ID NO: 19818 - DNA, 1501 bp, Oryza sativa
tcacttctgttttttttttccattacatatgtataggtacatgaacatgtcaggctgtcagctatgacaacagagcatactttgttgattggcatatcaatgcaaggagaaattgggaagcttgttcaattttcagtgagtttttggtcattttcttctggctgggatgctgcatgaatggcaatttctgaagctcgatgggcattcgctttgtttcattgtttgtttgttacgaatgttgtatgcagccacttctgtaataagttcccggcagttagatttgcttctgccatttagattttgcgaactttttttttactgctaaaatggctgtagcaaagcaatgcctcacttaggatcttgataatggctcccgtgtttctctcggcaaaatagcactgctgtctgctcctgaatttaatctggatagtgctgctccttagtttaacctggatatgtgttttttgggcctgttagcaagcacggaaagggaaatatttcaacgaaagcactaattgcagagggtgtggatgctactgtattcgggcgcccagcgcggaaaacggttcaattaagtattagctaaacttttgttaagaaaaatgggtcaatatgattttttaaagcaacttcatttcatatagaatgttttttaaaagcgcaccatttcagtttgaaaaacatgtacactaagtgcgggtagttgggaactttaacagacgaaaacagctgttattgtgttctttgttgacaatggattagcatgggcacgcctaaagttattctggcctaaaatataataagttaaagttagttataactcttatttagatgtataggtaaaacgttaatttattttgagataaagggtgtaaattgtttttttcgtgctacaaagagtttacttttataagggcatttccactgtactaatatgtgcaaaggcatctaaatgtcatttcccacgatactaatatttaatttatttatttgtactcttaataattgtcaaaaacttaattttatccatcatcactttatcacaccctaactaaaactgatcgagaaaagcaaactccacttgattacttcatcgtgccgacgtcgacacgcaaaatgtcgtactactgcatcgtcgtgccacgtggctatgcagcggtcgtcgcggagctctcgtgtcgtgcaagtgtccaccgcattcgggaagctcggacctgatgaggcacatccaaattgatccaaagccaaattttgatacttccaagtcgcgcgtgatttgtcagctgttagttgtcacacctactcatcagccaaccaattcgccatcaatagcaaaccaagcggattgatcatctcatctcatctcatcgaccgagcattctagcgagcgagcggccaagccagcaagatcgactcctcactctctcaccgatctagcagcagcagtggtagtagctagcagcgtcagcgtagcaaggggttgcgagaatggcctcgccgt

SEQ ID NO: 19819 - DNA, 1501 bp, Oryza sativa
ccccaataccctctatatccggtttacgggtatcccccatcgacagtggcgcgctaggtaggggcacttggtgctcaaggttctactactatgacatccagcttcgtcgacaacagcgtcaacaccaacctcaactaaggagttcctacttcaacaacactggtgtggactcaagtcggcgaaattgtctttccggtttacaccacagtgccgatcttagctggtccgccaatagccggaaacgagaacgcagtggctacaacccggggcgactccatgtcgaaggatcctcccgccgaagcggagatcggaacgtcgacgacatccgagcccgagaaggatcctagtgcggccaagccttgtttttccaataggaatcacgagccgacgaggattacttccgaggtgacaaggtcctggtgtcctatccacaaaaccaggaaacacttcctgcaagcctgctgagtctttctcaacgtccatgctgaaattcggcctgcaaagagcgtgaaattcagcgtacctctccaactcgtgatgtctattgttctattcacaagacaaagaatcacgacctcttgagctgcaaggtctttctcagcgccatgaagacgccgcctcctaaggtacagcagtcacgcatccccatcagggataaggacaaggaacaaggagcgacgccgatttcagatcgatttattggggtaatcgacattgatccccacgaaccatcagtcttgcacctgctcgaagacatggatcatcgacaacaagtacgccatgtgaggtattggctattgatgatgtcggcacgtcagcgtgcaccaatacggaagcggagaatcaagtgactactctggcccagcacatcagagctgtcaacacaatactgagggaaaccccctacgatcccgttctgaacgacgatctcgcacgttggatagaacgactacgggaatcagtgaccaacctcagcaacgcgttcgaagaggccgctgccgcagcgcacccagaacagccaccaaccgcgatgctaatggtgaaaaccctgaacgccgggaatcgcctcatcgagtcacccctccacctcgcggcaccggcgatctccgcgatcacctgaacggccgccgagaggcatgacgcacacgagacaacgagaaccgttcacggcgtcatgtctcttcacggggtcacgataacgaagatcgaggaggccgttcaagcgaagaccaagaccgtgataaccgccacaaccgccacgatcacgacgatcgcgaacggcgggtgctgggcgatactggtcgaggacgtcgccataatgacgacgatgatggagattggcgccgagacaacaacgggagacgatgacaggattctcgagaacccggccgacgtcctcgtaatcgtacgccggaaccaagtgacccatcgtcatcgttatcatcctcgtcatcttcatcatcagacagacatccacgaaggacgtatgatcgccgacaac

SEQ ID NO: 19820 - DNA, 828 bp, Oryza sativa
aaagctgacaacatttttgatctgctactccgagagaagcaaattcaactccctgctggtcatacgattccatcatctaaggaattaggcaaaaagaaatattgcaaatggcataattctgggtcccattctactaacgattgcaaggtgtttagacaacagattcaggtggccattgagggaggcaagattaagtttgatgattccaaaagccgatgagggtcgatggtaacccatttcccgttaacatagtacacacagttggccgaatagctgatacggggtgcatgaggggttatcaagtaagttcggctagaattataaacaaatatcaaaggaaatatgacaagcaacaggaaaggcatcatgaagaagataatggtggctttgatcctcattggggctgtgagttcttcaggttctgtcggaatgaaggtatgaggttaccatctatcgaggattgtcctggatgcagtgatgttgcaaggggttcaagccgattgtacgatggaggcaattggctaaaacagacaagagtgcctgttcatcagagattgggtccagtaaaccaacgtggtgattcggaatatgacgaaaataagaagactcaatggtgtcctgctagtatttttacgaagaatcagaaaagaagggttcaaagattgaggagtagggaacgcttccaggaggtcgagcaagaaattaatcatcggctgaagaaagcaaaaccgaggcaggagtggcgtgttaagaatcaggctcctgtagccgacgatgttgcagctgatgaggcaaagaggttggcaaaaggaaagagtgttgtgacgg

SEQ ID NO: 19821 - DNA, 1501 bp, Oryza sativa
gcaggacgccaaggaggactgcgaaagtgaaaagggggcccataaattgaacaagatgttagaggaccacagaacgtcgttgtacccaggttgcgagcaggggcacaaaaagttggataccactctggagttcttgcaatggaaggcaaaaaatggtgttagtgacaaggcaattggtgatttattgaaactcgtcaagaacgttcttccggagggaaacaaattgtccgagacaacgtacgaggctaagaagatagtctgccctctagtactagaagtttagaacattcacgcatgtccgaatgattgtatcctatatcgcggtgaggagtacgagaacctagaagcatgccctgtttgtaaagcacaacaatacaagattagacgagatgatacaggagaagttgacgggcaactaacgaagaagagaattcctgcgaggtgatgtggtatttccctataataccacggctaaggcgtttgttcaggaacaaggggaatgctagaatgatgcgttggcacgctgaagagcgtcaacaggacgggatgctgaggcaccccgccgatggttcgcagtggcgaaacatcgacagaaaatttaaagactttggaaaggacgcacgtaacatacagtttggtttaagtacggatgacatgaatccttttagagagatgagcagtggccatagcacttggcccgttacgatgtgtatctacaacctccccccttggctatgcatgaagaggaagtatataatgatgccgattattattcaaggccccaagcaacctggtaacaacatcgatgtgtacctaagatcactggtcgaagatcttaaactgttgtggaagaaggaaggtgtccccgtgtgggacgaggacaaacaggaggagtttaacctacgagcgctgctgttcgtaaccatcaatgattggcctgcacttagcaacctatccgggaagtccaacaaggggtacaaggcttgcactcactatatggatgaaacagaaagtacgtatcttaagcactgtaggaaggttgtgtacatgggtcatcgtcgattccttgcagcgaaccacccggtatggaagaaaggcaagcactttgaacatacgtggaccaccgtacgaagccaaaacatcgccgcggtaaaacagtgtttgctatggtgaaagatcttaaagtagtgtttggaaaggggcctggcagccagcctatagagagcgaagatggttacgcggcgatgtggaaaaaaaaactccatattttgggagttaccctatgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaa

SEQ ID NO: 19822 - DNA, 1501 bp, Oryza sativa
cagtgagaaacgatatgctccctgattgggcttacaagctgtatacaagcttgtgctgtcgatcaatcaatggaatctggaattttttttatttttttcccctcaattgctttgcttttataccttgcatttggtgttatatgtatggtttgatctcctctattcctcttgtctctgagcattttgtgtcatgcattgttttcagaaaaatatgtgatcaggaaacggacaagagctgagcattgcacgggtttgttggcgtttttttgacctattggttaggtccaggtagtgtgtgacctttgatgttttcttcactttataatatgcatatgaatattgaaggttgcttagggcatgagcaatagatgctactctttagagtggccttaatgtgctatgtgggctcaagccacacataggtcacaccacccataatgaaggttgctctaaatacttgttgtgtttcagctcctaattgtaaatgtatcagctcttgtgatatttcttattatctaatcaattgaaacctttatattttagacctaaaaactaaaaacaatgtatgtatctggtggagaaaccatcattcgtcggtcggccgaattccataataatcccggttgcaacaaaaaccgggactaaagatgatctttagtcccggttaaaaagggtaacgggcatatttgatctttagtcccggttggtaacaccaaccgggactaaagatcatctttagtctcggttcaaatgctgtcagggcttgtcaggcccccccggtatctttagtcccggtttttaacaccaaccaggactaaagattgtaactttagtcccggttggtgttaccaaccgggagtaaagatcccggcgatctttagccccggttgttaacactaactgggactaaagtcccatccctttatatatgtcttcttcctcctccagcccgagcaagcttcaaaatttcttcaaaaaagaggggaggtcatgccaaaatttatagtgaatttattttggtgattatatacaaatcggaggtgcctaaaaggttagcaacttcatcctccaatgtttttttttgtcatattacatttggagctatgttttgcacacttttttgtctccaaaattttgttgtaagttgatgagagagaaaatgtatatggggaagaaagaatatatataaatttagtttatttgctaaagaaggttttataaaatagttgagaaggaaaatatagtgaaagttaatcttaaataatagaaaacaaactaaaatgaaaattaaaagaagtacaacatattaatattagtttaaaactttagaaatagtaaataagaattatttggtggaatattttataatttttgtatgaataatgatatgtcattattgtatgactcttgaaagagtttgtaattattttatcattattgtatgactgtcatttttgtacgaataattatttgtgtacgattttttttcatttcatgtaga

SEQ ID NO: 19823 - DNA, 1012 bp, Oryza sativa
ccagcagggagttgaatttgcttctctcggagtagcagatcaaaaatgttgtcagctttagtaatatcaaaatcatattctcttcctttccatacttttacccattggcacggtatgacctttttaatcctcacccattcggctgtagctatctcagagtcatcctcatcgtcatccgacccatacatgtaaggacaaacatgattaaccttcttagagcttttcctagtctccgcagacctatgctcgtgcaaggttaccttttgtatcagatgtgacaagctatcaaagtcttcagacgagaatttctccctaatcggagcaatcataccctgaaaggctagatcggctaactgagcgtcagttaaactcaagctgaagcacttgtttctcatctccctgaatctctgaatatactcgtgcacaggttcatcatgccgctgcttaatcgccgtcaagtcagaaaacacgaggcctgggagatctgcttaactcagataagatcggctgaaactccgatactaccctaatcggcaaccagaggacaggctagagattgatattctaagcacgacttaatagatcaaactcaactgatgcagcattaagtatgaaaagaagaacaatatctagacaatcaagctgctgggtgtttcataaagtggtagatatcctatataatctaggacaacgtcgctatttaacctaatcggctgccttctattaacagatgttagccgattgtaggttaagatgacgatattgccagagattatgtaagatatatgataacttgacgaattatatagacaagattagagtgtcataaagatggaagcactaatcccgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtgttgaacgtgtgtgttaaaaattacatagggctcgggg

SEQ ID NO: 19824 - DNA, 197 bp, Oryza sativa
tttgttgtgaatgagtactagtgttactgatgacatgatgattgcttctcatatcgtaattgtgcatctaggtccgatctctggctgctgaatcctttcgagcataccaaaatggtccacttgagcctaccttttatcgggaagcatctactgcattttcagtaaatgaactggagggtttttcaatcccatcaaga

SEQ ID NO: 19825 - DNA, 1501 bp, Oryza sativa
aacggttagccgattcattacttaactaatcttttgttcctgttttgcagacaatagaatcctcccctccacatcagagcaatagtggtaggaacattgaatatgccccaggtctgattcctaatggagtgcacttacgttgatggcagcatcgcgctcggctgcccccttctcgcaaagggggacggggacgttgctcgctgttgtcgggccactgatcatcagttggccgactcggcgctccacggttgcgctgtccaagcctgcagatcgagaccggaatccgataagtcgggaagaacacgcgtataagggagtcaatttaactaaaaaggaaaataccccgaggagaaatccgggtcgcgtcctccgtcccagaataatcaaaggtcggatgagctcgagcctgaagcggctggatctgcctaccaatgaagtcggcagtgacttcataccccgataacccccgttctcggaggtcatcaatgacatcgatgaaagattggagggatggggtcaaggcgggtttggtggtccaggatggaatcttgtctggttgctcctcaggaacaacgaagaccggatccgaatcctctatctgaagatagaaccacctcccccgccatttgctgcgagatgaggggcactggaaggggatgtatcgcgacttcaggccatcccgaagtcggaaaccaacacacccggacacctttttgggttccatccaacacaactcatagtaaaagcggaaaaggtcaagaaacggctctaccccaatgtaggcctcacaaagatgcgaaaagatatttaggaaggcgatggaattagggttcaaatggagcaaggaaagaccatggaaattcaagaccaagagaagaaattcagaaggcggaggaagaaaaccacagagaataaagtcctcgatcgcaaccatgcaacccaggacaggctggggttcagtacctcctacttccctctccgcggtcccacgaccgggaagggcaccatcctcctgcagtttcttcagcgatgcaccggtggaggttgacttgtcgagatccatcactgctggggatcgccgaagaaaggatcgagatgagctagctagggttttttgcgggagcgaagaagacgagggacgcttggaagctggagagtgttttcaacaggcgtacttcaaatgggatccccaaaactcccttaaatagacgcacttccgacggtgcgaattccaaggaaaggagagagatggccgccggaaatttcggggtccgttacatgcgacagtttttcggacttcagtttaaattcactcatgaccgttgagcttcacccgacgttgtcgatcactccttgtctctcggtcttcacaccgagaacaacgacaacatcagaagccgcgatcggtctcacaagttcatttaagcagaagtcgggagctactgtcagggttacgggtaaggtataccctctacccctcgatatacgtcacatatcgata

SEQ ID NO: 19826 - DNA, 504 bp, Oryza sativa
cgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgct

SEQ ID NO: 19827 - DNA, 1501 bp, Oryza sativa
atttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggca

SEQ ID NO: 19828 - DNA, 1501 bp, Oryza sativa
ccctcacatttgccattagcttaagcttcagctttttagctggcagatcttaaggcttcagaatttctctttaattcatcaaggtatggatccacttgagcatcatacattgcatttgttttgcctggatggagcttttcttgagttttaaatgttttaccaatctatcattgtttcgatggcatgcttttgcccctggttttgatgtttcttagaatcaagctcctgcaatttcatcagcactttctggtttttttgtcaaatacttgcttgttctgttcgagcaatggttctgaagaataaccagccaacagcttgctagcttggtgactgggattattgctggaaatactagataaaagatcaaaacagtttatctagttctgttctgggattattgatcgaccaagttattggaaatttatgccatgttatgaaattcttgatgaaatacccaacttggtgattttgctctgttttgctggaaattagacagaaccagcaaggtttttgtcagtttcagtttcagtaaagaaaaatgtcactgtttatgttcacctcagatgtagttcattgaacctgcagcaatattcagttatattgtttcttaagatagtgatgagttcagtcaattaaccagagcatcctttgcaggatatcaagaagttcttcaccatgaagtacatgaagcttgggacaaagcctgacacattctacaccgaagaagctgtcaggtaaatgtcgtgcattcgtattttcgtttgtcgtttcaatgaatatttgtaactattttgactttgttgcactacaggtctgtactgtcagacgtacctgctgatctcatcatacatgtcaacaacacaaagtatcagctacataaggtgctggttttgttcattgatgcaaaattatctttattaccacttttgaaccatttcctatattcctcgcagtgctgatgaaatttcctatccttaacttttaatgatataagatatacatattgatcacagacttttcttctagaaaacagtatttgaattcaatagtcaatcaaaaataccttggccacctaatccaatctgaggagcatctcccctgaaaagattttgttccatactgaaagccaaagttgattgaaaagatactcttggccatcaactccatttgcacccttatcaaggtattcaaatctgatagccacaccacctttgcgaatcactgatttattaagcattgggcatacatatgaaacatagaatatgataggaggcgctgaatcagatccatctttctctgatagtttaacatgtcacatgttccccaatgctacattacattgtttaagcaatgtcacaggcctaatgatgatgtgaagttgtgaactaaggcaactttaccaagtcgcggctcgcaatgattagcacacatcaaagcctaatgatggcctcaaaccaactctatctttgtttagtcatcctttctgaaatgacgaaccgac

SEQ ID NO: 19829 - DNA, 1501 bp, Oryza sativa
atttaattaatcaatcatgcgttaaccgttcactttacgcatcttcttaatcttcttatttcccatcctctcaaatactccaagttctcattttctactatagtactatgttcttatttttctctttttattagtatgctttctaaccaatgtatttttttcaaaagatctctatacaaaaatttcttaaaaaatattaatttatttttagattaactgttgcttaattaatcatgttctaatgaaccatccggttttatatgaacggagagaagatccctacctccatccgaacgcacactaggaatgtttttcaactagaaattcttcattgagttgaggtctcatacttaatttcttgatttagttttaattaaagatatgattcatagtctacagtgatatcatgatatggaagtatatcgtaggcaacaccattaactgaatcaactctgattttagttttttttaatcaaaagaattcatcaaacaacaaactacatacaaattccgatgtttctttcttcactggtgcaatgcttttcttgcggtggaacccgtctaccaatctacctacattcagtgttgaacgtagtatatgtgcttgcatttatgattaattattttttcagtgataggtaatatatatgtcgatagcgagatatctatgatgactttgttaatatcaatatatatcgtcctagttttctggagatattgagagatataagagtaagttcaatagtatagcccactactagctacaattcacctatagctaatctaatagccaattcatacaatagttacttactgtactattaatatatggtcccacctgtcatacacacacaatgtcttggagtccgtgctgcagctggctacagatctgtagcccgctgttctctctcatcttttatctcattaaaatatgtttatagctggctactagtctgctattgtacctgctctaatgtgtactccctccgtcccaaaatataagtatttttagaacagtgtgaagtcaaactttttaaattttaactattaatagcaaataaattaaaaagattaatcatgtaaatttgatggtactttgtttatcattaaacgagctatcataatatgcaactctctttatttaaaacatcttatttttataaatattattggtcaaagtagcacctcgaagactgaaccgaggttaaaaaaaatacttatattttgggacagagggagtattacgtttgtatggtgttaaaaaaaagagagtaacaactggtcaatctacagctggatcgaaattgcaaatgtcccagcatcgggtgatgcggacgtttcccttttttaacacgtggccgtccaaccaccacaagtcagattcagattcatcgaacgactaggattcgctgacacgtggaagatcgtttaactcgggcctactcaccagtgacataacctccccccaccccacgcagcgcgcgcctctctcttttttctc

SEQ ID NO: 19830 - DNA, 1501 bp, Oryza sativa
cgtaagctcattatttatatgccactcaaaaaattatgaatatatcacttcacaaaaatgcaagttcattctaaccaacaaacacgaaaatgcttcgtatctggcgtctggtccgacgccaaatatcggacgactcgtccttatccaaaagttactctgtaactacctcctcctcctccccccccccaccacacacacacacacactcctatctctcttctctttttttttccccttgcggcagaggcaaggtgctagacgaggctggcgacgggctggtcagcatcctgctcgtggcggcgctattcatcctgctcgtcgcggacggtgcggcggcgttgttcctgctctaccggccgcaggcgccagccatcgccatgatggccgtgcagctcccctccttcgcctcatgcaacggcaccgtctctgactttgccgtcacctcctccgctgcttcctcctcccctgtgcagaccatcactgtccccgcctccggtccgtccccagcggcagtgctgcagccggcccgtccctggcggcggtgggcgcggtggcgctgcagcaagaacagccgcagcagcagcagcagcaggtggcggcaccgccggtgatggaggtggactcgccggtgaccggagatgaagaagatggaggtgggtttgtttagttggagtttaggatattgcatcctactgttttagcttgttacactctgttgcattaaggtgtttcattttgttttgatttgatgtagcaatctattgtatgtgtttgttgcactctattttattcgtgtgtttcatccttgttttatcggatgttgcacatgatgtacgatgttttagcttgttgcactctgttgtattaaggtgtttcattttgttttgatttgatgttacattgcaatatattgtatatgtttgttgcactctattgtattcgtgtgtttcatccttgttttatcggatgttgcacatgatgtacgatgtgttttcttggatgttgcagaattgagtcttgatgatgcaagtagtgttttttcactgtttcatctgattgaaacatttttttaccaattggtgaatcatttctcatcgagtaatgaagcatctgtaacattttctagtgaaacattatttaatgagtgatgaaatatctgaaacatttttttatatatgatgaaacattgtccgatgtatagcaattgcaagttagaatttaacttctacaagtgaaaaaaataactatagctatttcattgcaacatgtagaagttaaatataaccttttatgtttttgagtgattaatcacatattaatctatcttattgatttttttaattttttaaataagatttttttaattttttaataactatttaaataacatgcaaacaacgagggaacgttctcttcagagcagtttccacatattgaactagagttcagaaaaaaaaaaggtgtatatgagaagtgagcagggagctcagtcaaagaaagt

SEQ ID NO: 19831 - DNA, 1501 bp, Oryza sativa
ttgagttagggttgtgttttgcttagattatttctgccttcgcagtttcgctgctagattggtttgtgaaaccccaacgtcgagttcttaaataatcattcatttgcaattaagttgttgtttttcttgttcttacttgtgttctttgattcacacgcagggattagccttctcggcaaggtcaatcggttttagcatggctgataatcagagaagacgtgctactacgattgtagggtttggatcatgttgatcggaagttggatcgtgtgtgtcaagtttccaccaaatcgatagttatcttcacctgaaggaagatcgggaatcccataatcccgttgccatcaccgcctctctgcctttaccccaaggtccatcctagagtgtgcaccaccgcggcctctgcctcttctccggtctcctcaggattgtcatgtcgttcttcggagtctcaagtcatcgaggcaacaaggattttgcaagtattttttttgtgtttgtgtcatgttttggatcttgcaagttttgatgccaattttctgattgagttgtgttctttttgaagcccactgatttgtgctgctggggtttggagaggcagatggctgattatagaagaagagtcgggtcatttgtttcttgtagaaagagttagtctgaagtaaaatgttttgggttaataaccatagatatattactgttaatacacattttgcttcctgttgcaaccgagcatcattttagtttttatttttttaactgggtttttcacacctgtaattgtgatgggtcacaagttattcttcactcttattcttttatctttttgttgggttacactcatcactgatgggccacaacttatgagacgatcgagattgagtcatctgtgacaagttctatacagtcaccatcgacgggccttcacccgtcagagatgagatcagtcatcactgacccctaatttctacgagagctaaactcgtaagaggtgatggtatgggtgcatcggtgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctgtatcttcatattccgttaggaatatagattatcttttgtaatccggactccttcccatatataaggggggtccgggcgcctctaggggcagatgttgatttttcccaaatcatacaatcaataatacactcggggattcatccccggacaggagtagggtattacttctttataagaaggcctgaacctgtataaatcctttgtctccaaacccatacacttttccagcttgatagccacccccttttattattgccgaaatccagtttcgacagttggcgcgccaggtaggggtagcgtcaagcttttcgccgatcagtgcaa

SEQ ID NO: 19832 - DNA, 582 bp, Oryza sativa
aaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcatactattgggataacttatgactcactattatttaaggatggcttaatgatagttcacgatggttaatcgtgattggttaattaattacttgccaactaaaacttgataatggtgggttgtgagcacatggttttgagagtcgtgctcatggcaattaaggaccggttcgcgagctactattgtgagacatttaccgtgccaaccacaagccagcgtgggcaacggctttatcttttgtatagcgtgattcattatagtgcgccagactgagaagtggcgagaagtccacgggggtcgctggggagtccatgccttgtttataa

SEQ ID NO: 19833 - DNA, 1501 bp, Oryza sativa
aattgttacaatgctgagaagcttagctagacaaactgctgaagcgagtgagctaagcatgcctagttatctctataggataatttaaggtagggcaagttgcaatagtgcattgtgatgtgttgtcgggggaaggatttttttttattctgctttgttaaaagtatatattacaagtatataattatatggaagcaattttgttgacaaatatactgattccgttctaattagacaatctcaaacacttatgtgtatagtagtacgctgaaattttaaaggcgactctctctatctataatatagcaatttagtaccggatgagataaattttaggactatgaatccaaatatagtgctagaatacatctcatccggtattaggttagtacgtatattataggatagaggtagtacgtcgcaagtaggacaagtaaattgtatgtcagccacacttgcttatgtgagctaaacatcttggtggctttaacaattaacatgaagctcaagctcttcaaacaatactagaaaactagtccaaaatgagtctttgcttcaatgcaaacgccctaccttagtccctcttgagatctaccctacaaaaattttacattatattattcaagaaagaaaatcagtaggtgccatcttatcaagacactctgactcacccacttcctaagctctaaaaacaaaaaaacaaaaaatacttgtatatgcttaccttcttccaagtctttcttctatcaagtcatcactatcccgttcctctgatctgatcttagattaataatactaatataaattttagaaatatggacttcacatttcttttatgcaatggtgaatagtgtgcacctgtcccatactcccagaatatttataagcagtcacctgaggaagtcctagctcgctcgctctctctctctctctctctctctctctccagtgttcctagctacaacgagtggtttactttctcatcctaggtagcttgtctccattgttttcccaagaggagaggttctagaagcttctagataatggcagtcgatcccgtgtctcttttgtgttcgtgctagagagtgagtgatgatgtgtgggattctatggttatatatattgaatttttcttgagtgtgttctctaggaaattcggttttatgtgcaagataaaaggcaaagagacgagattggtggctgtggatgaggaggcttagctcttgagaaaaggatcgattgacaagaacatgaggtgagttcaacatattgtttgatgatgtgtcaaatgatctcgagttatttcgctgaaatttgatgtagtattgaatcaggagtttcatgagacgttttgggggataaattcagtttgctcttgagcttgaatctttcaacaacagagtgcaatttttatttccaaaagaattcctcaagtactagtttgtttcatcttctctttttttttttgtcttacttgtattttacttcctccatcctaaaa

SEQ ID NO: 19834 - DNA, 1501 bp, Oryza sativa
gctgcccatcctgggccacctccacctgctcacgccgctgccgcaccaggcgctccaccgcctcgccgcgtgccacggcccgctcctttacctccgcctcggctccgtcccctgcgtcgccgcctgctcgccggttgtgatattctgtcatggtaattagcagtagatggacaggcatcagtgacactgccgagtatccataccggttgtgatatactccctccgtttcataacgtaagtcattctagcattttccacattcatattggtgttaatgaatctagacatatatatctatttagattcattaacattaatatgaatgtgagaaatgctataatgacttaaatcgtgaaacggaggaagtagaaatagaataggcggtgatactaatttcaggtaaaacgaaatgaaatcacagtacaattcgcatgacataataaatccattgttgttaattgacagcgctacgctacgcataccatttactctgagcaaatcatacaccaattgattctaacaagttactatactctactctgcaagcaactggttaggaaatgaaaaaaaaaaggaaaaagaaagcaaggatcgaatctaagcagctgattccaacgagcaacaaggaaaatgggggtagaagtagaagcggggcggtgagaccagaggatggaggcgcaaatcggtgagctcggaggcgacgccacccgccacctctacctcgatgcggccccgaatccacctgctccgggcgcgtgggtctcttggtggccgggaaggagaggcacgggatcgacgatctggtggcggtggcggcggtggcccgacgaggaggaagaggcgacacggggcggggagaggagcagcccgctgtgcctctgcggctccgcttgatctccggcgaagctcctctaccgccgccggcggctggtggagaaaggtggacctcctcgccccgacgacctcctccccattgccggccggccgctgctgccgagccgctggagcctcgccgtccttctgaggaagagacacctctcttctctgtgttggcgcagggaaggaggtagaagagacacctgacaagcgggtcccatctgaggaaggatgagaagaggggaaaaagagttgacgtggcatactgacacgtgggccccatgtgggttccacgctgactcaactgccacgtaggttaaaaccggagtcaaaaccattaaagaacctattgtgaccggttttgattagttaagggacgccgggtatctggttttgtagtttagggacgattttgtaactcgaggacaagttgagggaccttcgatgtactttttcctaacagagatgtgctttagcggctaagcctaagctaattacggcccacgaccacgagcccggctgaggcccagggcccagagcccagggcccatcctctgcgccgctgccacctcctcatttcacctcgcttatcgcctcccaaatccactcgtccgtctccctccac

SEQ ID NO: 19835 - DNA, 794 bp, Oryza sativa
agccgttaattgccgtaactgctgacaaattgcgatgatgaaactaaaattcactaccactgttcagtttatcctgataaattcagaattaattgattcgatttgtcatgcatttagatctgataatctgagatggcttgttttcacaatctggattcaatactactagtagtactactgtttcatatttgtctatctgatgccctagtggtgtgatagtagtttttttctcaattaataaggaacctagtggtggctgttgtatcgagtcaaattatctactacttatactatgaatcctatgtacggagtactactttttatcaggagcatactgtgtccttgcacatgtagtgtcgattagttggtctgtcagaacatcatgaagtactgagtaggttagtggattactgcggagtgaaaaggagtacgttagtggcttatttctgaatggagaagaggaactggaaatccagctgacagaacaattgtttctatataggagtagttatgaatgtgtgtgaagtccttcaaaataaaacatctcccctgttaacagtgttttcaggtttgtaagagtatataatgtttaactttaggctagtcatttctgtagttttacatactagaaagaaaactgctaacaggggaaaagggtagaatatctgaacagtctcataataattatggagatctctttctttatgactgggagaatgtacaagttcaattacagttcatttttatgttaatctttcctaatgtttaaaatcgcttgcctttattttttcagc

SEQ ID NO: 19836 - DNA, 355 bp, Oryza sativa
aagagaagctaaagctatagcggcacaagcaagtgaagatagtagaagggaaagcgaaaaaggatgtcaccaaatttcttgcaagatgagttattccccgaagttcaaattcttgaggggattctagtctccgttgaggagctcacaaagagcctggactttgattactctttcctcaagaggttgcacaaagcattcatcctttcactattggaatctcttccctttcggaggtgagacccaaccttcacaaacttcttccgaccaaccacacttatatcggtggctcaagacctagtagtctaggagtcctcaatctccaagagtaaaagattaagcaagaatgtcttaggga

SEQ ID NO: 19837 - DNA, 1501 bp, Oryza sativa
ttgaacataacactaactgggagaaatgtctatcttttgctgaattctcctacaacaatagctttcaatcaagtatccaaatgtcaccatttgaagctctttatgggagaaaatgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggtactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatacttcgagtacaatggagcaatcatactgcggatgaagccacatgggaacgagaggaccgacttaaggccgaattccctagtttcttctagaatgacgaatctcggggtcgagattcttttgtaaggggggtaggctgtcacataccatgactttgggtgtttggaaaacatggaaatggtggaagaagtaaaataaataaaacttttgtttaaaacttatatgcttgcttgtttgtgcattttgtggtgtatgcatatgctttataggatcatgttcatatttaactaaaaccaatggatcaaagaaaaattcttggaacaactcaaaaatctgggaagaatttgtggtaacttcttgctgaccttagaaactaaatgcggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctggaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcg

SEQ ID NO: 19838 - DNA, 1501 bp, Oryza sativa
tatctgtttgtctagttgggttggcgaataggaaatccatgtttgacacggttgtacatagcatccctattcagtctaggagcatattgattaatttgacctgtttgatactttgatcagattgttttattccttttttccctttttgttgtgccatgtttggacattggatgcagtcttgttcgtgtctgcctggcctatgtggaatgctaacaaagaggtttataattgagtaatcattttttgtaatttttcttttcatcaacggctgtagaaacccgcgaagcattttgcctacgaatattagatatacacttatctagatttatagccaactatagtatagactgcaaaacacaatatgtatgacaggtgatattatatattaatagtatagtatatgttgataaataactattatataatattaactattaaattaactacagatgatttgaagctagtagttgactgtactattaaacttttcttaagggaatgtgaaatttaaagcgagtcaaccagcgaaacatactgcaatttcaagatttgtttatcccggagagtggcacaactgagagagagtagtatcttagccgaggccgtttgcttcgcgtggtcatcttcctcccgtgcacacgcggggacgtaggctgttacgcggcgtcgcctccgagtcgagtcccaacctgtttccgtgccttttccctcttcctcacctgcctgacctggcctggcctggcccccaatcaaaaacgagcgacctcaaccgacggaatccccaaccccaacccccaaaaccaatccgccgccgcgctgcctcgcctcgctcgtcgctcccaccaccaccacaaacccgcgcctcctccgccgccgcacgcccgcccgccgacgaatcaggtgagcgcgccgccctcctccccctcccgctatagatccgtagcgcccgatctacccgccgccgccgcccgggctgtcccgccgatacctaactccgcgattcgatgcgcgcgccgatccttcgccctaggttttgaccgccgcggcggcgcgggctctgctcggatcgccggtggtccggccggaacatggttcgatgaacactgttgcaggctttagccgattgtacttccctcatgaactgcgactttgcgtttgttagtagaaggcgatgtgtgggtgtgttttttttgttgacagtctagctgatttaatatctttgctatttagcccaccatcttgggagattacgatcggattgtgctattaaatttctcggctgcttgttgcaaatgttaattgcatcagtaaactttgtgatagtgtgggcatattacagttggggggcattagttgtatcaggggtgtgagttagctcctagttgcttcttcggtttagcgttgattttgatttgtttcgctcatccgattgcctgtaaatgatggtatcttctatgctttcgtcctgcagagtttggatttaatattacaggcgcagcca

SEQ ID NO: 19839 - DNA, 1501 bp, Oryza sativa
atgattttatatgaatttggaggcttgaacggcctcattccgacttcatatgatttagttatgaatttcacgagattaattccaagaaaactcctgaaaatacttgaacactataagtatttaaaaaaattataagcagaccatttaatgattaacttattgtttaaataattgctaaaatgttctttgtattattaaaattagtaattgagctctgaaaaatccgagaaaatttcagagagtataattaaccatagagaatttaataaaaaattaaatcgagccatgctttatatttaggaaattttatttcccacatttaacttcacttgtaaattaatgaacatttaatataaattataatgataatttattaaataatttataaatcctgaaacgaaaaatcaggctatgacattcgcctaggcacgagggaggctgcccgctgcctgttgaggagtgggagcgaaacctgaggtgtggtgtacttggtcagggggagttatatgaagggtcttgtcacaatcactcgacatggtgacgtgtcaggcctgatgcggtgacatgccggtggattgtgtcttatgggtacagttgtgcacctttggctagagtaaaactattcgaatagccgtgcctgcgattatgggcgatcgatcaaaatcaccgtgattagtctcacccctaataaatcgactcaatgcaatgcactggatagttcaggtgggatggttgagcctgttcaacatggtgtagcgttgattagtggagatttaatattaccttaattactcaacagttttactgttttgctcaataaaatgctttacagctgcctttatgcaaatagccacaagtcgtccttgtatccccttgtacatttgcatcattggtatggcttgctgagtacagtggttgtactcagccttgctattattttccctttttcagaagtgtagtgcttctgagctgaaaacgaagttagaggactaaagctcagacctcagttgagttttgctcgtggagacgaagttagaggaccaaggctcagaccccagttaagttttgcttgtggagtggagctaaagccccactaggatcgcctttttccgctgctactgctttcgtttcggtgtgaggactaattatttcttctgtaagtatttacgttttatttacatttggatctgtatattaatttattgttttgtgtaccctggctgatttctggacagggatttaatatacaaaatagtctggaaatttgggctaaatttctgggcgtaacatttaccttccctcataatttagcacgtatataagtggtaaatttttcatttattttgagatggaggaaatatttaactgaaaaaaaaagatagtaaatcagtaagattgcaatactaatccaggatacgagttcgcacgttgcacaaaagtgccaaaaaatgatgctgagcatactcgaaataaaggtcaaatgaacatctccatcgcaaag

SEQ ID NO: 19840 - DNA, 1501 bp, Oryza sativa
ttcaagcatccttggtacttcttttccagaatctgatgccctaataaacaagatttcaatctctttcatgcatgaatgcaaatccttcgcaccatttctaacgtcatgaaaaggttcttttgatttcccattcataggaagagcagcaatggaagatctcacttcttttacagggcttgccacagggctttcatcatcactttcaaacatgctaatgtctagcacctccttgtcattgtttggcctgtcaatttgagaatcactattctcctgttttcgagaaaatgaatcactattctcctgttttcgagaaaaagaatcactattctcctgttttcgagaaaaagaatcactattctcctgttttcgagaaaaagaaacgctattctctgaagctaacttttctgaagccacatgttcaggtgtctgattcatcacagtattttcaacaggcatatcattgcggttctggaacaccctcactaaaggttcagatgatggattatcgaaatcatcttctgactctgcaaaatcatcctcccttccattgataggagatttttctgcatctttgagatctgaagttttctcatcacggaagcgcctaacattgtcaggatgcacaggagtcttctccccttcctcttcgagctctggaattccctccttttcccgaagacgcctgatatcatcagcgttttcaaagtcatgaccaggctccttctcgtcatgaaatgaaaattggttctcaacagggttaaaaaggccaaagtagtcccacggtggtgtccctggaggtgcttcaaatgtggaactatcatccaggtcatgtacagctttaggaacaagggatgatgtttgtagagttgctgttacaggaacaggcaccttctcctcaatggtcatgacagggttccccccagatttcatatgattgatacggaaccgtccggaagataaaggggatggaactggggagaaagagtcactggcctgatgtgaaatagatggagataagttcctcgatttctgccgaatagtaggaggttctggtgttgcagatgtcgatgtgtacagcgaagaatctgttggcacttcaggctccaaaaattttctcagagcaaatcctgtgtgtctcagtgattgaatataagcgaagtgagcagctgcgaatgcacatcttccatcaagtgcttctctaacatatcgttttctttcgtggcataagacaatggccttgtcatcttcattctttgatcgtgtagaccccattttaaggtgtattgcactgctgaaattcacaagaaacaaaaagttacgggcatgcactgcagataaaagatagtatttggggaagctattttggtatgaaataatggtcaactgtgtaactttgtgtctgtattttatataaagggagtttgctattagatggtatcaaagagttgattaagctggcaagaaagataagctaatgtttcatcagcagctctgtatgtta

SEQ ID NO: 19841 - DNA, 1501 bp, Oryza sativa
gtttttcttgcaagccttggtgctctatagcggctgtcagggtgttagaagcggcggctaagctcggcttgcacatgcatgtgagttttgaggctcgatctaatcgtgcatgcgtatggtaaggactctagggactactaggaggctcaccaagaagcaaacgcagctcagcgaagtcttggcgacggtgtactggttcggcgacggcgcggctgctacggtcgtcgtcgacggcgtatccccaggcttctactgcaaagagaggaagcatgcctctgtttagatcagcacaaggtagctctaggcggaaaatattgcgccgaagctcaccagagaaggagaaagaaaggaatggcgtcggcggctgggattggagaagaagaagaggatctcccactgtggtccacctcgcgtcgattccttcgggattcttgatctacaggtgttgatgaagctcgtgacgaagtggctcagcctgtaacgaactatggaagccgggcgacgagcaaaggcgaagcagcggcgtccagagcgcgacggtgttccgatttgacgcggtcacgttcccggagattggctgcaccaaatgaggtgttcttggtggtgttagagacggcattgagaggggattacagaacgcatattgaacggaaatgggctcaccggattgcgacggagtcgaggacttatctcgccggcgccggagatggcgcctccgttcccggcgaatccgaggcggggtacctcggttcttccgcgaaacgagacaagggcgagagggagagaaagttggtcggccggtcgggttaagtatggtcgccggcggagatggacaggaggagctcgccctctcccgtgctcgacgcgtgctcacacgcgtggcatgcgagttcaggcagtgggcccgtgtggagaggaatgtgaggctgacaatggggtcccgccatgcagccctggcccacatggcagcgactagtgagagagaaggagaggagatctaggttttggccaagtctggaacagaggtggaattccatctttgggttcagtttaaaattagttccaggcagagttagagctagtgaccaaaggcaaagttgtaaagcaatgattgaactacagtttggatcgagttttacagcctaggagttcaagatccaattttggcagagtgtcaaagagtgctccagagaatctgtcaaaatcctgtgcttaagtgtttagagagttgtttggttgatctaatgagttgataagctaaattaaaatccacatttagtttctaaggtcagcaagaagttaccacaaattcttcccagatttttgagttgttccaagaatttttctttgatccattggttttagttaaatatgaacatgatcctataaagcatatgcatacaccacaaaatgcacaaacaagcaagcatataagttttaaacaaaagttttatttattttacttcttccaccatttccatattttccaaacacccaaagt

SEQ ID NO: 19842 - DNA, 1501 bp, Oryza sativa
tcggcgtcaatgatattagtgcactcccctagcctcccaacggaagctggtcactgatgtgaaggggtttggcgccaatgttattggggtcgaggatctatttgtaaaaaaatttcaaagaacttgtttgtaataaaaaaaatatttacaataggttcccagtgagaatgtcattggtactatccccatcgtatcagtgacttaacttccatggataagctaagggaaggcgccaatgtcatttgcgacgtcatgttgaaccacgacaccaataacattgaaaagaatatgttcttgaaataagtttttctatgaaataacttttaaaaaagatctaaaatttaaaaaatccaggttgaacgttcgtgatgacatggcttaaccaaatatcatcttaacagcgttgacttgacaagttgacaaccaatgatatgtggacaaatatgatcaatgttcgggttagtgtatccattttgagagattgctcaaaaaccacaacaaaataaattaatccacccacaaactggtccgaagatactttctatttgtcgattgaatgatagttactcccttagttattttggatttattttaaatctttgatcaaatttatagaaaactataataacatttttaataacatatataacaatggatttaatgaaattgatttagtgttataagtattgctatgttattaaacttggttaaacttaagacaaactgtggagcagggagtgattaattaagctactctatctgtttcaggttataaaatgctttgactttagattaactttgtagaaaaaaagtagtaacatttttaacccaagacaaatttttattacgaaaatatatttaattattgatttgataaaaactaatttagtattataaatattactatatttgtctataaacttgatcaaacttaaaacaatttaactttaaccaaaataaaaatgtcttataacctgaaatagagaacagtcaacaaataatgatgagaaactacttataactgctggtgtactaaaaatagcttttttttttaactttctcttctctgaccaataacgcaaacctattaatttcctcgtgttagttaatgaatcatcacgcgcgcagcttccctaacaatcaaagttcccgcgtcttttcctcccatcctctagctcatgccgaccgaaccagctaggacggacaagctccacaaatatatagctcacgctctctcgtcccctccatgcacggcctagctacccaccccccaccctacctctcctccgccacccgtcgccggccggcatctcgctcggagccagcgcgccgcggcggccggagcccggagggacaacgcaacgatctctctctagctagagctagagctatagcttagctcagctaattataatacatagctaggaagaattaacaattaatggggaagcgcagtgcgccccggtaccccgacgacggcggcggcggcggcggcgggatt

SEQ ID NO: 19843 - DNA, 1501 bp, Oryza sativa
ctatcatccaatcttccatttctgtttgccacattctccaatcttcagtatttttagaaagagatctcatgtgtatctgtgaagcatttctttttcttattttgtgtactacataagtatataaagtgttactgaaagtgttttacaagataaattacctgcatgttgcctattagttgtgcaaacaaaccaatgctgagaagggttaaccctattgcaaataggttttcaccaatgaaggaactagtcaccaaaggattgccatacgtgctgtcaccaaaaatatatacaaaataacatttcagtaatctcaaaccatgataagtctgctacaaatattgcaagcagcatgaaagaatttgtaagaacaggtcattatgaggttgatgctagataataattgctttctgggtgtaatgcctttttggagcttgaaaaattgaaaatgcattcagtaagtatcgaaatacgaacgtcaactgttgaagtccccaccacagggagtagaaatatttctcagagaatgaagctgtggtcactccattttgtattgcttgaatgaatatgccatagttgatactgacactattgctgttggcgttacaatgtgtgaacacatttgtgctatttgcccaactttgactgttacttgatgtggcatatttgcagtcaaggaagtgtaaatcacacagtcctttgtgtgccattctgtcctcaatagagcactgtgtttcccagcatgtcttttgtcgatccactgcagttagatagaatattgctccaaccacctggtggaaacatggcacaagtaatggtttaatgagataagttgcaactttttttctataggatgatttatgtttggcatattttccaatcgtttatttgatgaagtgtcttgacttaaaaatgcctagtgaaatattgacgacattaattctagccaggttgtatggggctaaaatttatgttttgaaatgggccatgatcctaaccaaattgtcattttatctgtttgcagcaatatctgctgcaaatatgctcaacgttatttatgtacttataaaatcattatatgacagttgtttttgtaatccaggcgaaataactaacacttacgtgacttgccaccaaataaagaactagactgtagatagctccttcccacccattttttgcgatgaaacccaccatctccatgatactaaggctgagaagaattacgatgtataatctgatggcagattggaccaatattataagaaagaaaggggcattgatatgcttgaagctgatagatggcatggctatccaaacaagaacctgcacatagaaagaaataatttaccagcacaaaaaatatcacacctttttctgattactgctgtactatttccaactttcaaatgaaagagacatacttgtggaactggcaatgcagctactaggtcaatgaagaagtttgttctgatgtatctatttgcaatctttttaggatctg

SEQ ID NO: 19844 - DNA, 1501 bp, Oryza sativa
tttgaaatgggccatgatcctaaccaaattgtcattttatctgtttgcagcaatatctgctgcaaatatgctcaacgttatttatgtacttataaaatcattatatgacagttgtttttgtaatccaggcgaaataactaacacttacgtgacttgccaccaaataaagaactagactgtagatagctccttcccacccattttttgcgatgaaacccaccatctccatgatactaaggctgagaagaattacgatgtataatctgatggcagattggaccaatattataagaaagaaaggggcattgatatgcttgaagctgatagatggcatggctatccaaacaagaacctgcacatagaaagaaataatttaccagcacaaaaaatatcacacctttttctgattactgctgtactatttccaactttcaaatgaaagagacatacttgtggaactggcaatgcagctactaggtcaatgaagaagtttgttctgatgtatctatttgcaatctttttaggatctgtgacaagctcacccctgccaagcactttggagcttggatcaacatgtgcagtggagaaacttatagcaatatgagctatgaagaatatgtcaagaaaagaccgtagacaagtgagtataatggcgagatgatggtccattgtcatacacaactggcggtctctgcgctcaacaattggcaggaagaagaagagaggatcaatgaagtgagaagcaacgcatgagacgaggaagacacggttccacatcagcacaacattgcctccagggtctagcatactctcttcgcggcttatccagattctggtaaaatcctttaacttgagcactatcttgctgctcattgttttaactgaacctgtggccaagttattctgtctgtgtcttgcttcgttctcaataagattaagcctgcagagtaaaaaaaatcaatgaaaaattatacgacctaagtacaaagaactttacttttttgtttcctggagatgtttatagttacagcaatgttggtcaacatatgattctgcaatcattgtacttaaagactggaggtagttgccagtgacttgacaattggcagtaaattaataatagtcattgagtaactcatgtgttgctacatttgtaatgacctaattgtttataatcaatcttgtcagtactaaaaggtgagtatcaacattttctagtaatccctgattaatgcatttttttttataattaaacggtctcgtgaaatgcattcattccaaacttgtatcagtatattgtcggtctgtggggttactgttttattttccccgctgtgaaaccttaactgtgattataccgtactaatgtactagcccaatgttgtttctctataattcaatgcaaaaacgattcctcataggtcaatctgtctcttttaggctcttctttcttacgctatatccaactgagtcccctcttaactcttgacagtactttgcc

SEQ ID NO: 19845 - DNA, 1501 bp, Oryza sativa
accaatatgtactcttttggtgggggtacaggctattggtacctttctttggttgtagcaccaacaccaagatgatgtataaagttttacatgtataaatgtaactgggtatataccaaatactttttttcttttgaacccaaattctttatcattgccacttcacccatacatcaattcgcctctatcctccgattgacgaggtttctctaacatacatcagagggacatgtgtctctaacgtgtagttttcttatgtcagtgatccatatccctttgactttatgtcacaagaaagacttctattttttatttataccttttgttgctagcgcatcgtagaacccaccaagaaataaaagaaaccttcacgtgcgagacaagagataaaatgctctttttgggcaataatgcctattgcaacaacccatccatttattcaattttgtagccatgtgtggaagtggaaattgttcgctaatttgtatactttcacgtggtagtattgttttagtgaattgatatgtattaatacttcacgccattaatatatcaattaaaaaaatagataaattgtacacttctcatttatgggagcgtatcctatgcacacaagccctcgcgtgtacacatcgtgtacaccaactaaaaattatcacaaaaaattctaggaaaattcatacatgtactttcaatagtattacatctacgtgtaaagtcgtatcttcaaattcattctacatagagaataacaaaaaagataaaattctgacaaaattgcaactttaaaactgtcagattttttgtttttttgttacggctaaaatataatgaatttgatgttaagattttaaccctaggtgtaatacaattaaaagtatgtgtatgattttttctagattttttggtgacattttttagttggtgtgcacgtgtgtacacgtgagggcctatgtgcatagtatatgttgccctcatttataaagataactgtgccgccgcgtcaaagatacacaaagctgcatccttcctgtttgatagtgtgacggggaaactcactaagcactcggtgcaatgcaatagacatgaaaaaaaaaactgaccacatatattaattgtaaaggcattttatttgtaaggcaaacaaagccacgatacaattaaaaatattttagaggcatatgtaccatatcaacataatcaaatatcatagttattcaatgttgcataatcggaattgctaaaaactgtcgcaagcttttttcaaaaaactttctaatataactcaatgtaaccataatgtaattacactatacttacactgagttacatcgaactcagtgtaagtatagtgtaattacattgtaatatctatataacttagtacaaactacaaagttacatatattttttaatacttatacttttatatatatatatatatatattgtagttatgtaaaactatattataactatactgtagtcagatttgaaagatc

SEQ ID NO: 19846 - DNA, 1501 bp, Oryza sativa
gtgtttcgtttcctctcgaggcaaactactactctttttagtttgcagttctcaaaaaaaaaaaaagggtttcctgatactgaatctacgccgcatgatatacatcccttttttgttctagcaaattttccaaaatcaagctaccacagacaaatatatatatcggatgttttctccacgcaacgcatacgaacacaataactctggattgaatctactatggtctcacaggtagaacgtaaaaagattttctgaaactagcaaccacaccacgccacagcctcatgttttggataatgctgatggaccatcgtcgagcaaaccttgcttggatggtcccatttccggtaaaaagaaagatcacaattgctaccagcagattacagaaggcaaatcgataagccatgaagttccaagcatgcaagcttgtatgtatttgcagggttgcagctggtaaaaccggatggtaagactcccaagagttagaaatgagcagaactctgcactccgtgccaatcctctccaaaggcagcaaagttctgggaccaaccatattcaaaagtgaactctgaatacctcgtgcccttgtggatgatgccaatatgtccctgtcagctgaaaacagaacaccagaaacaagaaggaaaaataaaagccaagggaaatcgatcatagtgggattcgaacccacgacttttagattcggaatctaacgcgatatccacttcgctatatgatcgttgttggcttgcatacacaattaaattttgatacataaaagccatctgcatccatgtcctagctttcaagaggcagaggaaacaactaacaaggccaatgcaaataagttctagctagcattagtaacatccaagaactgaagcaaaatgtaataactatggataaagggtatgcattgaactgtttctatagggaggaaacaaaaggaaatgcatactcttcaacttacagacgttttaaaattacagactagataaacattattttgccagggtggccgaaggaagggccatccaattttattaagatttgggagatagttacatagttatatatatacaggtaacaaacatcaacagtagactgtcgaaactgaaagaaaaataactgtcaaacaacataaataaacattaaacagcacaggatgacaaggatgcacaactgtgcaacatgttaaactgtaggtgaatttctctcaattcctaaaagatactccctccgtcccaaaaaaagtgaatctaggactggatgtgacatattctagtataacaaatctggacagatgtatgtccagattcgttgtaataggatgtgtcacatccagtactaggttggttttttatggaacggagggagtaagtctcaccagcactatacacaaacaaatatttctgtatccagtaaaggtatgttgatggtacatgacaaacaagtagtaagtgaaatcggcaaggtaaccaaactcaataactgaaataag

SEQ ID NO: 19847 - DNA, 1501 bp, Oryza sativa
ccgctcgctatcgcgcgttccttgggtggtggtggtggagtactggagtggaccagggaagggaagcgggtggtgggagtcgcgcgggaccgtccggggtccgggaaatcaacagcccgtcctatcgcgtctctcgggacggaaagtgggtgccgaatttgtaggtttcgtagcccccagtggacgagtggtggtgggtctcgttctttccttttgggtgcaaaagcggtgtccttctttgttgtgcgtgattgttttatatccgtctaccctatgcatctacttagatgctagatgcgggtaagagcaagaatagtatagctcaatttctactattatcttattttaaagccaacatatatagtagattagttataatgttaactataattttcttctactttctctatcttacacttatatgcattaatgtatttatttttgaaattgtgttaagctagctcttgcataagagccaacactcttaatattttgttacatctcttctccacgtaagtttatagtaggcttatactcactattatacttgctctaaacgtgtgtgtataagacacatgtaggaaccacggtctacttgctgtgcttgcgtaattgagtatgagcgtatctgtgaaaggagatatcaggacgggaatctttcgaaagcctgttgaccaccacgatgagctcgcctcccgccaatgttcgaccgagcaattcgcgtgggcgagcgtgagacggcgggtgagtggtgacatgggtcccctctacctgcggcaaccaagccgatcaccgattcaccgttcaatccgagctgcgtacgctctgttcttggtgcgcgtcggttgccgcggggggaaatcaccgcacggcaccgcacagcacaggcggtcgatcggcggctgactcgtcatatcgcagccaaaccgacgggcgggggaacccgacgtgactgcctacgcccccccaaatcttgtcggctcactcgttcagttttcgcgtttacggtttaccactcggtgtcgcgtgctccaaaccgcgaacggcagcgtccagggggtgctcccctccgcgctcgcgcttcgctcgattcgtcaactggccgcgggcgccataccgtgtccatccttcgctcgtggactctgttcaatggcacaagcggcatgtcggccattccccccgggatgcgcgtacatggcgatgaatccgaagcagttgacagatgcgtggtactacaatcctgcattctgggcctgctcggagagcattcgagaatggacggaattacgaaatgtcaaagctacacgatcgtttgcgtgatgctgcagaatctgactagctttgaattactacaaaagcttatctaaaagaattattacttgctctgaaatagtacacaaaaaacatcatcatagttaaacggttaaacaaccgaaaagccctttacccaaaacggtgcttcccattttatccgcctgctctgctgctccacattttctcc

SEQ ID NO: 19848 - DNA, 1501 bp, Oryza sativa
caatcacgatttatttcctagtacctgatgaaagaaagatttaaaatctgatggatggtagcatggagccatacatcctactgctttacgtattgatagtttgtttaggataagaaattaaagagggtagcgttgtgctctcttttgaaacccgaataatcaccctagtatcatgatctgatgaaccctggtctccaaacattggattgatcaaacaagtgtataagcttggtccatcctcttttcaagttgatggtgagggtcagctttaagagcatgtacaatagcaggctataagccagctgcaaacatattttaagaagataaataaggagagagaagagcagtgggctacagatttgtagccaactgtagtacgaacttcaagatgcagtgtgtgtatgacatgtgggaccagttattaatagtgtagtatgtaactattgtatgaatgagctattagattggctatagatgaattggagctagtagttggctatactattaaacttgctctatgagcaagtataatagtaggctataagccaactataagcttatgtggaggaaagagaatttgaaaaatggagagggttggctttcatgcaagagctagcttttcacatacttcaagataaatacattaaatgcacaggtgagagatagagagaggaggagaaaaaaagagataatcttatagctcatttactatacatgttaactctaatataagctataagctcatagttggctctattattaaacttgctctaagagcaggtacaatagcaggctattagccagctataaatatattttaatgatataaacgatgagagagaagagcagcgggttacagatctgtagctagctgcagcacggactccaagacacactgtgtgtatgacaggtgggaccatatattaatagtatagtaaacaattattgtatgaattggctattagattgactatagatgaattgaagctagtagggagctgtacaactagacttgctagtgtctaaggtagtgcgtgggaagaggtgaaaggttaagcatggcgtgacttgctagtgtctaaggcagcactctttttcctgtagcaaagtgtaccactagtagcttacactttacattggtatcaggcagccgcaagtcactagtgtccatgaaatgggataagcacagtgagtagtgccattagcaaacggattgtcgagggcttgagccttgaggcagccgttagctatccactgtgcaccactagattatcatgaggagatgatgcggagctcgatctttgaaaataaaaaagcggattcgaaatgctgctgggtctagcaaaaacatatttgctggtttcagacgtcgaatctgatgggcttttgatgtttgatgaataacgaaaggcccatgatagagatgccatcacatgttcgtacgaaaaagtacatcaaaggtccctcatcttgtcaccgaattataatatcatcccttaac

SEQ ID NO: 19849 - DNA, 1501 bp, Oryza sativa
ttcgataaattctatgcaaaattcaatgacctcctctgttccaccccttggcgatgcttgcctctggacgagcacggttatgaacatacttcttcagaacgcccatgtacctctcgaaaggaaacatgttgtgtaggtacacagggccgagaataccgatctctttaacaaggtgacaaagcagatgtgtcattataaaaatgaaggtggaaatatcaactcaaagctgacaagacattgtaccacatcattctgaagggcttctaatctatccggattgatgaccttctgcgaaattgcgttcatgaaagcatatagctttcttattgttgcccagacattgtctgggaggataccccttattataactggtagcagctgtgtcatcaacatgtgacagtcatgagactttaggtttgtgaacttcttctccttcgtgcttattattcgctttatattcgtggagtattctgacggtatcttgatgctctccaagcattcaaacatactttccttctctgccttgctaagagtgtagctggctggaagtaatggcttcctttctcctttggttccgggtgaaggtcgccgcattgttccatatgcttcagatcattacgtgcttccagtgtatctttcgactttccatatacacctaggaagccaagaaggtttaggcaaaagttcttagtgaggtgcatcacgtcgattgcgtggcggacgtccaagaattcccaatagggtgtcacataccatgactttgggtgtttggaaaatatggaaatggtggaagaagtaaaataaataaaacttttgtttaaaacttatatgcttgcttgtttgtgcattttgtggtgtatgcatatgctttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctggaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcg

SEQ ID NO: 19850 - DNA, 1501 bp, Oryza sativa
attagaatctttatgatttttattaatctgttagcgggaaaattaaaagaaggaaggaaagagggagggatgtttgtaccgtgaggagaggaggcccaggaggaaggaggcggtggagatgggttttgatttttttttctaaagatagatctaatggtgtataatatcgggtcaaccttattaagtgaaaatcgagggttagttgttttgttttttctcataatttctttgatttctaatttattagagcgtcatgtgacaagttataagtgtttgtagtaaatttaatggactttagctaaataataggaagggcaagaggagaggagagccctaaacttttcggagagggaaggtctatcgatttaaataaaaccgatggtcatatgtattttttctcaaaaataggtttttttaaaaaaaataatttattagatgtgaaatgtgaagacatagaggtgttgtaatggacatctaataaataaatgatgatacgatatatgttatcaatttttatataacgttgcattgatgtttagttgtcacggaaaggatatggatttatgtctgaaaatatatttatcatatatcaagaaaagcctacatggatcaaactaaaaactgaatatatttaaaaatataatcatttagctatctattgtttatatataatcatttagactatgtgaagatcggccaccgtaacagaggaactcatatcccgtaaggccgtaactatatctcaaacggcttatctttttttacccattagatatgatattattgcagatgatccatcggatgtctatgtctatatcgaaaacatagaaaatagagtgaatataggacttagctcattgattaatttaattaaaacatacaatcattgaagcgtatcataaaatcaatgtataaatcgtccataaaaaaaattagtacttgcacgttgcacagccaactcgatgctccatgccatgcaaggaaagatataaccatttacaatattaagttatggtgcatatctcgtagtaataactaacttaattagcaaaaaaaaaagaaagagaaaatgaggggaggataggcgtacgtacatacgtaagagggattttattttgatatgatgttttaaatgattgggtccactattttaaatgaaaatcgactgttagatattttcgtttttctcataatttctataatttattagagcgtcacatagcggctctatagcttttgtaggagtgccacatagcggattaggaatgtttgtaggaagtttaatagtgtcgacgtttgatatcgcggctatggtattttgatggtatggagatcgttggtatcagggtatatgcgagattgaggtaaaagagatggagacagagatttttatacaggttcgggcccctgaattgtcaggtaataaccctactcctgttggccgaagccggtcgttgctcttattcaccataatcacaccagtacaatatttggggtagcc

SEQ ID NO: 19851 - DNA, 908 bp, Oryza sativa
ttagttgtcaaaatttggaaggcaaaatgtggttttttgagccaagtaaaattcttggagttgaactatcctatcagatcacaattgcgtgattaaaatggaagtccttttacttgatattgatcaataggttttaagatgaatctttgatggccggcttagtcacctgttgctttctccattttctatattttatttttaatgtaaagctttatacaatataagatagtttctcgcaagcactcttggttggtgcataagcctaatgtttttgtcatatatggaatggattggtcttatctattatatctttaataacaaattttaagatataagctttttgtgacttctggtatttttgtaatcaccaccgcattgttcaatacaagacagcctactattcattttattgccatatcttgatttattaatccttgtttttgtactaccaagtgcaattggtactgtatgctgttttacccccaggttgcttcgtacattgctgtagtatgtgaaggtgtggaaaatgagcttcttggaaaccaaatttcattaatagacctcacttaggatcagggaagaggagctgtcaagtgcctagattatttttcttacaagatatatactgtagtaatcacataaaactgttgatggtcttaaattccattgtggatgactgattgcctgaagtattcaagtttcataggtacaactaatattcaagttttatctgtgctaatcccactgtcgatatcgttcaaccgccgttgtctgcactctgcactctgcagcactgtgactgccgtcgtttgcaggtctccagcacaagaattactatgctgttaacatgtacagactgtaaaattatgttaatttgagtttcataaaccttttcttttggtatcagg

SEQ ID NO: 19852 - DNA, 1501 bp, Oryza sativa
atcttactataaagaatcatctttgttctcatctttaccgtcctactattaaaagccatgcattatcttttcaagcttacatcttttgccacccttcttcctcaccactttcttgagagcatatatgtttgaagacaaactacacaagaaatttaacgagaatgtcgagcgaggtcgatataatggtggttgtggacaagcttgagggcatagcagtagtgattgtttcagttgagatcgaggatgagacgatcatgaataagctcggatacccagcccttgctgatgagtttcagttgcaagttttgagctcgaggacaatagcaattgtgcatgaggcgagatcaaacaaggtgacaaccacaagtaagcacaaagagtgcaatggccatggaacaagattgacggtatgataatagaaagcgagcttgatgatagtaatgtctaaagtggagagcaagctcaaggagatgacaacatgatagctcgaccactgtagcggacagacaagagagcatcagccgacaatagtcttgagtaagtttaaaggatggtagttcacatgatctcacatgcagctatggttctaagcttgcgcaacaccatggcacaattaatatatgcttaaagaataaaaacatatagataaatattaaatagaattatactgaaacagacaacaattacttagtaaacaaacacatgttttatagtttaaagaacaaaagtaatatgagtaaaacataaaatgacttaaacctagtcgcgcaaatgcgcgggccaacctgctagttatattcaccccgacatcgcccgtgaccacgtgcgcaccgcgtctctggccgccaagttgctcgtccgcctctttgtgtcgtgccgcgtcaccgtccatcagctgattgacgatcgacgagctacacctccactacattgatgctgagttgacggcgcacccgcatcatgcatgggcgaccgtggaggccgccacgagcactgacgtgtccaaccttggcgcgccgcggcgaggcatcagtggcgcgtgcagcctgagggcgtggtgtcgaggcatatacgtacgtatatccggatcggacagacaaggatggcggacatatcttcaccctgattatcgaccatcgccgacttcagcgaccagtacacgcactaacaggatcgacgacaagctatctaacaacgacgacgggtggctcgagtacgtttcgctgcgacaactggcgcgtgtgctgcagccgggccgggcaccagcgcaagccgtagctgaccagtgccctgccaacaagcctgggcgcccgccacatcttcatccgcaccggcgccggcggcatcaaaaaccaccgattacttccacaaggcgcactgttccaggcaagccaaacgtctctcatttccttaatttgcatattatttcttatactctcaagctagaacatgcagcatggctattatttatcacgctaatacactgaaacactaggtcgaa

SEQ ID NO: 19853 - DNA, 1501 bp, Oryza sativa
atggaccatactgctcaatcaccatgtctgcttttggtacccctattttggttcaccatgtccaaaataatagtttcttcaaactcatcttacatatcaatagacttgtagttgcatatgctttatatgcttagggtcaaatccggggaaaacatggaaaattgagaaaaaaaaagttgagaaaaaagaaaggtagctggatttgatgatttttgtgtgaattttaaccagtgccccttctgctgtctgacctagttcaggtttccaaaaaccctgtgagaacgtttacttcagttgatttatttagcttttattcaaggttgtatttattgggttatgtcaccactttcttttcagttggaagatatttattgtgttcatgcctattctgtgtacatagcccacaataaagctgtttttttccagtactcatttctttctctctttttttattttgcttttttttttacagtccctgagctgtgacttacaattattatttttccaactttagatcactcgaatttataaagtataatactattttcatatatccatattctataattttaagcataacacatgatgtaaggtgtcaactatcaaatgaaaagggtaatatgaaaagtaacatggttctaggaaacaactaacttcttgtttgtttttttttacctattacacttatgttctctagataacaatataataaaacagttgaattactaaaactgtatgaaggcaaatccatgtataatgtatatttgtcttcaggaaaaaaaaaggaaacataccaacatacttgatctctagtcaggctggactaagttccaaagcttgcatatttttcacatgtttagtaaacattgtttaccacaagagtagttgcccaattatgcttgccatattttttttcacccttaccatttccttactagggaaagtggattttaaatattctatttatgcagggatataaagtagtacaattatcttgctcaagatcgtattacttaaatatttttttattttctaataaataactcaagaaaaaagagctggtagcagaataatcacaacacttttcattgacgttttgtacagaactttgatttagttgtctccagatcttttttttttggtgcagttagcaatccttcttaggaatctgaagcttcctcagttgtgctttaacttgcatcatgttctgcttactaattactccctccgtccctaaatattcgacgctgttgacttttttaaacatgtttaaccgttcgttttattcaaaaacttatatgaaatatgtaaaactatatgtatacataaaagtatatttaacaatgaatcaaatgataggaaaataattaataattacttaaattttttgaataagacgaacggtcaaatatgtttaaaaaagtcaacgacgtcaaatatttagggacggagggagtataatttttgtcaccttttctaaatctctggcctcccttgcaga

SEQ ID NO: 19854 - DNA, 1501 bp, Oryza sativa
actgctgccaggtgagctccattggtgttacttaagccagcttcaacatgattcgagcatggagagtttgggccttttattttgtgtgtggaaaggagagtgtgggcatgcatgtgtcaagatgggtggataaattggtacaaatggttgagcatatatatattatcaccttgagaagtgttacaccttagttacaaaatttataccctcataacctcacaatatctgcgccttattggaaaatgttacacatttatcattatttatataatacactgttggaatattgtcggttcttctttaaatgttattttacagacaagagaaacaaaattttgatcaaaaagagcatctgcgcccctttcaacattcataaaaagatggcaaatttacgggataggtaatcagagtgcttgggtggtgctcagttctatatatatatatcggtctgtactggctgcattttgatgaaagctttgataaataacatctctgtttgttctaaatcagcatacacatcgtttcatgcgatcgaaacatataattggcactctggtcaatgtagatgcgttgtactggagcacatattcgatgatttgcaaagtccgaattttcaataaattgcaaatattcgataaaaggacgcatgagttgcgtcaattactcaaaaattcacaaggttcaaactggaaacagcagcagtcagcagtgcgctcctaaagaaagcaaattcaaccggggactttctgcgcccaagactcccaacactccccacgcataattcacaccaagacaccggcccatggctcatggcacgcacagttgtcgccgctggatcttactgtgcatctcaccttaccctacatgcgtagtactccccttgacgatctacctatatttacacataaacgcaggacctaggagagggctagaaccaaacggaaccagaacccacagggccactacggcaaaagcacggaggagtagggggtatgtaggacactcctccgggcagcgtacatcatctgggtgttccgatgataggagcagtgtttaggagaaaagcgctctgctgctgcatgcaggctgcagcaggcactagccaagccaagagagaagaagaaaaaggcgacaggggagacagacagggcgcaatcatgccgacccccccaaaacacgactcgattccaacctacacaaacggcacaaccacaaacgtccacgcccagtttccttggactctctcctatgctcctatgcatcctactactcgctttctcgctcacctgcacgcctctctctctttcttggaaaacgtgacacattctctcctctcctctcctactcccagattctctctcatggggggatggagtgagtgagcgagtagttttttctaccagccccataacatcgcaccatcgcataatggaagagagaattgaaacaagttgcagcacgaccacaagacgacaatctgccccaagacaaaaacttgctg

SEQ ID NO: 19855 - DNA, 1501 bp, Oryza sativa
ataattcactcaacttggatagggaggcctctaattaattatatggggcagaatttactaccttgctaacaagggaatttacagggtaacacgtgacacgtcatcgatgaggtaatacagaggtaaaatcatatattatcatgcattgagaagactgaagattgtgacgggagaaagatgcatttcaacctacattggagcccactaaagctgaagcaagcaaaaattcctttattttcttcctttgtcgtcaggagaaaatgatttttttttactaaaataccacaattggttaagtgtgcgtggttttctttgttacgctagattaaactaatcgtagaataaatttaaagaagcataatagatgctcacacaattaagtattgaaggagtgcatattttctgttcaaattaagagtagggttaaagtacaaaagatataacactaaaaaagaagaggaaaaatgcgagtggtaaagccgtttgtggggggtttataacttataaatgatgcaaggtttttctaagatggaattggaaccatcgctatcagacaagcaccagcttcaacaggccaatctccaatctaatccacctttacgacattcaaatgacgaactttcaataacaggacacaaatttaatcatatcataagttgattgtgttattagcgcaaaggcccaccacttctgttctactctaccaaccaccatgataagagagaaatcagagatgcgataggttgctttagtttttcctctttgataaataaacgagcaaacagccttggctagagagtacagagataagctcgtcaagtcaaacatgaatgccgctacatttcaaaccttggtgggacctagcgatatcccaacaaccaaagcaaataattctcttgttgtgtgtatatagttgggcaacgtatcctatgcacacaggccttcacgtgtacacaagtgtacaccaactaaaaaatatcaccaaaaaatctagaaaaaatcatatacatactttcaattgtattacacctagggttaaaatcttaacgttaaattcattatattttagccgtaacaaaaaaacaaaaaatctgacagttttaaggttgtaattttgtcagaattttatcttttttgttattatctatgtagaatgaatttgaagatgtgactttgcacgtacatgtatgaattttcctagaattttttgtgataatttttaattggtttacacgcgagagcctgtgtgcataggatacgctcccatatagttgagtaactatgttaagcatcccacttgccaaatgacatcttaggagtactaatctattggcgctgtagcagtaccacagaaacatgaaaccgtgtgcttatcatggctaaataatgctctaacgctctgtttggaatatatgattgttgaaagcaaaacataggagatttttttaaggtctagtggcaaaaacaggagtttttcagctgttagagatcaaataaaaaa

SEQ ID NO: 19856 - DNA, 531 bp, Oryza sativa
aatcacctcatgattttgtttctaaaatatctcactaaatttacctctgttttgtcttgttctaaatattttaatgttttttgttttttattatccagtaatgtagattcggtttctgtgcaatgtaaacaaaaattgaatgttttttgcttgtgcagttgtgtggatctttggtttacctttctgagcaaagctataaaagcaaataaaaatgatgttctgttaaaatctattttttaacttccacagcttcaatattttgaaatgacaaatgaacgatgaagtgatgctttgtcacctcatgtcaaatagaaaattctgaattaccattagttgatcttgtgatctcttgagcctatgacgtgaaaaaaaaattcactttactgaggagaactacaatctccaccatagctgcttctcgagtctatgaccagagatttcttttgctgtcttcctgatgaatacggccatacaccatagctgcttcctatttatattctttcattaatatgttttcttgtcttattgcag

SEQ ID NO: 19857 - DNA, 1501 bp, Oryza sativa
ttgcctcaagtcggcggcggcgagctgtccgttgtcttccccgtcgccggcggcgggacgctactgcaggccggcttcgtcctaccccttcttgcccgcttggccaccaccgacagtcttcagccccgcggcttcaggaagagccacttcctgcctcaccgcccgcctgatccgccacctcccacggccatccctctaaagccggcgaactcccccctcttccccctccccctcccccacccccaccccaccccaggaccctaattcgttggccctctactggagtttgggttcgccggcgccagagaagaagaggtggccgccggagttagagaagaagagcacgaatcgtaaagcatatccagtgatctaaaatttgcaaaatttgagataagattttctgtcgacagagttttagcaattccaaaaaaaaatcccaaaacattagctgtggatacgtatgtctacgtgatgagagttagtggcagaaagtattgtccaacttatataattatgcagaggactattaaaaactgccgtaaatttttaaagtgatctttcaaatctgactacagtatagttataatatagttttacataactacaatatatatatatatatatataaaagtataagtattaaaaaatatatgtaactttgtagtttgtactaagttatatagatattacaatgtaattacactatacttacactgagttcgatgtaactcagtgtaagtatagtgtaattacattatggttacattgagttatattagaaagttttttgaaaaaagcttgcgacagtttttagcaattccgattatgcaacattgaataactatgatatttgattatgttgatatggtacatatgcctctaaaatatttttaattgtatcgtggctttgtttgccttacaaataaaatgcctttacaattaatatatgtggtcagttttttttttcatgtctattgcattgcaccgagtgcttagtgagtttccccgtcacactatcaaacaggaaggatgcagctttgtgtatctttgacgcggcggcacagttatctttataaatgagggcaacatatactatgcacataggccctcacgtgtacacacgtgcacaccaactaaaaaatgtcaccaaaaaatctagaaaaaatcatacacatacttttaattgtattacacctagggttaaaatcttaacatcaaattcattatattttagccgtaacaaaaaaacaaaaaatctgacagttttaaagttgcaattttgtcagaattttatcttttttgttattctctatgtagaatgaatttgaagatacgactttacacgtagatgtaatactattgaaagtacatgtatgaattttcctagaattttttgtgataatttttagttggtgtacacgatgtgtacacgcgagggcttgtgtgcataggatacgctcccataaatgagaagtgtacaatttatctatttttttaattg

SEQ ID NO: 19858 - DNA, 1501 bp, Oryza sativa
ctggcgttgaacattgatttgcattgatgttttgcgactaattaaccagctatggatggattggtgtacctgtcggcgttgtaagaggatgaccgccggagaacggcaatgtcttgggacgtgtcggccggcgacgagcgcttcgtctcgacgaggctaccgctgaagtactccttgtcctcgacgatcttttggcggtagttcgggatctcggtggtggtcgacgcgagtgtaggtgggcgcggtggccgtggacggtagtgcgcggcggtgcgagccatcaccggcgaggcgagcgtgctcttgacggagacggacccgcacgagatgagctgcatgagcacggacgacgccctggtcctcccgccgccggtgacggccgccatgacgcgtccgtccgccttgatcagcgcctcgagcgtctcggggctcgtcgacgccgtcggcggcgacgtctcctctctgctcagctcctcctgcgccgccgcggccgcggcgcgctgggcgtgtctaccgcggctgctgcggtaaccgtcctcggtctgcgtcgcggcgtccgcggccgccgcggcggggtcctcggccttgtacaccctgtactcacaaagctccgacgtgtttattcccgcgcccttcttttggcgcgcctcgccggtgccgttctcccacccgggcggcgaggacgtggccgtctcctgcgagcccgaggagcaggacgacgcggcggccgcgtcgagcagcgggagctggatcgggtgcagccgctccgtgcccttgagcacgtactctcgcccagccaccgggtagatgtagtcgtcgtccgccaggtcgtgccacacgaacccgttccggtagctcctgcaatattgccacaacattgaggacgatcccatgtccaatgctcgcttgcacctcactggcaagcaagccacaacaagaacaagttcgtgaaaaaaactaaccttttggacgcccacgagtacatgcgcgccatccccttgcctctgagcgcgtcgagccggtcgatcacatctacgcacagcaacgacgacgacgacgtcacggaacggcggcgaatgcagcaacaaaaacaaaagaaaaaccgaaacgcgcgacgacgagacgatcaagctgagcacacgcacgtacctcggaggtagagcccgtcaggtgaggcgacggcaacctccatgaaatgcgggtgctcgaggtgcccgttcctcgagaggtagtacacgacggcggccctcgccggccccggccttggccttggcggccgcgacggcgccatgtcggggcacctcgcctcctgctgcgcctctcgccacggcagccgctgctgctcccctttccccctgctgccagccaccaccactgccatcctcgtcaacctaacctacccttgctggctgctgctgctgcccccagcaataatccctgagctatatgcagcgagctgcaatgcaaggctgcaggcgtcgtcgtcaccgctcagcagcta

SEQ ID NO: 19859 - DNA, 1501 bp, Oryza sativa
caggactgccgagatggagcagccgggtgtattgagacctgagcactatgcttgtgtggttgatctcttctccagggctaagcgatttgatgatgccaagcggtttcttgagaaccttcccttcgagccaggcattggattctggaagtcgttgataggagggtgccagattcactggaatagggagctggctaagagtgtcgcgaagcatattcatgcactggatcctaaggatacttcttcatacatccttctatctaatgtttactctgcagcaggaagctggcaggatgtgtcaatgatcagaagggaaattaaagaaaagggactgaagaggatcactggttgcagttggattgaggtccagaaccaggttcatgtcttcttcaatggagaccgcagacatccaaagagtgatgatatttacatgatgcttgaatcttgtctgaatagcgaggaagatgaggactgccttgtatgattatcagacaccataaaaaagacagctcgaggaatggcattccaatgaaagctttttcggatcttgagataaatataaagttctgggcacatgtacagcaagcttgtctttgcatatcaagtatttgcttaaagattaaactatgagccctaacagcattagcaagaaatactgaaagtctgaaacagacctcataagatttaagcatggtacctggtaacctggagatgaacagaaatgaccacatgcaactctcaactctggatctgttgtggtgctgaccattttctttattttttgcctcacatgattggcttcttgcacaaagggaaaattgatcatatgctacaaatactgtcaaaattgaattgttagcgatagaactttcctgttcaaatttttttttgaatggaaccagcacgtgagtgtgcttttttttttcctgttcaaattgaaattcctttggatgagaaaacatattcaatcataccgagtgcagaattgcagactaggagtctaggaccatcaagctccagcctcaaatggtttaatagtagacactacacaaaggatagattgtgtagtgtgtacaaaatcaccataatactggtgtcttttgatttaattttttcgggcgaaattctctcatttttggaaagaaataaacttgtttaaatcgcaaatcaaacgttagcgctgaaaacatcagtgaaaggaaactgatctggccacatcaacacttgcaaaaccatgacatgagatgagaccaaggatacacttctaaaggcctgtagagtacttaacatgtgttcaaaacattctatattattctgtaatctaaatcccataaattcggtattattcactctgatacatcacaaactttttccactgatacaaattacaaaatcctccgtaggtagcctctgcggtcactcatttgacatttcctgcagcccgttcaaagcacaaaccacaaattcacaggaattcaagcaccaagagaaacacattgaaagt

SEQ ID NO: 19860 - DNA, 1501 bp, Oryza sativa
ttctgacaaaattacaaccttaaaactgtcagattttttgtttttttgttacggctaaaatataatgaatttaacgttaagattttaaccctaggtgtaatacaattgaaagtatgtatatgattttttctagattttttggtgatattttttagttggtgtacacttgtgtacacgtgaaggcctgtgtgcataggatacgttgcccaactatatacacacaacaagagaattatttgctttggttgttgggatatcgctaggtcccaccaaggtttgaaatgtagcggcattcatgtttgacttgacgagcttatctctgtactctctagccaaggctgtttgctcgtttatttatcaaagaggaaaaactaaagcaacctatcgcatctctgatttctctcttatcatggtggttggtagagtagaacagaagtggtgggcctttgcgctaataacacaatcaacttatgatatgattaaatttgtgtcctgttattgaaagttcgtcatttgaatgtcgtaaaggtggattagattggagattggcctgttgaagctggtgcttgtctgatagcgatggttccaattccatcttagaaaaaccttgcatcatttataagttataaaccccccacaaacggctttaccactcgcatttttcctcttcttttttagtgttatatcttttgtactttaaccctactcttaatttgaacagaaaatatgcactccttcaatacttaattgtgtgagcatctattatgcttctttaaatttattctacgattagtttaatctagcgtaacaaagaaaaccacgcacacttaaccaattgtggtattttagtaaaaaaaaatcattttctcctgacgacaaaggaagaaaataaaggaatttttgcttgcttcagctttagtgggctccaatgtaggttgaaatgcatctttctcccgtcacaatcttcagtcttctcaatgcatgataatatatgattttacctctgtattacctcatcgatgacgtgtcacgtgttaccctgtaaattcccttgttagcaaggtagtaaattctgccccatataattaattagaggcctccctatccaagttgagtgaattattgtactttgtgccacaatatgcatcctcattggactatcgttcgtggatagtacatcattagtcgtctgaattataacccctaaaaacgactattaaaacgcactttctagagcgaacaagatttggtggtcccaaatatattctcaaccaaacacacggtgataactgagaaaaataccgtgcgtgagctcatcgccacatgccaagttagcaattttttttgctcataattgagcgcattatatataggccctggcaggaaaatggcggattagatgtctaatcctgtggtgggagtagcttttagggtgggttttttttttaccgcatgtatatttccctcccaaattgataaacgttgttttttgaaaaaacaa

SEQ ID NO: 19861 - DNA, 1501 bp, Oryza sativa
gagcaaaatcaccaaacagtacataaacaatcataaacagcacatgtggatatttttaacatgtagatcccaattttagaaaaattgagagacttgaaccaactaaatctgagctaagatgaattagttattaatttttaaagattaaatcggattaaatcatttatatagattttaattcgattatgacgcaataaagaattatttttgaaaaggaaaaaggatttattgcgtcagcggggctcgggttcacggtggaccgggtgcacagaagcggtctacggaacgaacggctgagatctaatctaaacaaaacgaacggccaagatctaaccgatctaccacgggtctacggctgacgtggtgctgacgtcgatgatgacgtcattgccgacggcggctcggcacctcatgctcgccggcgaacgacggcgcggcggcgcaaacggacaacacctacgggtagagggcgacgcggcgaactcaccgagggctctgacgatgacggacgacaaccgacagcgacggcggcgaggtcgaggcggcgaagacgttcgggtcgacggcgacggcggtgctccggtgacctttggcggaaacggaggacgggacgaggacggctacgacttggcgaacccgatggcgaccttcccgagcgacgatgatgacaagagcggcggtgccgcacgactgcacttgcggcgacgacggcggcgcacgggctgacgcggaagcggcgctacaaacgacggcgggctagggcgaaggtggcggcgaacagaggacgtcctggggatccttttatagtggctaagaggcggcggctaggcccacagcgaccaacagcagcaatggaaggtttagggttggagggaagaaatcaaatccgaatcgaggtcgaatccgacgatttcgaaacgaaattagctaaagtttctataggggaaaagatagaggagatcaaagggatcatttcccctctatcaatttgatcgaatcggaaaagatgcgaccgaatctggaaggggcggcggcttgcgcgcagctagggcgcggctggcggcgggaggtggaagacgaccctaacaggtgggccccacctgtcagcgggagagagaggagggagagaggggcgaactgggccggcttgagccgggcgcgcataggccggtgagagagagagagagacttgggctgactttcggcccaaaaccaaaagaaggatttttaaacctttttccttataaattattcatgaaatgcaattctatttattaaaaatactttcttggctcaaataaatccccgaaaaatctaggaactgtagaatcaagggaagtatttaataaaaatttacccacttttatattggaatttattacttaaaattagatcttttcttctaggcttttaaaatcatttctaacaattccatttaaacaacaatttataaatttgggatttttagtgtgtgacaaacctacccccttaaacagaatct

SEQ ID NO: 19862 - DNA, 1501 bp, Oryza sativa
tgggcctatgcaacgggtatgctctatagcgttggattaatattgtttaattaaatactttactgtttttttaaattcaaaagtatttattgaatgccatttatgcaaatgagactattatgccatcctttgttatccctgcacttgcatatttgctgcatggcttgttgagtatgtcagatactcaccttgcaatcattcattagaggaggagttctacagtgatgctgaaggtgtggaggattaggcgtagccctggtcaagctgcttgtgggatggagtcgcctgtgctctttattttattttccgctgcttagatctttattgtttgagaggaactatctacctctgtaatgactttatattcgcctattaattagagtaataattgcactctattatcaatttgttattgtgtgcctcagctgatttctggacgaggatttacacacatgtaagcgtttggagttttggatagaaattccgggcgtgacaagttggtatcagagcctccttgaccctaggttatgccaaatggttacctatagaagccctctaaaaatattgaaaaagtagaacggttctcctctctttctcttttaattaaaccaagctaatggcacatgcagattatagtctctttaattgttctcattcaaaatttacttattattcctgtgttgttagtactgtacatctattactgtactaatgggccatttaccagcaaaagttttacaatgttacttttatttaatcatgttgcaatataatgaacttagcatgttgattttataactctcttttattttatttcttttgaaacctgttattcaaaagtgcaaaaatttgtgatcctgttttcaactgtttcaacttatcttgcaagattagtttactttatttacctttcactttgattttctaactttattcaatttaattcaaaaacttgtgctattaattggataaatgtcttaactccctcctttctcttgtccttagatgccgcgcttcaagcctgagtacttgttcggtgttgagggatttgtccaggagctgcgtacgatgtcctttaccataggattcgggactgcccctttgtatgcccagattcctcatgatcgtgataaagagaagtgctgtgtcaaggtcaccttgaatagtgatcgtgaagacctcccatcggtgatcttcgaggctggagggggaagctatcctcatgcttgtcaggaggtggcaaggatcgccataggagagctctggaccgttacaatgatctgttggccgacactgagtatcgctaccatcctcatcagccccagggaagggaccgtgccagctatgttgaccctgaaggaattgagaatgatgctagcacaagacatttggtcgagatgctgtgggccatggatgagtcccacgctgaagtcgtgtcagctactcaagctcgtgaagaccggaaccatggtaagatctacaagctggaggacaaggttga

SEQ ID NO: 19863 - DNA, 1501 bp, Oryza sativa
agaccgaatgtcttgtccatcattgccgattaattagtgattaattactctaattaatgattaaataatatttaatcattaattagagtaattaatcactaattaaccattttcaacagtcgctttcgcccggtgagcgagcgagactgcttggtctcgcggtttggccgcgcgagaccgtgtggtctgacgccgccaccacgtacgtcctcgattttgtcattcatagtgtcgcagtttcatcgtgcgagactgtgcggtctcgccctattaccgcgcgacaccgtgtggtctcgcgctgtcgttgtgcgagaccgttcgcgtcgtcacgtccacgtcactttcgcgaaacggttgtgcgagatcgagggtatatttctgctaataaatttacatcccgaatatttgtgagaaaaaaacgaatcaacagtatattttcaaatttaattccgcagccatagagcaacgaagatcgataagggtccctttgaatcacatcaatgaaaaaacagaggaataggaaaaacatagaattctaataagaatgtaagtgtaaaacagaggattacaaaacacagaaaaaatataggaataaccgtttgattagaccacaagaaattgatgagagataaagactcaaaggatttcttccatgaggttctacctcttattaaaatttctccaaaacttatatgggaagaggtattccatacgaatttcatatgattccatagggttcattcctttgattcaaaaagctttgtaggacaaatttccttcgcccctccatgggtcaccccgccgttccacggtctctgatcccctgtcaacaccaattgcttttcgattttggcccactctgatccgtttgattctggtttgtgttgcataatttctctttcttgcatttcagtaataaccgttgtaaatctataatctcgattctggttctattgcaagctatggccagtatttgtttatgagtgtaccaatagattagagctaattcatgtggtgccaatcgtctctacttagaatttttttttaccaggatatggattttggggaagaaataatgtcgattaaccattgcttttctgtttattttaaacaaccttttgctattaataactgcgctgatgcaatgggatttcaagttggattgcttaaacagtatgcttctcatataattaacatgttttacacctcttatacgcttcactagcgtatggacctaaaggtgcttagccaagcaatttatctccaggaaggaaacgaaattcaggatgatagttggtgcatatgacatggagttgttggatatataatttaggaattgttgcaaaaattgctatttactttcgttgttcgtacatctctagcttgtctaactgtatatactcgagatctattgctgaattctgtcaactgcttgttctactttttcagaggtcttgcaatttaaatgctcacagtatttggtaacatggtgccctcacta

SEQ ID NO: 19864 - DNA, 379 bp, Oryza sativa
cgggcgccgtggcgaatcaggaagaatccaacgcacggggacgcccacaacctggttctgataccactgtaacactatgccaccgcgaaactcgccgccgacgagagagagagatttagacgagatcggagttggggacgaagagaaacagagctgaggcagaggagagatagagtttggagagagatagattcgatttcttttgccaggttggccacagccattctctctcttgagtatttatctcctgattacatgggccattggcccaaacgatttaaggcacgcaggccgcattatatttgataaagtctagcccaaaacacacacactatcattcacagttaaacctctttctcagtgtcaccattgccggtca

SEQ ID NO: 19865 - DNA, 1501 bp, Oryza sativa
ctaacaaccaatccatcgtatatgatgttttgcatcctatacattttcttcaatttgaaagttaaatttccttgataacagttggtccttatacatatggtgttatttagagtgactatttccagtgaactaaagaatgaattaaatgcttttaagcagttccaaacttacctcaaatggaactgcaacaactggatagtgatgcagagacagaagttatgcagcatagtgagggcaccatgttaccaaatactgtgagcatttaaattgcaagacctctgaaaaagtagaacaagcagttgacagaattcagcaatagatctcgagtatatacagttagacaagctagagatgtacgaacaacgaaagtaaatagcaatttttgcaacaattcctaaattatatatccaacaactccatgtcatatgcaccaactatcatcctgaatttcgtttccttcctggagataaattgcttggctaagcacctttaggtccatacgctagtgaagcgtataagaggtgtaaaacatgttaattatatgagaagcatactgtttaagcaatccaacttgaaatcccattgcatcagcgcagttattaatagcaaaaggttgtttaaaataaacagaaaagcaatggttaatcgacattatttcttccccaaaatccatatcctggtaaaaaaaaattctaagtagagacgattggcaccacatgaattagctctaatctattggtacactcataaacaaatactggccatagcttgcaatagaaccagaatcgagattatagatttacaacggttattactgaaatgcaagaaagagaaattatgcaacacaaaccagaatcaaacggatcagagtgggccaaaatcgaaaagcaattggtgttgacaggggatcagagaccgtggaacggcggggtgacccatggaggggcgaaggaaatttgtcctacaaagctttttgaatcaaaggaatgaaccctatggaatcatatgaaattcgtatggaatacctcttcccatataagttttggagaaattttaataagaggtagaacctcatggaagaaatcctttgagtctttatctctcatcaatttcttgtggtctaatcaaacggttattcctatattttttctgtgttttgtaatcctctgttttacacttacattcttattagaattctatgtttttcctattcctctgttttttcattgatgtgattcaaagggacccttatcgatcttcgttgctctatggctgcggaattaaatttgaaaatatactgttgattcgtttttttctcacaaatattcgggatgtaaatttattagcagaaatataccctcgatctcgcacaaccgtttcgcgaaagtgacgtggacgtgacgacgcgaacggtctcgcacaacgacagcgcgagaccacacggtgtcgcgcggtaatagggcgagaccgcacagtctcgcacgatgaaactgcgacacta

SEQ ID NO: 19866 - DNA, 1501 bp, Oryza sativa
gacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcga

SEQ ID NO: 19867 - DNA, 1501 bp, Oryza sativa
attcctactacgttttttgtcatcgatgggaagggttcttacagcttgttgcttggaagggattggattcatcataattgttgcattccttcaactatgcatcaatgtttgattcaatggcaaggcgacaagatagagatcgtgccagtcgacaggtcagttaatgttgccagtgctgatttagctctttgggagatggatagccttgattgtttatctggaaaagtctgggatagagattttctaaaagtatccgattctgatatacaaccaattgaagatggagaacccaagctattattttgagggcgtcgtggggggttcagtcgtctaccctaaggatacagtagatgatctcgatgacaagcaaggtcaaggtttcatgtcggccgatgatttggaagaaatagacataggtccaggcgatcggccaaggccgacatttattagtaagaacttatctccggagtttagaaccaagctgatagaactcttaaaagagtttagagattgcttcgcttgggagtattatgagatgcctggactcagccgatcgattgttgaacatcggttacctatcaaaccaggggttaggccacaccagcaacctccgaggagatgtaaagccgatatgcttgaacctgtcaaagctgagattaaacgattgtatgatgctgattttattcgtccttgccgatacgctgaatgggtttctagcatagttccagttatcaagaagaatggcaaggtcagggtgtgcattgatttccgagatctgaataaagctacaccgaaggatgaatatccaatgccagtagccgatcagctggttgatgctgcatcagggaacaaaattttgagttttatggatgggaacgcgggatacaatcaaatctttatggctgaagaagacattcataagacagcttttgagtgtcctggtgcaatcggcttatttgaatgggttgtcatgactttcggcttgaagagtgctggagctacatatcaaagagccatgaattacatatatcatgatctaatcggctagttggttgaagtctacatcgatgatgtggttgttaagtctaaagaaataggggaccatatagccgatttgaggaaggttttcgagagaactagaaaatatgacctaaagatgaatccgacaaaatgtgcttttggtgtatcggctggccagtttttgggatttcttgtgcatgaaagggggattgaggtaactcaaaggagtgttaatgcgattaagaagattcagcctccggagaataagacagaattacaggagatgatcggcaagataaattttgttaggaggtttatttctaatttgtctggaagattagaaccttttataccattgttgagattgaaagctgatcagtaatttacttgggaggcagagcagcaaaaggctttggatgatattaaggagtatcttagctctcctcctgttttgattcctccacagaaaggaataccgttt

SEQ ID NO: 19868 - DNA, 1501 bp, Oryza sativa
cgcgttcgccagcgccgccgccgccgccgaggccggcgacagcggcggcgagagcggagacggcggatcggagaagcctcccgcccgcccgccgccgccgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcgtgtgcgcgcgcgcgggcggcagggggaggcgtagctagcgtggggatcgtgtcgcgttgcggtcaaggggagcgtacgtttcgacgttttcgtgaggacgggaggagtcgcgtgccgcccctgtgccgtgcgccgcgtagatcaccacggcgagtggcgtgatccatccatgcgtgcatgcatcgtcgtcggtactccaatcgatggatcaagggcgtacgtgcccattgtgaagtgaaatgaaaagcaatttttcactcgtgaaaagggccttttccttcgtgtacgcgttttttttgcccagctggccgcatcgatcggaaaaaggagagagtaaagtgtgcgtgcgtgctgttcgacgtgggctctgaaaacaatgggggaagaggaaggaaaggaggctgcggagcggagcgcatgcaatgcacgcagctagcgcgcggccgcacagtgaatgcgtgccaacttgcctttccagaagagaagtagagtagcctagtcgatctagtgtaggaggcgcaagccgtacgaagcatctcctctcctcgtagtcgtcctcgggaatgatgggaattatttgctcgtggcaacagatttttcgttttacgggcgagatctcgtgtgtttagcccctttcggtagaggactagctagcatccatcgcgtcgctctattcatcgcgtacgtacatgtagcctctgcacgtactatgcgctgtactctgcgtccccgtataggctacttttgcaatgtccaagttagatcgatcagattcaatgcatgcacgagtttgggagtgaattgaagcttgcttgactgcttgaggccaaagtagatcgagttgttacatcgcattgcatgctttgactactacgcgatcagatcagagtgccttcaggataaacggatcaagcattttttttgttgggaaatgctcgtatcgtggttttgcgcccaaacttcagtctattgtcacagaaaatgttcgccgcggttctaaagacatcaatgcaggagattcatatcgatctcgcgcattccgttctgtgaaagcttaattcagtatacatcggtgtaaagcaattggttgcaggcttgcagcatgctgcatgcagctgaaatttttcgagttactggttgccgcatgcgtgcccgaacaaggatctctgaaatgataaatcaggtttattttgcaataacaaaagatcaaaccagcaagatacttcct

SEQ ID NO: 19869 - DNA, 1047 bp, Oryza sativa
agagtctaagtaggaatacaatttaaaaatagctgaaattcgaaattaaaaataagaaatattaaaagaagagtccatataagaacccaatacgagattaattaaactcaaaataaaaataaaaataaatccgaaattagaaaaaagaaaataaaagaagagttcaagtaggaatacaatttaaaattagctgaaattcggaattaaaaataagcaatattgaaagaagaatccatataagaacccaatacaagattaattaaaattttgaaaaaaaataaaataatatccaaaattagaaaaactaaaagagagttcaagtagaaatacaattttgaaacaactgaaattgaaaataaaaaaaataaaaacattaaaagaacacaatacgttattaactaatttttttaaaaataaattatgaaatttgaaaaggaaaaataagatttcaattaggaatacaatttataaataattaaaatttgtgctaaaaataaagactattgaaagaaaataccatctaaaacacatgatgagataaaattaagtaacaagcctataaagaagtagagtggtagcggttgatacgatatataaaaattgttaataaaacaccaaatagaatcttaatgacgattaaaaggagggacaacaggcatgccgtgaagcaaacgagcaaggtgattgccgggacttctagaaagtaaaaaaataaaccccatttataatcatatttgatttttaaaatgtcaataataataaaaaggagaagccgccgatggttggcgggacctctagaaaataaaaaaaataaattccatcgatagttatattcgatttttagaatcacaatgacaataaagagtgggcggcatatgggccgtagaggagtaaaccggcatcgtttgacgggacttataaaagttacaaaaaatgaaacccaaaaagaaaataaactctaaaaactacaaggtccaattaaggtccagaacttctaaaaagtaaaaaaaaacctaatgataatcatattcaattttaaaatctcaa

SEQ ID NO: 19870 - DNA, 971 bp, Oryza sativa
ccgtcaccaccgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcagcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctggttgtgaaaaaaatatcaaaaaaataataaaaaaataaaaaaaaagttgtgcctctctcctcagcactagagagagcaagcaaaaaaaaaaaaaaaaagaggatccagcgagcacaccacaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgcaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtc

SEQ ID NO: 19871 - DNA, 1112 bp, Oryza sativa
tgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatattgtggtcatttttcaggcggttggtaaatcctttatgagtttatttactcggattttataccacatatgccatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactatattttttagccatccacagtcttcagatttggtaaaagtactcgggagaccatggcgaagatgattgaagcactcggctttggagtaatctagttcgagagaaggttatccttccgactgtgaaggtctcaggggctactgtggagactatgggtaccccataccacacggcatggttatccgactagttataggggataacttatatctatgtaatatgtaacagatcatgacttgggtgttacgtttccttgtatattacggaacggcctagagtcctgatttaggaaaccgataccgtattggttaaggtttctatcttgtaattctgccccccatcctatataaggtgggcatgaggccctctagggggcagagataga

SEQ ID NO: 19872 - DNA, 168 bp, Oryza sativa
tcattctccttggtatcttcaaaaattggatcttatagtttttacagtttattatctcgttgggtttcgtttttataatttctagaagtctcgtcaaacgctgtcattatactcctctatggaccgtccactgttttttctctttattgttattgggattttaaaaat

SEQ ID NO: 19873 - DNA, 1501 bp, Oryza sativa
cataatagggtttcatttgcaaaagcagcatttagcaaacatttgagaatttaaaacagttaagtattaattaagcaatattaatccaacgctatacaacataccctgttgcataggcccaaccattctgaacaaccatcccggctgcacagctctatctccaaaccaggaatataccattccaaaccaggagctaatcaaattattaccaattatagcatcatttactatggtgaaaagtgtgagactaatcacgaaagacattgttagacccgcccataaccgcgggcacggctattcgaatagttttactctgatcagaggtgtaccactgtacccacaagacacaaccccacatcatgtcaccatgtgcctcaatatcaccacgatacctcggaaaggagttgtgacaatacccctcatacaacacaatccactgcagcgcaccttcctggatcataatcacccccttataaacaaggcatggactccccagcgacccccgtgggcttatctccgccacttctcagtctggtgctccgcaatgaaccatgctacacaaaagataaagccgttgcccatgctggcttgtggttggcacggttaatgtttcacaaccgaaactcgtgaaccggtccttaattgtcatgagcacgaccttcaaaaccatgtgctcacaacccaccattaccaggttttagttggcacattaattaattaactaatcacgattgaccatcgtgaactatcattaaaccatcatgaaataatagtgaatcaagttatcccaaaagtgagctaatgtttctaagcagggctaagcaattgtatctaaaatctagttgaaccaatataaataaagttcaaccagtcaaattattataacccaaggtatcaaggaatagaataaacaagaacaaaaggggctataacaaagaataggttaattccacccaatgacattcgaaaataaatgcagtagttgaatgaaaacaatagctttaaataggatcaacatgctcaaagggttgtttgggatctgtgtgacttgccttgctggccttggaactcttcaaactctcttccggcgaaaacggactctccggaaacgacggaatctaagcagaaaagaacaaaatcaccaaaacagcacataaacaagcttgaacagtacatgtggatatttttaatgtgtagatctcaattttagaaaaatttagagacttgaaccaactaaatcggagctaagatgaattagttatgaatttttaaagattaaatcggattaaaacacctaaatcggcttaaaattgaattatgacgcaataatgaattatttttgaaaaggaaaaggggatttattgcgtcagcggcgctagggtttgggtggaccgggcgcacgggcggcggttcacgcgaacggacggccgagatctaaccgatccaagatggacggctgagattgatcgggtccacggcggctcacgggagaggggcttga

SEQ ID NO: 19874 - DNA, 1501 bp, Oryza sativa
gaccggttcacgagtttcggttgtgaaacattaaccgtgccaaccacaagccagcatgggcaacggctttatcttttgtgtagcatggttcattgcggagcaccagactgagaagtggcggagataagcccacgggggtcgctggggagtccatgccttgtttataagggggtgattatgatccaggaaggtgcgctgcagtggattgtgttgtatgaggggtattgtcacaactcctttccgaggtatcgtggtgatattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagagctgtgcagccgggatggttgttcagaatggttgggcctatgcaacagggtatgttgtatagcgttggattaatattgcttaattaatacttaactgttttaaattctcaaatgtttgctaaatgctgcttttgcaaatgaaaccctattatgccgtcctttgttatcctgtgcacttgcatatttgttgcgtggcttgctgagtatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttatacgcttatagagtagtaattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaatattggaaaagtagaactgttcttctccctttctcttttaattaaaccaaactaatggcacatgcactttataatctcttttaatggttctcatttaaaatttattccagtgttattagtactgtacatctattactgtactgatggctcatttaccagcagaagtttttattgttttatttaatcttacagcaataaaatgaatttagcaagttgattttataacttttctttttatttcttttgaaacctgttattcaaaagtacaaaattcgtttccaactgtttcaacttatcttgcaaagtttggtttacttaatttatttacccttttactttgaatttccaaactttattaaaattaatccaaaaaattgtgctattaattggatagatgtcttaactccctcctttcacttgcctttaga

SEQ ID NO: 19875 - DNA, 1501 bp, Oryza sativa
ctgcgcgtggtgttcggcggcggcggcggcggcgcgcgcggggagcacttgttcttcgggacgacgccggcggggtcgatggcgcaggcggcggcgctggagttcgtcatctccttcttcctcatgttcgtcgtctccggcgtcgccacggacaacagagcagtataagatcgaacaccaaaactaacaaattaactatatatatatgcatgatgatcgatgataattttgtggtgtacaacacagatcggtgaattggctgggctcgctgtcggtgcgacggtcgcggtgaacgtgctcttcgcagggtatgtgttgaagtaaatcataaaatttcacagttaactacgtgctgttgatgccgcattagtagtagttgttcggtattctttttcgtttatgcttatacttatcagccagtttgaatttttaaaattaaatttgaaactaattttgtgaatttttttcatcaaagtttatttttcagcctttacttttaaagcgctaaaaacctgtatataaaagttttattcacaaattatcttttttttataaacacgtcgtttgatttattccacgaataagctaaacgatgaggcccctcattgttgttgttgctgctgctgctacagtgtgtattgcattgggggtttaatttgcaggccggtgacgggggcgtcgatgaacccggctcggagccttggtccggcgatggtggcggggaggtacggcggcgtgtgggtgtacgtggcggcgccggtgagcgggacggtgtgcggcgcgtgggcgtacaacctgctccgcttcaccgacaagccgctgcgtgacatcgccaacaccgcctccttcctcaggaggagctcgcgtaggagttagtgatagatatatagacagaattgaagccgttctgtctctcgaatttgcagcaaaaatccaatcaccgtgatgctaatgtttttcatgcccgttgcaagtgtaaatgtgtaattaacggcccaggcaggcaggcaggcggaccggcccatccttcggttgatttggtgaaatttgggccgaggcggaatgaagtatcgggccgtgatgtcagagatgcggtgggcccatagtgggctgcgcgagcggctagtggggtcgtcgtgcacgtacgtcggttacacgattctcttttctttttatttttaccgaactaggtaaaaacccagaagttgcaacgaatattataaaagaaaaaaaaatacagtatagtcggtcgattagatatataatgtcatcttcaaaggcagccatactaaaatatgctgctatgctggtggatcatctattcttatcctcttcatatatttccacaagttatatggtcggacaatacaacgttgaacacttctaattcacctgacacccacatatatatttgtgtgtgaaaccccttgcaatttctagagttaacaattctcttattcattcatgtgttgtggggcttatggcccccacatgttagttt

SEQ ID NO: 19876 - DNA, 1501 bp, Oryza sativa
tttgatcttatgagtcatgattagaatatcaatctctagcctgtttcttggttgccgattagggtagtatcggggtttcagccgatcttacctgatttaactatgtttaccttatatgcttcattgatatgttaaatctgccctttatgttaagatcttgtcgcatttaagtatattaggcttttgtttgatatattttacttgctttgatatcttagtatagagtggtatcggagtattagccgatacatgctagatctatctgatcggctatgctatgaatatatatagtctcattattaatatatatttcgatctaagtgatttatactggctcggcatggcgaccgatctatcccaatcacttgatttaagtatatatcgatataaggattatataccgttaatatctacagccgatcgagtagatttagttctgtcttatttattaatgactgccgatcgatgcatatatgacattggctcaaaggtaaatgatatgtcatcggcacctagccgatcggctatcgtttatggatttaaccgcggtttctttgtctttgtttcttgttgattgcaggatcaaatcaactagcatgctagcttacccgaatgcgagttttggaactgcactggagttaagcagatctcccaggcctcgtgttttcacataaacacgtttttggcacgcccagtgggaccgattagaagtcagaatcacaacagcatcgccgtcttcgactggtaaagatggctctgttaaagctaagatccagaagcttgcataattctgggtctcattctactaatgattgcaaggtcttcaggcaacagatccaggcagctattgagggaggcaaaatcaaatttgatgattctaagaggccgatgaaggttgatggcaatccttttcctgtcaatatggtgcatacagctggccgaacagtcgatggaggtcgtgcaagaggttttcaggtgaattcggctaaaattatcaataagtatcagaagaagtatgacaaacagctggagaggtattatgaagaagatgatggcggttttgatcctcattggggctgtgagttctttagattttgctggaatgaaggtatgaggctgccatctattcaagactatcctgggtgcagtaatgttgcagaaaattcaagtcgatcgttcaatagaagcaatcggctatggcaagcaagagttcctgctcatcaaagattgggcccggtgaaccaatattgtaaccaagaggacaatgaaggcaggaagactcaatggtgtccttctggtatttttacgaaaaattagaagaggagggttcaaaggttgaggaacagggagcgctttcaagaagttgagcaagaaatcaatcatcggttaaagaagacgaagccgaagcaggagtggcgtgttaagaatcaagctcctatagccgatgaagccacagtcgatgaagcaaagagattggctaaagggaaaagtgttgtgactg

SEQ ID NO: 19877 - DNA, 689 bp, Oryza sativa
tcccccctaaacctcctctttcatctctctttttttacttttctattacatcataaatttcaaaaaaaatcgtaaaagaaaattaggagaaaaaaattctaatactctcatttgtgtgcacagactttataccgtaaactttacacgcataaactttgtgtatagaaatattttatatataaaatatttgaatccaaatttgaatttgaatcgggtatataaacttttgacttataaatattcgctctacaaactttagatgtgtaaaatttaggtatataaacttactaaaagaggaaaatataaaatatttgaattcgaatatgaatttgaattgggtatataagcttttgacttataaacattcgctctacaaactttaggtggataaactttagatgtgtaaactttaggtgtatcaacttactaaaagaggaaaatataaaatatttgaattcgaatatgaatttgaatcgggtatataaacttttgacttataaacattcgctctacaaacttaggtggataaactttagatgtgtaaactttaggtgtatcaacctactaaaagagaaaaatataaaatatttgaattcgaatttgaatttgaatcaggtatataaagttttgacttataaacattcgctctacaaactttaggtggataaactttagatgtgtaaacttta

SEQ ID NO: 19878 - DNA, 1501 bp, Oryza sativa
aactcactcagcatatcggcaaggacgaataaaaccagcatcatatagacgttgaatctcagctttgacaggttcaagcatatgaactttgcatcttttcggaggttgttggtgtggtctaagccctggtttgataggtagccgatgttcaacaattgatcggctgagtcctggcatctcataatactcccaagcaaagcaatctatgaattcctttaacagctctatcaacttggttctaaattctgaagataaattcttactaataaatgtcggccttggtcgatcacctggacctatgtcaatttcttccaaatcgtcggccgacatgaaaccctgtccttgcttgtcatcgagatcatctactgtgtccttggtgtaaacgtttgaaccctccacgacaccctcaaaataatagcttgggctctccgtcttcaattggctgtatatcagaatcggacacttttagaaaatctccatcccaaacttttccagataagcaatcgagaccatccatctcccaaagagctaaatcggcactagcaacattaactaacctgtcagttggaacaatttcaatcttctgccttgccactgaatcaagcattgatgcatggttgaaggaatgcaacaattagcatgaatccaatcgcttccaagcaacaagttgtaggaacccttcccatcgatgacaaagaatgttgtagggatagttttgctgccaactgtcagctccacatttaaaactcctttggtttccgatggattgccaccaaaatctttgagcaccatgtttgtattgatgagatcctcagcatttctgcccaacttcctaaatgtagcataaggcatcaaattcactgcagccccaccatcgaccatcatcttggacatcggcttcccattgacatagccatttatatacaatggtttaagatgccgattctctgtcccttcaggcttctcaaagactgcttgttctggtgataaaaccaacttagccgattcttcttcaacttcatcgacatcggcttgcttgaccccaaactcagcaggcaacgtgaaaaccatgttaaccgacgcagtcacaacacttttccctttagccaatctctttgcttcatcgactgtggcttcatcggctataggagcttgattcttaacacgccactcctgcttcggcttcgtcttctttaaccgatgattgatttcttgctcaacttcttgaaagcgctccctgttcctcaacctttgaaccctcctcttctaatttttcgtaaaaataccagaaggacaccattgagtcttcctgccttcattgtcctcttggttacaatattggttcaccgggcccaatctttgatgagcaggaactcttgcttgccatagccgattgcttctattgaacgatcgacttgaattttctgcaacattactgcacccaggatagtcttgaatagatggcagcctcataccttcattccagcaaaatctaaagaac

SEQ ID NO: 19879 - DNA, 1501 bp, Oryza sativa
caccaaccaacagcgagcatcggggcagtagtacgcggcaagttgcaagctgggcctgcgcatgtctggacaagcggccggcccccttccaaagctccagactagaactactccgaataaactacgcgtgataatggcaacaagcaacaacgtgtacgagaagtactacaccaaagtagagtttaaactgtgtgctgctagtaatgagcagaccggccggccggccggcgctgatggaggcaggcagaggttctggattactacgaccttatcagtgtccaccttggtttgtgaaggctttaagttcacggcagatatggaatggggatcgatcgatgcgccatcatcaagtcccttccctttgcctttgattttatagaagtatagaagacgagctgcttgataatgtacacgctactagctagcatgcttcgtgtcggcagaacagagcagttaaaacgaccatgcatatgagtaattgagtacgtacttttttccatccaaaaaaatcaattcatctcccaatttcttcttattttgggatttggtgcttcactttcagctctcgccaggtttcggggatcgtcttgtttggtgttgcagtgttagacgagtgaccaacgctactcaacacgttcggcgtaccagatgttcttttatggccagccctcatttgcttgtgctgatcttctgtagcacgcgaagggtcctgctaaatacaaattcttcctctagtttgcatttcaacgatgttgttgcacgcccgatctcccccagaagcgcagcattgatagtcactcggtctgccccttttacactcaagagctttagatggcaaaccacatcctcctcgattgtgtgttcgctcgacaggtctggctccgtgtgttgtcacctcttggttgggctgccctctctcctccccgtggtagctgcctccaggattggtggccatcgtctagggcatgctttgcctgagcatctccgtgccggcttcgattctctgattctcctggtctcctggcaacagtggactctagggttttcgactctatattatcttcagtcttggaggtccttcagtccatcctctcagagggtcatctatagccgttagctggcattgctaattttggggttttatggggagagtagtgggctctgcccccttcccgctgtttggagtcataataacctagtttttttttctttggtcttttgtttccctcctttcttggcataagtcagtctaactgattgcgttgtgtaacaaatactattttcttctaatatattgacatgcaatccttttgcgcgttcgaaaaaaaatatgcgacattttctattacaatgaatctaaataaatctcttctggatttattatattagaaaatgtcaatctcaaatatatttattttggaacggaggaagtatgggtttattatggtcatgatgagttcacattcccgttcaaggtatgagcggaacgtaggtgcgtgcg

SEQ ID NO: 19880 - DNA, 1501 bp, Oryza sativa
ataaatagaccagaagaactataaccaacattaggcctctacctcaacctcatgggctttggccttagtgttaagattaaaaaattagcatcatatagtttagcgcagagtaatataatacaaattaataaatactataagttgttttcttatcaagatgtatctagtagtctagtggtaagatactcccttattataacagaaggtgctagtttgaagcccatttcgtgatcattgtttttcttttttgccacttcggacccctcccctcccttttttttttctttgttgtgccttcaccttttaaaaatattttagtggtcgtgatttgaaccatgttcttcatggtgatacaaacaccatttaccactacactacgccactactagatatggcaatgagccccgttttcccttttcctacgaggaattcttttattagggacggaaatggctatagttgattcttcataagggaattataatgggagaagtcatgcccctgtcaggttcgtgggggcaagggtgatcctctttgataaatgataatcttatttcccgttgtattttgcgggcacgggaaagttttgtctcacgggggtagggatagggatgcatttttcggtgggggccatctctagtcactgatcactatgcaagttttcatgtgtatttggatctatcaacgttttatagtgtattccacgaggtccgcatcaatgggtctcagggacgtacctacgttgtagattattcaaattctaactaaattatatcatattaatttatattagttaataattagataatttacatatatagagcctcgataattttgttccaaatttatcactgatgagcttggcgttgagatgttgggccttagtgctaagatctagtaaggtaaagagctttttttttgacgggataaagatatatttttggttatatttttgtcgacatctagttttcgaacaagtttagtaaaagagtcaaaattgctgccattatccatcatagtatgctcccatctcagccgctctcaataatggagtatgccctgccccagagtcgcaggttttgttcagctttactctgtcagcatctctggaaaaactgaagtggacaaatgctacttccaccgttctaaaaaaaacctagtactaggatgtggcaccacgatatagacatactctatgtccagattcattgtagtagtatgtgtcacgtcgtagtatgaggttaattttttttagaatagagagaatataccgctttttttttatccccgccgcagatgcaggcaattccatggtccctccctcgtcacagacctggtgttacagttccacttccaacaccatgttttcatgtttaccttcgcttccccttgtcctgaatcctgatgaggttccgagactcttgaggatgtcgaggaccagaggatctacaagacaaaagaatactatatctatctagccgccatgcggtgcgaatgcgat

SEQ ID NO: 19881 - DNA, 1501 bp, Oryza sativa
  unsure (1)..(1501): unsure at all n locations
acgggcacgttgttgctatcctccacgtaggaaaatggttggtgggaaccacttactggcatgtttgctagatgccacctgtatgtactggtactatttaaactcttgtgatggccacaacatttttgttttttgaagcagaaaatgtactgagtttgagcaacataaaagcaacacagtcctgactacatagcgaaatataaacacgcgccatcgctctctttcattgttcaggaataattctctcaattcagcatggaaaagcattaaaattttcttccattatttggtgtgtacatgtggcacgcgtgctcatatgtgattttaactcgagagagatcgtcaaataaaacgtatgttatatattatcgaacttgcgactggagtccaataaacaaaaacagtgcccttttagtttcaacaaggtcactgatctcctggaacgtacgtagatgaagaaataattccaattgtcaaattctcatttcaaccctccaagagtccatggggcaattcttgttgagtgtaaatacaagtaattaacccaatctccttaatttttccaaacacacgaccttaagcctcataatttggacaatcacagcaactactttttcgtagtgttgcatgcaagccacgatgaaatgatctaaaagcttagaaaaatgatacgggaattgttctgattgatgttattaatattggttggcacaactatacaaaagaaaacttcaatatctgataaacaattttgcaatgcccgtaatacctcatgatatataagagggaaaatggatagggaagaaagtgtatgtccgagatttagtgttacacgtcagatccaacacagagatcgggaaaatatcaaaatatagcgtaaaaatgaagagtgtgaccgacactactaatgtccaaaaacaattttccaatttctggcgtattaatctgggttctccaatctgaaattatgtattctagcttagctcttcggtcaaatgcaaactgcattcttacactgaaaatctcatgattttttttgatataatagcaatcccatgattagtgctgcatgattccatataaactttttttttgggagggaggaatgccattcggctagctttattgatatgataaaattgttacatcatttaccagatgatttagaatatagccagggggttcatcaacccaaatacaagaaagcattttgtataaactttattagatgagcaatataagtttctagtaatggcacacaaacatgaaagcattttgtttctccaaaaaaaaaaaaactgaaagcattttgctttcagtggcttttctttacatttccaacactgagccaggcccggcccggcccataaagactcccttggcttattgccttcttccattcattgcactacacgcagtccacagacgcttncttcgtacgcttcaccggagtgggtggagacgagacgcgagcaaacccaaaaccctcgcggcgacgcca

SEQ ID NO: 19882 - DNA, 243 bp, Oryza sativa
agcgaccccctaattattggcgccggccactcggccagggcatccgcgatcctcgtcggcaggcactgcatgccactctccccaccgtctcacatcacatgcctctccaacctgtcgtcgtggcgcgctcgccaccgaccgccgttgccaccgcacgccacgctttgactctacctacgtgcccaaacacagcacacaccgtcccccccggccacatttgccgttgttttattacgcgcgcga

SEQ ID NO: 19883 - DNA, 1501 bp, Oryza sativa
gacaacacacggagccagacctgtcgagcgaacacacaatcgaggaggatgtggtttgccatctaaagctcttgagtgtaaaaggggcagaccgagtgactatcaatgctgcgcttctgggggagatcgggcgtgcaacaacatcgttgaaatgcaaactagaggaagaatttgtatttagcaggacccttcgcgtgctacagaagatcagcacaagcaaatgagggctggccataaaagaacatctggtacgccgaacgtgttgagtagcgttggtcactcgtctaacactgcaacaccaaacaagacgatccccgaaacctggcgagagctgaaagtgaagcaccaaatcccaaaataagaagaaattgggagatgaattgatttttttggatggaaaaaagtacgtactcaattactcatatgcatggtcgttttaactgctctgttctgccgacacgaagcatgctagctagtagcgtgtacattatcaagcagctcgtcttctatacttctataaaatcaaaggcaaagggaagggacttgatgatggcgcatcgatcgatccccattccatatctgccgtgaacttaaagccttcacaaaccaaggtggacactgataaggtcgtagtaatccagaacctctgcctgcctccatcagcgccggccggccggccggtctgctcattactagcagcacacagtttaaactctactttggtgtagtacttctcgtacacgttgttgcttgttgccattatcacgcgtagtttattcggagtagttctagtctggagctttggaagggggccggccgcttgtccagacatgcgcaggcccagcttgcaacttgccgcgtactactgccccgatgctcgctgttggttggtgccacatcccacgctgccatgccatgcacgtatgtgcacgcacacgcgacgtacaacaacgtcgcgttccggtggccattggtccgtgcgctcactgcgtcctgcatgtgtgtgtgggcgtgtcgggggtctcgaccgccgtgcgcgctcgggccgtgccggcacgagatgccacggttcacatgaggcgcaacgcacgcagcgcatctgcgcatgtcccccactcggttggtggtggtggtggtagctttggggcgtttggctcggggctcgcacgcgacgcgaccgagacaagcaagcgcggtctgcctagcttgtctccttgcgcgacttgtagatagatagatagatagatagaaatagaacggcagacggtgcagcagtagctggaaactcgcgcgcgcgcgcgagcggcgggcggcttttccgtgttcggtgtttcggtgcggcggccatatatacgcgcgcgcgctcgcgtactacgtgcagacgacggactagtgcgtgcgtgcgtgacgcgagaggctgagaggagcattttggcccttggtttctttcggttcttctgctcttttttgctggcgatggggtggtcgtcgtcaagggcta

SEQ ID NO: 19884 - DNA, 1501 bp, Oryza sativa
gtagctgcgtatttcccgtagcgagcactgtagcagttactgtttgaaacgacgtggcatagatttaaaccgttgatcgtcttaatccaacggtgaaaaatgattacaactgcaaagttgcagtctctattacaactgcactggaaccatattcctttgtgtgtgtatatgtccggcagcctgcactcgaatcccgatgttgactcgcgcaaaagaaagtccatggataaataaggcaaaagaaagtccatggataaacaaggttaaggacaaggggaatatttgtaagcacccgatgttcactctcgtaaggagtgaagtgtacaggcaatttttaaatttgtacggacatgtcatctaggttttaaatttctaagatgtatttttgcgtcctcgaatttattatttgtgtcgtatatgactaaacaagtttcaacttacttcatgtgttgatgtggcatagcacagcggtgcatatatgttagtgggacccacatattagtaaaaaataaataaataaccatctttttctcctctctctctctctcctttatttttattttttatcctctcttttaatttaatttttttatgactagcactttggtccaccgacacgtaggcatcaacgtggtgtgccacgtccgcacatggagggttggaacttatttagatctatatgacactcacgacaagttcggagacaaaaaaaagtatattttgagatttcagagacttagatgacactctcacaagttttagggactgctcatacacttaagtgtatgcaggttgttacactgaataaaccaacaccctccatccatggttgatgactttgtgctgatatgcatattgttcttcccgataggcaaaaccaatgaaagagtaccaccctctccatccatggttgctgactttgtgcaagagtatatccatccaaaatcaaaaagaaccactccccaatattatacctttgtgttgtgagttagaagttgagaagggatttgaaaagagaagagtttgggggttgagtggttgagaagagaagttaagagctagtgagctttactccaatctttgagcacttggattcatagcaagcaaatcttcgattgtgtttgttactcttagaggttaagctttctagttagcagagcgttattcggtgaacttccaagtttgtgaaggtttccctcacctccgcaaggaaagaggtaatttagtggaaaccaaactattttctaggagattgcatgttatagcaagcttcaccggtggatcagcgctcatcatccatatttggatcttgagtcgtttggagacttgctaatcctaggtggttgcttgaaacctagatttccttggggttgctagcctggtaagggaagtggttgaaagagacaaattctttcagagtttcctcaacgaagggcggaagcagaagcaactaccccctccctacaatgccgtcaatcctggtcctcgttgcaaacccgca

SEQ ID NO: 19885 - DNA, 1501 bp, Oryza sativa
gacccatccactggtatttacggtatggacttctacgtcgttcttgagcgtgctgggtaccgtgttgcgcggcgccgtaggtgcaagtcccgtgttggtatccagcacagggtcaccaaggaggatgccatgaagtggttccaggtcaagtacgagggtgtcatcctcaacaaggcccaagccaacacctcctaagcgtcactagtgcctagttctctttagaacttgagttatttggatgttggatttgtatgcttcttaaaactaaagatgttttgttattttgtcaactttgagttggatcagttttggtggtatgtactttcatcttaatgctcagatctatttactctcttagcagagatagatatatgatttgacatatgctacgaactgctgtcaatgttgataaaatgaaaagagaatggtttagaaaaagaaaatgtcactacagatgtttctttggcaatgatccaataaatgtaactcagaaagttcaaacccttctggcaatttagtagaataccaggaatccccatggtaatcgtgcactttcatgtgaaatcacaacgtattttttaaaaaaaatccgtgtgctccaagcggatacggaagttgggaactcgttcctgtaaaaataaatctataatcttgccctccaagcctaggcgaattgtacgatgatgtttaccttgtaaatttcttctcattccgtcacggtgcttatcttttccaaaaccggtcagtctacaatttgtttgcaagataaatgtgattgtaatgttgatcttcgacgcaagagtcgtttacaaaatgttttaaaaaaagtactatccagtacgattggccggtaacgcgtcatgactcatgagctactggacttggaatcaaatcgacgattagcacactaagagcaagttcaatagtatagctaactactagctccaattcatctatagccaatttaatagcttattcatataatagttacatactacactattaatacatggtcccacatgtcatacacatattgtgtcttggagtccgtgctacagctggctataaatctgtaacccgttgtccttctctttccttatttatctccttaaaatatgtttgcagcttgtttgtagcctgctattgtacctgctataagctagctgcaaacatattttaatgagataaaagatgagagagaagagcagcgggttacaaatctgtagccagctgcagcacggactacaagacgcaatgtgtgtatgacagtgggaccatatgctaatagtatagtaagcaactattatattaattggctattagattagctatagataaattggagctagtagtggactatactattgaacttgctcttgacagctgattaaacaaaacgaagatgctgggaagctcatgtcgaaaagataaacgtgaactgaaacgccaaaggagtccagacatccaggtcttgacggcattcatcgccgaaatccccaaa

SEQ ID NO: 19886 - DNA, 1501 bp, Oryza sativa
tagacttaccatgccatccattcgaaaagcacccgctaatcacagaattccaagaaatgacatcccggtgaggcatcccatcaaacacctgtagtgaaccatcaacatggccacacctagagtacagtgctataagcgcatttccaaccgcacattgcacccccaaacccaacttctcaaggtacccatgaactacttcaccatctgcaatactgcccaaaccggcaatgcatttcaagacacacgaaatagcatgtgcatccggcctaaccccagaacagtgcatctgcctaaacagcaaaacgccgtcttggaactcaccagctttcgcgtaaccgctcatcagtgaagtccaaactcgcacgtcactcacttgaggcatttcatcaaacaccttccttgcattctccaaatccccacatttcacatacatcagcaccaatttccttccgagaacactatccattccatcttttccaacaccagatgcgcgaaccaagaaatgggctctcttcccggcctccaaagatctcagatccgagcagagctggacgaccgcgccgtagctccgggcgtcgacgccatccgagccgagcaacctcaacgcctcctctaactcacccgcccgacagagcctctcaatctgcacgtccacatcggttctcggtgcccgactccgcgaattcttggcgcccctcggagcagaggccgcctccaggatatgaccggacgccgcgaggacgtcgcacctaacccttgttcttgggctgctgttcttgggaggcggccatggaggaggggctcggaggtggctggaaacggaggtgagtggaggcgtcgccatgggagcaggaggaagaagaagaagaaggggagttcaaattttgccgcgaaatcccgcgatgttgccgcggcttcgcttggttgaaatggatagctttctggattgggttgcaaagtttcccatttcacgcctcacatttaagaaaatttcatgaaaaggacatcacgcatttgtgttgtagtactactgtactagttccaaaatgatgcctaaaaaatttcaatattactttgagggtatcaatgaaaattttccctgagtatcagttctcattttttcttcatgtggctgtgagtggattgaagcagagagcagaaggaacaaacttttggctccattggaggacagggagttcttcacctgttgtgtggtggagcaagaaaaaatggagaaaatgggaggaattctcttgcagcatcaccaaatctctccaaattatctcgcaaaggctgccttcccaggatcatttgctctccacaaaggtgacagtgaatcagttcattctgaaatttacacacatgccttaatttacatacataaacataagtaattaactatgattttgcagcatgccatcatttctctttctgcttttataacacctggtttgaaactgcagttagctaaaactgcaaatcatggcgaaatgaactaaga

SEQ ID NO: 19887 - DNA, 1501 bp, Oryza sativa
acaaaagattgagggaagcccacacaagtgtatccttatgtagtgctactgggatgtttaactctgatgtttcatctttttatgatcctagtattttttttttaatttccctgcaacatgtaaatcagttatcccttagttatctttataagatttgcagcagtgtacaattcattccttggagaccttggacaggtcagtgctacttcatgcttcattgtttgacttatacttttcttttgtcaacttgtaagatgcaaatactagctattctccttggattcttttattttaatttgtaatttttttatcctcacaattagttcagtttcatctaacagctattactggaggccttgattcaaagcttgctgtgtgggatttctccaaagggcgaacactgttttctatagattatggtacctcctttttccttgaatgaaaaacttacaatccatgcattgcaccaacttctatgtatgtgtttaccttttgacagggtcatatactaacaattcctagtgaatcttgtatggttactttaatgggttcacatctttaagattaaatgggaaagttgggttttgctgattaaccacaatgctgtatattcccttcttttcgcataaattttctccagcatgcattgattaacttttttttttttttgctcttggacgtcaggatcacctgaaatgcagaatggaagttcaggtgggcaatgtttcaatcctccttttgttcactcaatagcagtttctgaagagggcatcttgggagggtcgtacaaagtttgtgctgttgcaagaggagatggtgctgttgatgtggttgatctagaatatgaacttgcccctgcaaaatcaaaagggcttcctcggatggcagatttgagtttaagctcgaaaagaactgatttaggagatggatgtggtagtcaaagtcaagggaacaggatccaccttgattacacagtgggtggtcatacttcatctgtttcttgcgtgtaagtcccactatgttgtttctctgtaatttcttacatatcttacccttttactaactgcttaatactttaacagtacattttcagcatttggcgagaaggggaagtttcttgtttctggtggcaatgattcatcaattaaattatgggattggtccaaagggttctcctctgaaacaaacaacagtgctgaattggtgttggatataaaggttaataaaaaggtagccactcaaccttaaattctgtgaaatgttgtctgcagactttggctatctatctgcacataatactccattacttgatgtactactagatagtaattttgctgttaacggatgtgactgaattcttaggattgggtaaaattgctaacctttgatctacatcttgacaggtgaactggttgtgtactactccgactgattcagataacctgattgtgtgtgacacatccaaggtggtcaaagtttacaatctaccttagactgacaa

SEQ ID NO: 19888 - DNA, 1501 bp, Oryza sativa
ccataaaattcatgctaaagacttaccgcatctttaatcttcttagtttcttttggccctagttttttttaatctagatacaacaaaaaaaaacaacaattataatgaaacgaatacaatcacattttaataaaaatatcgctatgtaacatgactaaaatatacaacttaagcatccatacaatttattctaaaaatgtaccacatctatattcttcttgactactttcaaccctaacattttatcctgatacaaccttaagaaagcaacaatcacgatgaaacggataaaaccacatgttaataaaaaattactacgtaaccgtcgttgaactatacagattaagcatccataaatttcatgctaaagacgtaccacatttctattcctcctgactattttcagccccaactttttatcctgatacaaccttaagaaagaaacaatcatgatgaaacagataaaaccacatgttaatataaatattactatgtaaccgttgttgaaatataccaactaagcatctataaaattcatgctaaagatgtactacatctctattcttctttatttattccggcccaactttttatcctgatacaatcttaagaaagcaacaattacgatgaaacggacaaaatcacgtgttaacaaaaatatttctacgtaaccgtcattgaaatatacaaattaagcatttataaaaatcatgctaaagacgtaccgtatagttgtttctttctgtcccaaccttttatcgtaatacaacctaaagaaagcaacaatcacgatgaaacggataaaaacataaaaccatatgttaataaaaatatttctacttaacagtcattgaaatatacaaatgaagcattcataaaattcatgctaaagatgtacaacatctctattcttcttgacttattctagcccgagctttttatcccgatacaaccttaagaaagcaacaattacgatgaaaccgataaaaaccgtacgatgataaaaaatatttctatataaccgccatttgaacatacaaattaagcatcaacaaaattcatgccaaagacgtaccacatctccattcgtcatccatacccaattctttatcctaatcaataccaccaaagactccttctaaactaagaaactcaagattttcaccttggttcatctctcatgcaaatcctctaaaattcctcctataaaacatcccagttcatgaaagaaaacccttcaaaaatatcatactgagcacagttattagctggaggagtcagcacagttatcggtaaaaccacttccccatctgtccaaactccaaagccggcctcaccggcagcagccacaccacaccacaccacaacaccccgcagccttgctgcctcccctccctgaccggtcaaaagcacaccaccaccatccccccgcaaagccaagcaccaacgctcagcagcagcagccgcctccctccccagctcagctcagctcccccccgca

SEQ ID NO: 19889 - DNA, 1501 bp, Oryza sativa
acaaaatttaggaaccaatgcatagcacgactgtttctgttatacatcaaacattacaaatgttgaaagatgagtagcatttgagatttgaagtgaggattttgatacagaaacaacaaatgtagtaaatacacagatcaaactgattttaaaaactacatttcacccaaataaaaatctacgcatgaagaaaagtaactacatttgggcgttgaaaaggaagtttagtaacaaatgctctacattgaaataatacaagattatgggattatataatcttacttgatgccaagatcaatgtgctcctggataccaaaaccaaagcatccagtctcactgaagttcctcctcagcagctcgtactccttcaccttcaggccactctccaggagctgcattgccttctcaccacgcactgtcacgtagcacgcgatcttctcattacgccggatgccgaacgacctcacagtgtacctcgctgcaatatcgcatcatcgtcactccaagtctgaaagccagcaataaaccacataccactgataataacaggccagacttcagaatttacccttggagaacaccggtgactgcccactcagctgctccagcacctaacagaacaaacagcagaatttacatacatttgagtatggacgatcgaaaacatgatgcataaaactcaaagtcaaaacaaaatgttcatttgaggccaatgaggctggactaatcatgcccaatctacaaattcgacaaatggaataaattgaaagtccaaaccagcttctaatcgtaatggcttcatgctagcagcatcagtaacacaactttataaaccatccacgagcaaccagacaacagctagattggacacacatcaatcaaagaataaaaatgcccagaaccaaacaatagctagccgctacacaatccggactggaaagctcaccattgcactcagcctatctgaaaccaacaaaccgtacagctctacatgactaaaccaagccgaatctgacatgacatgaacaggtgcatcgtgattattaccttcgaggcgcgggtgaggcgatctccgctctcgccgacggagatgttgaggacaagcttctgcaccttgatctcccgcatcgggttcgcctgcttcttctccgacgcctgcgagcacagaaaccaaccaaaagaaaacgcatcaaaaccacgcgcgcccgagcggacagaagaacgaatcgaggagaagacgtcgccgacggcaaggcggcgcgcctctcaccatggcgagatctgggaggcggcggcggcgagggggaggcgggagcggcggagatggggggtttagtgttgctcgggcggcggcggggaaggagctttgtaggagtaggggaggaaaccctaaaattgttgtgctgggtgtttgtatggtgacaattactatattgccccggtggaatggaaaagaaagggaggggcatttacgtaatttcagttaataaaagggattaga

SEQ ID NO: 19890 - DNA, 1501 bp, Oryza sativa
ttctacatttctacagctttcaacaagtgaaagagggtttcagagtgaacaaaaactcaagaggtactcttagaaagtcagagattgctgtaaaaactgctataacaattcagtcactgtcagcaaagttgctggtagtagcctggttatctgcaagactgcaactgcgtgattcttggtcttggccaggacttgacaatcagacacccttcagacgatcaatcagctcactcttcttcagcctcgagtaacctttcatccttctcgccctcgccaattctctcagctcagccaccttcatatcattcagatccagcgcctttggctccccatctgcatgttcctccgaaacatcagctatgcctagcttgtcaacaagaagcagatgatcagttctgggatgtcaaacagcctgcatttgtttgatgtgttcttggaacagcaataaccagttctttttctgaaatacaacagttcaatccacagtgaacagcatcagttctgtacatgcagaaacgagtgcaagttctacgttttcttttttcacttaccgtatgactgcttcctcctctcaacctcttcgaacgggtcagatgattgcttcctcgtcctcctcgaagttcttggcgattcctcggcaatggaggtctggatgcttttgaagaactcaatgagctcttctttgctacgcctattaaccgttcttggcaacggagatccatttgcttctgacctgatgctccccaacgatgagcatgagaagctattccgtggaggacaaagcagaatcccatttgcaaagtctgcaactaattgaaaagatcagttacttaacaagaagtttcttagttcatttcgccatgatttgcagttttagctaactgcagtttcaaaccaggtgttataaaagcagaaagagaaatgatggcatgctgcaaaatcatagttaattacttatgtttatgtatgtaaattaaggcatgtgtgtaaatttcagaatgaactgattcactgtcacctttgtggagagcaaatgatcctgggaaggcagcctttgcgagataatttggagagatttggtgatgctgcaagagaattcctcccattttctccattttttcttgctccaccacacaacaggtgaagaactccctgtcctccaatggagccaaaagtttgttccttctgctctctgcttcaatccactcacagccacatgaagaaaaaatgagaactgatactcagggaaaattttcattgataccctcaaagtaatattgaaattttttaggcatcattttggaactagtacagtagtactacaacacaaatgcgtgatgtccttttcatgaaattttcttaaatgtgaggcgtgaaatgggaaactttgcaacccaatccagaaagctatccatttcaaccaagcgaagccgcggcaacatcgcgggatttcgcggcaaaatttgaactccccttcttcttcttcttcctcctgctccca

SEQ ID NO: 19891 - DNA, 1501 bp, Oryza sativa
taatgttaatctttcatttctatttggaaacaaaacttttttctattatatatgtgctaacagtgtagtgcctctttttttttttaacttgcctggcccctgttgacgaaaaaatcgaacacaccggcttgggagatctgcttagctccagtgcaggtccaaatatgatgacatacaggcgtgccagtcagtttgatcctgcaactgacaagatatgtaaacaatagatcaaatagccgatcggctaacaagccgatggagtagttccagccgatagccgataatagacgatgccgatacctgccgatagcgatagggtttaatcaatcggctatatgtccaatgcagataatgatataaaggcaatcggctgatgatgatgtaacaaaataacaatataatccagtataaaccaatcggctaataatgatatgatagataagcatcgatctgaaggttaaatcatacatcggctggaatgaaatccacaagattagattaaacagtaaaacctttgttgtcatcggctaatccaacttatatgtatatgcaatccttatgagcagatgcaacgtccagataactcaccggctgaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatatagcaacgcgatttagccgataccggcagaaaccctaaaacgagaagcagccgatagagctaaattgatatgctaaaactagattaacagagacatatgataaatatgtaggcaaatatattatctaaaccagagcaatccaagaggtcgaatgtactgatgcagccttgaatgacgccgacgtaaacgatacaattgcctgggccgacagaacattggacttaccccttcgccggagatcgaacaccgatgcagccccgcgtcaggtgccaagtcccgccggacgataacataaagtagaaaaggtaaaaggtggcgatgcgccgaattgtattgatcatgagattaattacatagaccccgggtgtacatatttatacccatgggttgatacaagtccttgttggacaagaaagaaactttcctatagataaaagaaaaagataaagtccttataggacactaaacacactttcctaaagataaaaggaaactaacaaactattcctaataaatagataacttgccatgccgcatcctctttgaactcggtctcttccggataagcttcctttagtagatcaatttccttaaccgaatatagcaagaatccgacaactgacgacttgacaactctcatcggctaatctcaggacttcgaagctgatgctgactataagccggtgactactccgggcttaccaaatttcactgttaacagcccctaa

SEQ ID NO: 19892 - DNA, 1501 bp, Oryza sativa
gagtctgatgtggcgccacctcttcgcctcggacaaatctttccaagcatttttattcgtgttcatgtcctttcgatcatatttatacctacgtgaatcagtttattttaaaatagagggagtaatcttagtcggtgatgcactgattagtaagtaggcacctaggccaactagttagaggatccaatatagtagccgtaaaaatattttccacggaatagatacgctactccttctggatcaaaataaaatgacacatctaattgatcgagggttgtttgagggagtttttggtagctgcaacttctcctagcattaagagctctctcaaactgttaaatatgtgatctgaattttgggaccacaatatattcggatttgttttctagtaggagtttctattaggtgtctttcttttatcccctatatatactcttgtaagccgtacgggaaggggtgacgtttccattgtgattcccttagtttgtaatcatctcctctatagtgattattgccggtcggcgcccatagttttttcccgcaagaatttttcatataaaaatttgtgtttccgttgtgcatctattttcataacacaaacaatctattttttcatctagatttttagaagatgtggttataaatccgtaaaatgatgtgtttttcagcttttctaaattattagaagttaaatactaatcgattttcctaagaattttgaactccaaacaacacttaaatcacatactaaagccgactagaccgactttaactgattaatcggtgaaaaccgactaatccacagattaccttttgattagggcggtctacccatgtctatcaagtatcaactggccattgactcgtaggtcgaccagtcaattgagccagtacactcgctttcgtcaattgagccagggttgggagagttcatttgcgggtgcacgtgcagtgcagtcttttcgaatttcgagtgattgaaaaagaaaaacacacacaaccaaatgagagaaacctaagtgtacaaattcgtgagaattctgtggtgtttgaatctcctaagaatgaagacgaagtttaaatgtttcacgtaaaacgatgtagtaataacatgtaattaattaaattttaactattacaaatttaaaaaatggattaatctgatattttagaacaaatttcatataaaaagttttcgcacgaaacactccgtttagcggtttgaaaaacgtggtacgaatatccaaaaattaatacatcctttccagaggaaacgaacagggccgaagactgcacgttccatgggcttcacggcattaggctagtaacaaaataccggcccatctacgtgaatgggccctggagttcagtataccggcccattcgtgtacatgggcttcgatctaggcccatccaaactaggccatacggattttgatcggacggttcagatcacaccagatttcttccccgtctccgtcacccgaaccctctcaaccca

SEQ ID NO: 19893 - DNA, 1501 bp, Oryza sativa
gtctcctcgggagcagcatctcctcctccggcggcgaggacgacgccgtgcttcttcttcctgcgacggcggcggcggcggcgccggcagaggatcccatcatcatcgtcacggcctcctgaacaatctccccgccgtctcccggcatcatcctggcttgcaagaacggagccgacgatgtcagcagcaagaagaccaggagcaggacggcggcgacggcggtcatggacgccatggttgtcggtcaagaactcagaattggatcgatcagggctagctatggctgaattcttgtgtaagattgatcaggttgtacagctgaattcttgtgtttggctcgtgcaggagaaggagatagcagagcatatttataggcagaggaagaggaggatgaagaggaggagatgctagtcgttgccccagtgcccgcgaatctagccggcatttcgattgttttgccacgtcattatggtcccgtttgagttcactgaatataaagatttttttacgaacacataaaacgagaaaatcgttaatgtacgactaattaacttctagttattataaaattaaaaatagatttaactgatattttgaaaagtaacttctacataaattttttatatgaaatataccgtgtagtagttcaaatatcgtgacaacaaaataccgaggtaaaaggtttatcttaattagaaacagagctatgctaattgattaggctatgtttggcaacctgggttaggaacccatgtgctgcgcacggaaaacagagcaatctattaatatgtgattaattaagtattagcttcttttaaaaaaaagggatcaatatgatttttatgcaattttcgtatataaacttttagaaaaacatattgtttaacaaattggaaaacgtgtacaaggaaaacgagagaagtgagttgaaaaaagaggggaagaacatagcctaaagactattagaccctgacttgttaacccaaaaatcatgcaaaggaatagcaagtacggcctcggctctattagacggaccctgacttgttaaccaccgtcctcgtcaaaaactagtgcttagtactaccccctacgtgtgcgacaatggtgcgtccccgtagaacaggggaatcgagtcaaacgagaggggctagagtacaaaatgtactaagatgctactgtgtaggaaaaggaaaacgagggggaatgcgattcaaatccgatggaaatattgaaaccgtgccggaattgaaatttggagttcggtcgccgtcgccgccgcctgcctgccggccggacggacggcgagtttaattgccggcgtatttggaaacttcctcgacagagatcgagagtcagaggaagcttctagttctgcaagttgcaggtggctgtgcctagttgctttcagggtatatttatttctgtttggcaagctaatacccagggcgaacacatgataaaaattgacccgggtcatctagtgcatgtatattgtactcgt

SEQ ID NO: 19894 - DNA, 1501 bp, Oryza sativa
gtcttactctagacgccccttcttgaagtcaactctatgggccctagatagttatgcttggacttttggataggataatatcagtgtggattgtggaaacaagcatgcacattgagagtttgagatgccctgcttaagtgtgtgtgtgtgtgtgtgtgggtttttttttttttgggggggggacatgtgttgacttactttaggttgtgaagtggtatggatcatataatgcatagtggtgcatgcaaatccataatgtagaaatggtatgggtcattttacgtgtgtccatcgatcgactctagttatgctcaaccaacactactacaaattaatttggtctttgcatacgcccacctttatttttacaaacgtactaaaaatatatatatataataagccaggggatgtccaataaaggcctgtctatggaaatagtttgttctcacagacatgcatgttaagaagaacaattgcgaaagtgaagacctggctccatccttttccttctcccttcattttcgctgcaccccgcatttcttctccatcacttctctttttcttccacatctcctccttcctctctctcccccatcacttctccttccccaacccttccttcccctctcctttctcctcgaatccaccagcggccgacaacgagagtgaccatcgcgtgccttggctcctcctcctccatcgtcggtagccttgtgacaaccagattcagcagaggcagtgatgagagcatccactgctcgcctcggctcctctacctttggtggcctcacaacggtagaggcggagatggaagcggacaccatgcgcctcagctcctccatcgctagcagccttgtgtaggccagctctagtggcgcatctagcgtaggggaggtaggggatcaaggctagggtttctaggtttcctttttttttttgccaaatatcttttgtaggccagcctacgaaaaaacgattttgcacgcggttgaggtgccgacttgtgataatcaacatttttatgtggcaccaggtaggcactccatctacaagcaaataccgaatttgatagtttgggggaaagcctttatgcaattgatcgtaaaaacattatatatatatatatatatatatatatatatatatatatatatatttgagcgaaaatttttaactaaagttgatcaacggctatctacataacggttagtttgtacaagtgtacgtgatacaagtataccagatcgagttaattatctttatgcttcaaaaaaaatgtcttttttaaatgaagcgcctgtgttaattatcacaaggctttttttctagacttgatatttatgtccattaattttagagatacacgaacatacgcttatacacattcagtggatctccggcaaagtgccaatgctgcagggttcggtggatctcctctactctacttgtagtacttgcctaggtcaatgcaactgatcgaagtgccacattaaagcatagt

SEQ ID NO: 19895 - DNA, 1501 bp, Oryza sativa
taaaaatgccaagtttggtaataaaacctagtcaaaggtgaaaagatctgctgattgctgctccaatttgcaacttgggtaataaaacctgccataaagtgcaattcactctttatactaacaattcgcagatgtaaacggcaaaatttggcaattattgttagttaaggccgagtcaaagatggaattcacgccatgattttagttgatttggttggcaagtttatctgggtttttgtaaattacttccgtgataaggaaggtttttaagtttctatttttatagatagatttctgggctgatggagtcgtgttagaatcagacttagaagatttatcttttaggttaaccgatcagagtcgtgtttgagtcggagttgtaatagtattttccttgcttagaggtacagtcctgagtcgatccgattgtagtggagtcggactttctatagcctattggtataaatatgtacacccagggtctttgtaaaacaacagttcaatatacaaatttcgatgcatcaccaaccctagttttactttcgacgagttcttgtttcgagtttaggctgcatcggtttcaatctctggcaagaaagtaagtttttgtcaactttgcttgtaacagcggaattagtactttctcagttaagtccggcatactagttaaggttcgactctttgtttgatcgtttttgcaatcatagtcagggtttttatatcaaacactatcaaaagtatcgatcgacccgtttaaatatactaaacttgttattaatctagaaccatcttggttgagtccaatcttctaggttataacatattaactatatttactcaaactgataggtattcaatatagttttatcggagttttagctgataagttatttgcttatcataatttaatctactgtatcggctaatacatagattttgtcagaataggtcaagctgctgccttcattactttccctacaatgtcttagttaggtccgatctatctagattgtgattaataaatttagattgctaatgattacgatttaaactatcatagccaatattagtttatctactttgcgagtaataataagtttcaattaaatatttaagtaaattgacctacatctggaaattatatatttgataaatctaggttttattattcttcgatcttgatgcaaaattccgttgttcacaataaccgcccttccaatagttccgattgtcattggcacactataaaaggagttcatacacacttcaacttgcacaacaaaatagagtgcaactcacttttagacattactttagtatgttggctgttggagtacctccgagaattttatggaggagtgccggactgtcggcattcttcaaattgaattccggagaaagtcggcattcttcaaatggagttctggagaaagccggtactgttggccttcttctctcaattgtatttcagcggatgcttccttctataaggtaagtattc

SEQ ID NO: 19896 - DNA, 701 bp, Oryza sativa
cagttttatttacgcctaattcgattttttttatccatatatagattattttgacttgaaattgtgaaattactctctacatcatcaaaaaaatcaagttattttgttaactatttgattggtgttgacaggtaggggcaccttttttaatgatttaataccggcaacatcataccctattttataaaatctttgtttatgcataccagctaaattaaggagttgatttttttttctcaaatgagcagaagagctgcgcatcatcatattaaggaaaagagatagcaagtaaaaggtcaacattttacaaagatatgtattcaaataccgtatatcataacttcataagagaacagattaatagaatcaatacaaggccatttatcatgatagacacccaggaaaaaaactcggagaaaacatagtggaaggaagcttccttatatctgacatatgttcaaatgacgcattatagcgcacaaaaatagcaccccgagcaaaaaatagcatcccggcatgctcgatcacatgcttaattcttagctttgtcctagtttctatcctcgttcctctcctgagcgcgagtgtagcacacaatttcggaccgtcttggacgccatctttactgcccccaggcataacggtttgtcttctcaaggataaataggacgaatacactgatattcggttttgggtccaaa

SEQ ID NO: 19897 - DNA, 279 bp, Oryza sativa
tgaaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccaca

SEQ ID NO: 19898 - DNA, 1501 bp, Oryza sativa
  unsure (1)..(1501): unsure at all n locations
cataaaaagtgcagtatgtgcctgaggcgcgtacttttccagctaaatccaggatacggcaacagcgggctcagttaaatatcgtttcttgctaccaagtttgataacctcatccacaaaatccttgacaatgggagaaccttcttcatgtgcccactgtcccgagacccgtccagacctaacaattgatccataaccaaataatcgtcccaaaagattgtccttagcttcctacaaaagaaaaatgaaaaaaaatgagtaaacaaattaacatcacaataggcagaaaaaatcagcagtaactaatcatcataattaccggtcccctcattgaagctgaatactctaacaaattaggtatcaacttcatgattgcttcgacgctgattgcatgaattgattcgagcacaactgcaagacccaatgcgaatccttgccttgcaaactgcaaaccaagttcccaagcataagatacgatctaactgtagcggatgaccaatgcaatacacaaagctaaacttcgtcatggaattggaaaagcatctctaacctctctagaagaagagataccgcgaatgagccgccgaatggcgtaacgcaccgacggcgcgcagttctccaggccatcgtccttctcggcctccatcctcgacgacccatctccaccctccgcttcgctctccccctccttccgcccacccttctcgtgcgccacctgcacctgcctgagctccgccacgagcgcctccgccgcggcctccctctgcgacgcctcaggcgaagccaggtccctgaacacgttcatgtgaagcccaggccccgacaccaccggaatcacaggcggaggagccacgggcgccgccgcagccgcagccgcagcctccggcgccacctccgccggctgcttcggcttagcggcagcggcgtccgattcagcggactggcggtgcctctccttgtcaatctccttccgctgcttcttccgctccatggccagcttcttcttcttcgctggcgcctccgcagccggggccgtcttggctgcggcctcctcctcctcggcggcggcggcggcttcgggctcggagagcgcggtcggcggcctcttcttcccggccattgctgcgccccccgcgaatctcaagctcagctcgaggcggcgatggctgcggagtagaagggtttatgccgaggcggcgatggctgcgaagcttggagccaaccaagcctagggtttctcctctccctctctttctcttcttttttttttcttttgtatacgtatagtcgaggaaccagaggcccaagaagcgacccacctatgcggcccaattcagcccatgtgccaggccggcccagttaggcccacatgccgggctagtatagtgatctcgatgacacgtggggtcgggaggttgacacgtgggggtgaggctgacgtctggggcccaccgaataaagcagaggaggggggaagagaaganaagggnaggtgcagcaa

SEQ ID NO: 19899 - DNA, 660 bp, Oryza sativa
  unsure (1)..(660): unsure at all n locations
aaaacaagctgaagttgagtaggcgagatcgagaagctcactaacacaaagggtgccgagtgagaatccgaggtcaagggaggacatgctgcttggagacgagaaaggagaaggactgaatctagaaggaccgcttgatctcaggctccaacgccgctttctccggtaaggtctgagaagaaaggcctacgcggcgtccgggaagagcgttgtgcacggggttccttctcctgtggtcgcgagcagcggcgtttggaagaaaacgagcgagccggcgtccagcaagcgggggggagatgccaagcaagccgnagtgaagggcggccgcgtgcggataaaatcaatattctcaaagatatatggttgtccgtatagaatagtagaaactgttcatttcatacaagagtgtacacgtcgattttatcagcattagtcagaaaataacctaactaatcactgtgcaccaatctaaaattcagggattagatgaaagagtaatctgcaatattatggtaacttcgacatatattttgacaaaatttatattagagcaagtacccataaaccataatagccttctgaacattaaatcacaacatgagaggacctgaactgtgatttgcagtcaggaaaaaccaatgatatgaattagtaaaaaga

SEQ ID NO: 19900 - DNA, 1501 bp, Oryza sativa
  unsure (1)..(1501): unsure at all n locations
tgtaaatatgtaatctatcattctaatgaagttcaacaagaatagtatgagatttattacaagaattgagcctcatgttccatcgttttgatttattaatttgctatggagaagaaaacaacattgttaaaatattataaagcaattaaagtggcaaccttggatcgatgagagcgcaaactattctgatttagattgtgtatattgttgaccatgagatgtacatgattctgatttaaattatgtatattattgatcatgagatgtgcatgccatttttcaatcccaggaaagcctaggtccaggaagaatcaagcggaagttcagggacatgcacttgggaatctgctgaagttttctctgacatgatacggtgagactgtctttctctgaacttcttctggaaagtgaagaagttttgtgccatgcttagatctgttcttgtgttagttggtactctcttcagccagtaaactagcagagacaacgcttccgtttgcttgtgaaatcaatttttaatctgcgtgaatcaataaaatgttatatcaaatatttttgtcaacaatacaaccaaatatctatgcatcgaagaatataagcaaaaaaaaaatgccttgaccatagtaatcatttttaatttccgtcataccattagtctatcccaagccctacagctttgatggagctgtttgatgaatcagcgagcataggcacctcttccttatgaaactcaacagatccaactgaacctatgtggcctgattcacattgcacccaaatttagaattgatagttgagcgtccatcattaacagaaagcatttaacaatcttatttgcacaggatgaggttcatctgaattacaaataaatgtgcatggcccctatggccctatgctgcaatatgacataggtagaaatcaacagaaagatatatccagctcattcaatctaccctatagcgatcaacagaaaggacataggtagaaatcaacagaagcttttggattatatccagctcatgatcaactcaccagattatattgatgaatcactggaaaaaatttcaccacatttccatgcatacaaatgttgggggataaattcaaggccaacagcagtctctataaggatcatgggctccgggcaagggttggtnanngcccgaccaacgcggataaaatcaatattctcaaagatatatggttgtccctatagaatagtagaaactgttcatttcatacaagagtgtacacgtcgattttatcagcattagtcagaaaataacctaactaatcactgtgcaccaatctaaaattcagggattagatgaaagagtaatctgcaatattatggtaacttcgacatatattttgacaaaatttatattagagcaagtacccataaaccataatagccttctgaacattaaatcacaacatgagaggacctgaactgtgatttgcagtcaggaaaaaccaatgatatgaattagtaaaaaga

SEQ ID NO: 19901 - DNA, 1501 bp, Oryza sativa
aaagagaacatgaaaaggaagagaggaaattcgttgtacctgcaggggtggaacagaggatggggggcagcttttggccttgatctgacgaggatcgtcaccaggggtgttggggtcgacggcgagcatgcggccttgaataatcaaataatacacttgatccacctgcataacgatgaggcaaccaaggccatgatcctctcctcgagatctaatcagttcgtccaatactcatagcaaccgttgcaacagagcatgagccatcataatcacacaaaaaaaaacaccttcaaactgtggcactgagtggcgacgctagagggttcgaggagtcgccatggtggacgatgggtttggcgctggggatctcgcggcgtgattttcgggtgggtacgagaaagaggagggggagagggggcaacgggagggggagcgatctgggcgctgatggggttggaagagcggcgaatacagaggtgggaggaggagaagatcaggagcgttggatctcatacgaataatctgaaccctagagtgatgaatgaaagaatgagtgaaagtatttgttgaactatagggtagatagatagaaccgatacagggtgtgtcaatttcattgaatactagtaatctgtctgtgttaacactacagtgacatttagaaacacaatttaagatagatagacatagttattattttgttaattaaattgccacatgcgtaaataacatagttattaaccatgtccaaatggggtcattagcgacaacatagcaaatattcggatttttttattttaaaattttattaatagacatttccgaaaaatatttccgaaaactgaaatttttggccacgccagccaagtagctagtgtggtagcgttgttttgccacgccagcctcttgccactgccacgccgactgtgtgtgacatgacaaagtgatttggccacgcccaggtttaccttaccgtttttggggaggttaccccccaacggtaaccgctaaaaaccgtgtgaatttcatctcgaaaaaattgaattaaaaaattggcggtttcgcggtttggtcgcggtttgacgcggtaaccgcgatattgcagaaaacatgaaaaaaaatgaaaaatactaaaaaataaaaaaaacacttaaatgcgtgtagaaagtagggataattagaataatatatatgatacttgcaaacctaacttgtggatgtaaaataaaaaatgaagcccaatacattttttttgtttttccatttcctaaacaattatcggttttgccctcaaatttgattttatcttactctttgtttttttaaaaaaatcaccatctagcattaaaaaccaagaactgtatccatgattttttttttgcttttttcgtttttttttggaatttttgaatttgctcaaatttcacccaaaccttaccgccggtaacccttaccgtacccccgcggtaagcaccgtggtaaccacgcagttaccggcggt

SEQ ID NO: 19902 - DNA, 1501 bp, Oryza sativa
gatgaacaacaagtcgcctccctagcacatctcgaagacctatggggtctccctccccctgacaatgctctcaccccacggatctggcgcaccatcttactagccacggtttggaacatctggaaacgccacaacaacaagatcttcaactccattgatgaagcccactcggtagttcttcatcgttgcgccaacgatatcgaattgtggtcaaaccgatgtatcgacgttgtaggcaaacaacaacttcactcttgggcgctaaatctttctgtaattaaccactaatttttagtttcttccctccgtccctctgtacctccccctttgtaaagtttttttttaccatatgaataaagttcaggctggtgttcaaacccgccgtagtttcccttaaaaaaaagatgacgtatgatatctaaagacaatacatacgtaatgcatatataaaattagatttttgtttttttatcggctcataagctagctcctattatttcagctattttgtcgtttcgcatatcaacgaaatttcactgcatgattttttcatctttttgtgtaccataagctacctcctgtatttttcagctattacaatgtttttggagattaacaattatcatgtttatcatcacggtttaattctcccatgtatgtgtagtagcacaaatagttaaacactatctagattttagttaagcggatatgccaatgtgtagcagaatagtttaaagcactatccacctatcgaataaggtgggcaaattgctttcttttccaatgtactcatgtaactcatcatgcatgtcgaatattcagtttgatcatttcagattccatagagaatgtatggatttttttaaaaaaattttagacatttttatttttttaattttattaatagacattttcgaaaaatattttcaaatgtcacatcctgatttttgtttcaggatttataaattatttaataaattcttaatagaatttatattaaatgttcattaatttacaagtgaagttaaatgtgggaaataaaatttcctaaatataaagcatggatggatttaattttttattaaattctccatggttaattatactctctggaatattctcggattttttggagctcaattcctaatttttaatcatacaaagagcatttcagtgattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagcccagataaagtctgtttgacctccctatcgctacagtactccatcttcctcctccagacagagccgagccagccgtgctcgtgcacagt

SEQ ID NO: 19903 - DNA, 1501 bp, Oryza sativa
tattcaagatgaaacaatgttcatggtatattgacactctctaaggcatgttcctttttacagtgatttttgacaggtctgaactttcttgtatgtgtatcagtagtaaaaacttgagaaatctgtttgatgttcctgctactggtttcacactttcagctacattttttacaactaatctgagctagcgcaggaactcccgatgttatcagctacctcctggaccatcagcctgacgaccaccggagccgccgctccggagcctgacctcgccgtcaccgacatcgacggcaatgccgggacgacgtcgaggcactcctggaagtcggcgtcgcaggacagaagcacccactcgtggtcgtcgtccaggtacttgacgtcgaaggcgccggcgtccaggctcagccgcttggccaccaccgccttcaccgccgcgacgccggctgagcacggcaccctgaacctgatgatgtcacctctgtggctggccttgatggtgaccacgccgtcgccattgccgcacctcggaggttttcgcaatgcagttttggcgtgagatggcggcgcctggcatgatccatgggaggaggtctctcctacggtacttgacaggcatggccgcggtggcggcggcggcggagggagaagaagagctgggtgagcaggcatggccaccggcggcgacggcgagcagttcacggattccatgacgcgcttcatcttgtcgagggagcggttcaccttgctgatcttgcgaaatggccaccttgggatgccatgctgcctgcagatgcgtttcattgttgttgggcatactgcaaaacaagaggataaaactgtcacctggtgatccaactttcagtggttgcgtgttaatttgcgcataaacatcaggattttgatgaagataatccactgaatatccagctgattcatttaactcatcaattatcatgatgattatatgcaggttgttggcaagtgtgatgttgtcttaccaccgaggcttcttgcagcatccttcaagctaccagagaagtgtttctgcagctcctccaaagtgacagatttctcagcttttcctcttttcgtcttgttcttgccaacttgtgatgtaggatcctcatttctgatttgatctgcattgtgaatgttaagctcaccaatgtttgtgttctccagcagctgcagatcctcctcgtccgagcatctttgatcatctccaagatcatccatttcatgccttagttggtgatcaccatctgccatagtatccaagaacaaatcatccaagttgctgatcacaatggctttcaggttgccggagcattgcttgatcgtggcggagacggcgtccaccgccgccttctgctccgcgacgccggtgcagtccggcgggaggaagagctccagcacgacgcagtcctcttcgtcgccggcggtggcggcggcggcgtccgccatggccgccgcgctgagctcagcgcgtagcacgaggcat

SEQ ID NO: 19904 - DNA, 1501 bp, Oryza sativa
ttaatttaaaaatatactgccttctttttttaaataaatgtcactgttaacttttagtcacacatttgatcattcgtcttattcaaaaaatttatgtaattacataatttatgttgttgtgacttgttttatcactcaaagtactttaagtatgatttatattttatacatttacataaaatttttaaaaatataaatggtaaaaaatgtgattaaaagtgaacggcgttatctattaaaaacaaatggagtatataattattatttattttcttgtgacttagtttatcactaaagatatttacacataataatttctaaacatgataaatgaaaatagaatgcagagtctgcaatacgggagagagctccaatgccaacagtaatagcctagcaacggtgacagatttgtctagcctccgacatattgtagcacacgctactgtagcgatgtaatctgaaccgttagattgtgatcgtgtggttggaagtttctcagaatgcacacaacggaacgaagcagtcacgctcgtgcgatgaagatcggacgacgcagctgcgctcgagccacgtcaaaggatctagctagtactacgagccatgcgtaaaaaaaaaagaaggaaaaaataaggcgtgcgactagagacacacgaaacgcgagtacgccgacgccgcgacgcgtcctttcgtttcgctcccctcctccccccgatctccgccgccgccgccgccgccgccttccgatctccgcctccctcccctccggatccccgcgctcgccgtcgacgcgctccctctcctccgcccctgcgtctcggcccacggtgaggtgccctccctcctctccgcaaggtctctgtgcggatcctcctcttcttccctcccgccctcgtacgccgcgcgctagggttagtcaggattcggtttggggggagagtttgcgtggttagcgtagcaaaactagcaataggagatttacgcagtgacgcctcttaatcctcgcgtttctgtgggatgttttgctgttgggataaacgagcaatcgagatttgttcatatttcgtcaaataaattattattactttttgaatctgctcgtgatgtgcgttgcgcttgggttattcggagatgaatcatcctgcttgtgtaaacagctgatagcattttggggaattaaggtctgccttgcaatgctcataaaaaaatactaatcatgttggtttttcagtatttttctaactctggctagcatatcaactcctgctactttatttgctgcacaacatattagttccttataatgtgcttctctgtttgatgcgtctgttgcgtggcaccgtagctgcacatgtgaaagacacgccgtttatatttttcatctacttgatctgtaccccatctgatcttagcttctctattcctatcaaataggttacctgaggtgaatacattggagttggctgggatacttctgatttgaggagattataaattggaacaa

SEQ ID NO: 19905 - DNA, 660 bp, Oryza sativa
agttggtatgtcagtcccggtcaaatccattccaagcttcagcgcaagcatggcaaggaagtcgctggccattgaatgaaggttgaaatgggcgtccaccggaaaagctggcgagcggggcagaaggcgtgggctctgcttgtcagaggtcacttccggctgtagactagccctcattgtaaaaagcatgtttcctttcttaggcagctggaggcccatgtggtgacccctgaccagataaaaaggaggcccaggcctaggaggaaggaaaaagggggagaaagaggaaaaaaagaggaagaggagttgggactctggcgaatgggtgctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtaggggcgcgcgtgtctttctaagccctcgtcctctttcgtgtgcgccaagcttctcccgctcagcccaa

SEQ ID NO: 19906 - DNA, 578 bp, Oryza sativa
ccatatgaatgtgggcaatgctagaatgacttacattatgaaacggaggaagtattaattggtcacttttgatacactaaagtgatttctatagaatatggtagtggcctgttttggcctttctgtatctctttctaaaatcaacaacacctaaatagtcatttgctgaatctgctctagtacaatttgctatttttagcatatagttggttaagacaagaaatgttcttttgttgggtatgattatcatttctgtcactactttgttctgccttttagttccagttaactttatctttggttaaatctttctgttttgttatcatgttctttttcccaacacgtctagtcacactcgtagcatgtgtgatactaactgttattttggttcaactaagcatttaagcataatgtgctctcatatgcattttatgcaaaaatatcttgcgtactgaggtaccaacctttgagtacatgagctactagctggtaggctgaaggtgcaaattcaaataatgtttctcagaagcatctgctctcctataacaggcaatccgacatgcaacttaacattctct

SEQ ID NO: 19907 - DNA, 439 bp, Oryza sativa
ttgtacaacaggctggagaagctgcacatcttataaggatcactcatctggcccaagtccaacagccagctcctgcgataatgaaatctgagttacaaaccagatgtcccaacccactgacgtatcactacccttgagaggatgtcaactgcgactaatagactatcacattgtgtcagattctgctaaattgtccttagtcttgcctatgttctccccccaaaattaaaccgcagacctaatggattagaatagagcccatactttgtcatcgcacatggcaaagataaacagccatgccctacaaaatgtgtcatggatgggggtgacaaaagatgatagctcaatagctgatgctactcctgaggagttaagcagacattgatgtcaggtgaaggcctgtgccccatggactgtgagctgactggccacccaacca

SEQ ID NO: 19908 - DNA, 328 bp, Oryza sativa
ttggccacctggcctagtcccacgccaaccaatccttcctccgcccaaggtatactagctgctgcttctactctgcttcagctgaaattgctgaaaaaacatctgccgttttctttaccctgaactccccaagtcctggatttcacgagatctagctaagaacagagccaagaattgattgctctctgtggctagatcagttaactgttcatcctgagaggctgagacagagtcatttactctgaatttgttcttcagttagtgtctcggtgaagtctcatggtgatgagatttaatagttagtctctgcaagaagacaatctaagtt

SEQ ID NO: 19909 - DNA, 1501 bp, Oryza sativa
ctgatgtctaatgaacttgggacagatgtgtatagttaatgttgctgtatctgatactacttccatccattactcacggtcatgtctatagcactaagcatcctgtaggcctttacgcgtcttcctgacagttagcgtgatctacagaacccgtgcctgcagggaaggctgcaattaacgatgcttcttgctgttttgcattattacaatcttgatcaccgttgtttcggggtgcaaacaccaaaccataagcctggaggcacagacaataaaacaattagtacctgcatgtgaagatgcatgatcgacagctacctagaagtatagcgcaacaatgtacagtccatcgacaaaagtaaatcgtaacacctgagcacattgaaaaacatactccccgtgtaacaacaacgtgcgtgcaaggagagcccaaggccaagccaaggagaggagacgcgcaagctgagaaacacacacacacccgtacacctccacacagtgcacaagtgtgttgcgagcaaaagcctcgcggagtcccggggaaaacgacgccacacactgctccggtattcccctctccatccatccatccatccacctacgcaaacgcaaacgcaaacgccaacgccaacgcgagcgaccaccctggcctggctgactccctccacacttttgaatttgaaaagtgcatcaccctctccctccctccctcccacatctccctccattttcctcctcgccctcgcctctgctctcgccgccgtgcgtgcgtgtgctactagtagtggacacccgtactacgctactcctccccgcgcggtcgagccaggtcaggtcaggtcacgcccccacacgtcgccacccgggtcggttcgtaagttcgttccccgcacccaccacccggtccatccacctcccccccacaactatcccaccaccgctccacgtctccccacgcgggtcgggcgcaaccgaccggacccgaactccgcttccacagcgcggcacggaccgaccgaccgacgcgagccaggctcgggtgcgagcctctcgctcgtgcggttcacttctttccttttcgcctcgctccccttcccttcccttctcttcccttctcctgtgtcatctcctcttcccccatctcctctcctccgcctcctcgccttccgccgccgccgccgccaccgccgccgcgtagggttgcgaccacgcgaggggctgccggcggatgaatccaatcatcgggtagggttccgctcgtcgcgcggggatctcgccgcggaatcgggtggggggttgcgcgtttttccccttagctctctctccagattcgtagcccgcgagtgtgcccggcttcgcatctgcgtcgggcggcgcctcgggtcccggtggatgagccccgccggaatctcgactccgggctcgtgatctcgcgatgcgggggctttctgtagccgcactcgcttagggttttcgggggtgtccgagaatatggaggagccca

SEQ ID NO: 19910 - DNA, 1501 bp, Oryza sativa
caccgctctgctctgatctgtagtagcttagcctgtattgccaaggtgatatgctatcttggtatttcatacagagaggttatgaggtgagcatatctagctaggagctccagcaatgaatgatgtaaatatataattctactacaatccgcgagaaacgtgactgtttcgattcaaggggagcattgtgagtagctgtgactgtttcagagcatgtgcattatttcagctgctgcctctggatagaacgcatagttggccagttgggatcgtttctgcccgatcttacacgtttgtctgatgatgaatggagccagcacgtttgtctgtcacggcacgctgccgtagtgctgccccatcttgccggcatcctgtcccggttgacgcaattctgtaattcactgcagccgactaccaagtttagttgtagagttatggattttggtctgcactgtaagatgggcactactggttacttcagctaacaagtactacttgtgtataggctgggtttaatataaatctattatctaaaaaacaagtactactggttctggtctgtttttatacttgttacttcagctaacaagagatgtctagttgtagtgaaatatatattccctccacctaaatttttcttactattttattttcctatttgtaatttctatgtatccaagacttgaatgaagagagtatatctttgtttagcaacaatgaattaagtttatttcggaaccgaccagccatcctccaacagtccaacaccattgcatgtatgctgagaattttgctaaatatggagtattaatcggatgaggtagtttcttcttggtcttagtaattaaagaaatacgaagaagacttttagatcaaggtagtatattacatcagttgttgggaacttaaggttccttcgaagcacaatattaagaaaacagaaaaaggggataaatataagattatgatagaaatttaattacaaaacatattatgattataaagtacataaataattatttaattgaaccgtgaaaagaacaacagaaattgaatgaggctcgtaagaaagagaaattttgctatttgtcactcttaaaatgacaattaagtatttatcactgaatccacatatcatgaatatataagaattccacgagttataagttactctctccatacttataaaggaagtcgtttaggacaatgtttaagtcaaaccttgggaatataaatcatgaataacacttaagttgttgagtttgaaaatataaaaattatatgaatagatttgtcttgaaaaatactttcataaaagtatacatatatcacttttcaataaatatttttatagaaaaaagaagtcaaagttgtgttttggagaccgtgtcgctgttataaacgactttacgagtacggagggattacgagtgataaattcttaagtgcaataagaatttcttcatgaagttggaccaatagcgtagagcttggcgtcatg

SEQ ID NO: 19911 - DNA, 1501 bp, Oryza sativa
ccacaaagcttcgatgtggcatatgaacaattgaaacaggatgcattcctcatccacaggaagggagatgatttgagcatgttaagctccacagcttagaaggttgtgagcataaaaatcaaaacacatttgatgcagtgatttataaggtaaccaatttacatatatgtaaggaaatggagatcagagttgcttaaaaagaacaaattaactagtcgaaatagcgtgaaggcaataacacaagagaagtaactagtatataccttgctcaataacaaatgagccccacatgaaggatcattagagaaaggaagtacacgattagagttttgaactgcatcgatcaaaagtaatacaactgcccaagcatttcaggaaagtggctgaggtaccttctgaatgctcatggtatcaacagaaagataaacagcagagcaagtaaaaatagcaaaggccagcatctatgctcttctccttataattatcatgggcagagtgattaagtcagattttagaccaacaaaaatgctataccctcaaggtcaaacttaataaattaagaagttggatccaaggtgcaatcaagatttgctatcagtagaatctgtcactgccaacgacatcagaaagacacggacaccagagcttctgacgactatacaagccaaaaactaaatggacgtgtcggaaggaacttagaacacatgagataaatttgacctaatgaattaatataataaaaagggacacaaaggtttgagctccaaacacgaaataggagaagtgcaccttcgtgaagcaagcaacagctaaaacctatcctgtgaaattgcatggtcagaatagccatagcccaccacaattgacaattctacagaataattcttttgccatggcacggtaagaatatattcaagcacttggaaagcacaagcagagcgggagaaaagatcatcctgttgcaaaataccaacaccagaagccacctaacagacagaaccaccaggaagcaaaattggaataaagcatcaaccaaatccacttgaaggcgagtgtttttatataaaaaataagagcaattctacggtccttgaggaccatgagatactaaaattttagtgtaaaatttggtatctcatggtaccttatagtacctaggtaccaagaggtaccaaatttacaatagaaaaaaggtacctcatggtatctcttcaaggaccgtaaaattgctcataaaataaacaaagagaaattttggataagaatagagctgcgcgatccttgtatccaagaatgaaaaacagtgtggcttttagcgaagaaacacacaagacaactattcttcgaaccaagaacccatcaaaatcataccggaaataagctttgcacattgtgaatgggaaagtgcatattttccctacaaggcccactaccacatcatgctacaaattgctcgagctagaaggggttgctccaattgctaatagcatcaaagaaaagc

SEQ ID NO: 19912 - DNA, 1501 bp, Oryza sativa
ctcgattccttttataaaaaaaaaacgtcggaactaactaatccaattccgaataaattcgactggaattcatgttgattcaaaaccggccaagggtaagctccaaagcccggcctgtgccaaaaggattttgcaagaacagtgcctccatattgtttgtcggtggttgatttttgcttacaagcaacaaatgctgacgagagagattgattatttcagctgcaaatcaactggccagctggttaatttcacaatgccatcaccttagccatcagcaagctccagcacattcataattcagtgtcaagtacaagctagttgctgacctgaacaagttctcttcttctttcttcagcttcagcttgtgttgtccctgtcaatttacctaccatcacatatgaccgataacttgtaattcatcctgcaatcactctcccattaaaactcaatcatccatgaacaagtcaattattacccaatcaatttcacatctcacacaagtacaaaccctgcttgcctttagaaaatttcacaaaggacaacacattcatcatgccaaattgcaattgggcaaaattcctagtcccaaccactgatggctgggtcccgcgtcgcggataccatctgatcaagatccgacggtcgacgatgtgctgaccattcttcagttcttccctacaggaaacagaaggaagcttctagtgttcctactagcatatcactccatgtttctgacaggctcacatatgagatggcaggtagaagtagttgtcatcagtgacaaattagcaacgcaacgcagttcgtcgaaagagacagatttgactaaggccgagcagatcagccaaaccttcgttggccaaaaaattctctctttttctgatatatcatcatgccaatcagactatgaatttggcttgctgtgatccggtcagagcaggaaggaagctcatctcttcccaaaccaaaggattcacaagagaaaggaactgacaaagttgaaatatttccattgcttatgcaatgccaccatgacaggtagttgtggtaggcaatggccaatggtggtccatttcattctcattgtgttagttgaatccagggagaatcctggtcctgttcatggcctatttatcccccaattatggcactaatcatctgccaaactgaacatggaacctttgatccactgttctagcatcaatgactgatcactctactaatttgttgtgcaatgactaatgagacaatggaagatcaaatgtagttcgtttatatgttgaaaatcgtggttcatttgcagaggaaaggtcaattttggcatggtttggtagaggcaatgtactggatgaaatgaattgaattgatacaatgaagaaggcataggagaatacagtttgcccccctggcattagagggaggtacactcacatttgatacttactagtaatccacaattttgtatcttgacatttacttgtaaataaacaaccaattaata

SEQ ID NO: 19913 - DNA, 1501 bp, Oryza sativa
agtaatttataccctttgtgattattaattggttgtttatttacaagtaaatgtcaagatacaaaattgtggattactagtaagtatcaaatgtgagtgtacctccctctaatgccaggggggcaaactgtattctcctatgccttcttcattgtatcaattcaattcatttcatccagtacattgcctctaccaaaccatgccaaaattgacctttcctctgcaaatgaaccacgattttcaacatataaacgaactacatttgatcttccattgtctcattagtcattgcacaacaaattagtagagtgatcagtcattgatgctagaacagtggatcaaaggttccatgttcagtttggcagatgattagtgccataattgggggataaataggccatgaacaggaccaggattctccctggattcaactaacacaatgagaatgaaatggaccaccattggccattgcctaccacaactacctgtcatggtggcattgcataagcaatggaaatatttcaactttgtcagttcctttctcttgtgaatcctttggtttgggaagagatgagcttccttcctgctctgaccggatcacagcaagccaaattcatagtctgattggcatgatgatatatcagaaaaagagagaattttttggccaacgaaggtttggctgatctgctcggccttagtcaaatctgtctctttcgacgaactgcgttgcgttgctaatttgtcactgatgacaactacttctacctgccatctcatatgtgagcctgtcagaaacatggagtgatatgctagtaggaacactagaagcttccttctgtttcctgtagggaagaactgaagaatggtcagcacatcgtcgaccgtcggatcttgatcagatggtatccgcgacgcgggacccagccatcagtggttgggactaggaattttgcccaattgcaatttggcatgatgaatgtgttgtcctttgtgaaattttctaaaggcaagcagggtttgtacttgtgtgagatgtgaaattgattgggtaataattgacttgttcatggatgattgagttttaatgggagagtgattgcaggatgaattacaagttatcggtcatatgtgatggtaggtaaattgacagggacaacacaagctgaagctgaagaaagaagaagagaacttgttcaggtcagcaactagcttgtacttgacactgaattatgaatgtgctggagcttgctgatggctaaggtgatggcattgtgaaattaaccagctggccagttgatttgcagctgaaataatcaatctctctcgtcagcatttgttgcttgtaagcaaaaatcaaccaccgacaaacaatatggaggcactgttcttgcaaaatccttttggcacaggccgggctttggagcttacccttggccggttttgaatcaacatgaattccagtcgaatttattcggaattggattagttagttccgacgttt

SEQ ID NO: 19914 - DNA, 227 bp, Oryza sativa
gccagagaaggaggaagccggcgagcgcggcagctccactccgtcggctgcttcggccgccccgcgctccgcccgcgatgcccagcagaaaagaggatgaggcagcgggaaacattgtgtttatctgcatgataaacaacaattgtttatccttatatttcatcttgctagtgggaatttgatcctgacagtttagctttgaccatcaaatcaattgttgtttcagc

SEQ ID NO: 19915 - DNA, 1501 bp, Oryza sativa
ttctgaaagttcactctctctttttttccctgaaaatatggaagtaaatttgggaaattatgtgggtgtagggagaaacccagatgaagataatgaccacatatatatctagaagttttggtaattctaaaatttttcacactaaaagatcatatcagaatttggtaaggcttaaaatcaaatgtatccaacctactaaaatttaataacactaaaatgtattaaatcatgattatggttcaaaggtgaataagtccttataattataaaattataagggtgatcaacaaacatattgttggtcagaaaacagaaaaccacttgggccacacgtgcgggctgcactgaggaagtagtttcctctttttctcaatctcaggaccaagttgtagagaagatatagattaaaagttgcattaaaccaggatcacactaacaaactacgtcatgtactcctcatcaaacacgataagactcttcatcaaacacgataagactcttctaacataactactccctacgtcccattttaagtgcaacaataaatttccacgcttaacttttagtccgtattattttttataattagtatttttattattatgatatgataaatcatgaatagtactttatacgtgacttatgcttttaatatttttaaaaagtttttcaaataagatggacggataaagttgtgcatggaaaatcatggctgcacttaaaatgtgattgaggagtatatactttctccatctaaaaaacttaatctagatgaagatgtcaccctcatactataacaaatctggacaaccactatccaatttcattagaggtggtgtttgaatctcctgaagataaaaataaagataaagattaagtgtttaacgtaaaacgaggtcgtaataacgtgtgatttatttagttttaattattacaaacttgaaaaatagattagtctgatattttagagcaactttcatatagaaagttttcacacgaaacacaccgtttagtagtttaaaaagcatgtcacgaatatccaaaatttaatcctgtgcttacaatagaaacgaataagacctaaacatcatagattaagttttttttttaagtacggagggtctaagtcagatagacgtgtgtctctaaccccgcaggattcacctcagtttctcgccaaggcatgattatccagtcaaagtataatactcgtccctaatcgattttaaatcgaactactactactccgcaaaaacaaggctcaattagtagcaaaatgtttatcaggtaggcagcctactatgccacctaacctaccgtcgccacccttcctcttcttttttttttttgaacggtcacccttcctattctcaaccaacgtagaacaaacttaaaccaccttgatcgcattcgcattccatcgccatcgatcgatcgcctcctccgcacgcgcaacggcaagccggcgagctatatatactacatgccactactagcacca

SEQ ID NO: 19916 - DNA, 761 bp, Oryza sativa
actcagggaacgtgtgtaatctatctaaggctaagacaatccaaggataacaacgataggtaggctaggcaggctagagaggactttctatgtgttttaattatctaagctaagcaaaggtaatttcctatctgttgcttcgggcactgacccctcttggtctgcccgcgtggttccgactatagctctatgatgtatccgaacgtggaggattactgggtcgggattcagggcaggcaccacctgccgcctacctctgacaaatccgtgggatacacagcaaactaaagtaatctctaacctagacaccacgtctaagttattaattactactctaatacttgtacaggaacttccttctttatccagagtcctagtactagagcacttagtatgaatactaaacaatgaacccgcaaagatggaaatatatcttacttagactaagcaactaaataacataagaaaggaacacgaatgcttactttatagaagaagttctccgaacccggagcagagtctaccgacagcttcggtactcctcccgaattccttctacgaagctacacttgtcaaggtagaagtcggatgagcaccaaacttccgggcactcctccagagcttcccctcactcgctaccttattctaatatgcaaaagatacaatagagcctcttgtaattcagctcaaagttttgtgttgtgaatgaatgagaggagctctctttatagcctccatatgacggttacaagtatgggaaa

SEQ ID NO: 19917 - DNA, 1430 bp, Oryza sativa
cacatttgttcagcttggaacgtggaattggtactggagttattgtacactgctccttggttgtcattttattccgtgcaaaagttaagtggacaacaaatatcagagggactacaaagaattggaaagattttatcatagctcaagattaattgttcacttccgcgctaaaatggaattggattcaaaacttaagaagcgtggatccctcaaatttgccataattttattttgtcattttttttagagacatttcttcttccttttttttcttgaaaacattttttttcaaaatttttattgttcaccaaattttcggtaagcaaaaactcatacggggcttaagataaaattacacgatcataacaaaagagaagtatacttactgtgcaccttgaaaggtgatgtgttacttctttgcttgttgcaatttatcgattagtttcctgggccctgacttaccttcagtgtgaattgaacttgaggactcacccatgaatttgaaaaccttcctgcaggggttagtccacagaagatatatatccaatgtccatgaacatattaactctaaaagttcattaatcaaactcgactcagttctaattcaatgaattgtaatggtatatttcaaaatgggtaaatttataatggcatggatccaattaaccctaatatatatgtgtttgataggcataggatacctaacaatttttattttttccctcgcactggacacacacgtcacgcaacacacgcaaatagagccacacatttgcccacgacatgaggagtagcacatagtggttgttgatactggtcaatatttttgcgctagagatgtggagtggatcaagtgcgcttcatactgtactacagtggcataacatacgcctccataaatccataatatattggcatagaggatcgatttcttcaaagatttataggccagctggccagggaacatgattagtggaagaaaattatacaggactgaggtccttccctcacatgaaatactttgtcttcctgcacgacacctgtccagcacaaattacaaagcatgcagcatctttcttttctccaatccccattctgttcttcaatatgctcggcaagacggaactaccactgtaggcatggcagcggctgccggcttcgagctaccaccaggaacgtgcttggccagtagacaagtaggagtagatggttaaatgttagaatggttagatgttgctcttgttactttaatttcaatctccattacagataatcattggtggttattgaatttatccaatcctttgaggattctttccgataacaagctttgctcgattacaagctgacagcccttctcaacaagaggcttggtgctgcaaatgataattagattgtattatcactgttatgtgaactcttgaataaga

SEQ ID NO: 19918 - DNA, 173 bp, Oryza sativa
actttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaa

SEQ ID NO: 19919 - DNA, 276 bp, Oryza sativa
aatgatttataactgagataaaagattaaaacatcctccggaaaagattaaataatatttggtagttgacatatgataataaggactaatatgccattgaaaagagagaacatatttatattgattttggacggctgagattaattttgacatagagttggccaagagccaacggattagattgaatctgatctagggtttagatagacatggcacggcagagacaaataggcggttaggtggcagtagataagacaaccacacgatatcaccgga

SEQ ID NO: 19920 - DNA, 1449 bp, Oryza sativa
aatccaatatgtccaaaaatcatgttttggtgctttttgaactttttcattccggtcaaaaacatcgcacccgtgtgggccaatattggcattaatggacaaaagtttgctgcgcgaatcacgaagtgagtttttgccacgaacgcacccaatacactccaatatgtcgaaaaatcatttttggttctttttgaactttttcattccggtcaaaaacatcgcacccgtgcgggcattatatgccaatattggcattcgaataaccgtgtccgcggttatgggcaggtctaacaatgtctatcgtgattagtctcacacttctcaccataataaatgatgctataactggtaataatttgattagctcctggtttagaatggtacattcctagtttggagatagatctgtacagccgggtttggttgttcaggatggttgggcctgtgcagcatgggtgtgttgttcagtgttgattagtattgatgattaattactctactgttttacaattctcaaatgtttcctaaatgctgcttttgcaaatgagccctatattatgccttcctttggtatccttgtgcacttgcatatttgttgcgtggcttgcggagtattccatgtactcaccttgcaataatcaatcaaacctcagttgaagacaagtcgcaaaggagaagacttttggcttataccccagttgagctgcctgtgggagtggagccggagcttcgctagaccgtaattccgctgctgttctcttctcttttgtaagtatttaacattattattatgatgaatctgtatattaaattgtcagtttgtgtacctcggctgattactggacgacgattttatgcacaaattagttcggaaattactaatgaatttctgggcgtgacaagttggtatcagagtcatctcgactgtaggataagccaaatggccaaaccttcaggactgattttccgaaaacatgatttgtgaaaatttttcctttcttccttctctagaattctttgcgaattgttttatcgtcctttccccttcctttttcaacttgagtagttctgaaactagttgttgaaacatgaagacgccaatgtggtctacttatcaagtggatcgaggaatatgaaggtgatgatcgatctgaagtgtccaggtgtatagatggaatgaagtttggatcctaccttagaacctaaaccaccaaagtgactttgaagaatagttagtagggtagagcgtctgttgcttgcttgtgtgtaggtatggttgcatttccatcattggtgtagatcggtgatgagcgtgtaactataataggttgcttgcttaatcaacttgaacaatataatggtctacacacaccagatcagtggtaacctggttaaggtcttgtctttagtgtaacccctatccttctatcttctctaatctgcaacaga

SEQ ID NO: 19921 - DNA, 1501 bp, Oryza sativa
agccagggtgtcccattccaccttgtggttgcactttgattatgtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgattcaggagaaatcagcatatgcccctagaggcgcccggaccccccttatatatgggaaggagtccgggttacaaaagataatctatattcctaacggaatatgaagatacaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagagtatggtgcatcgaatagatgcacctaattaggtgtagcccccaactatgtgattagttaacaaactaaacatatagttgaaagacaaaataacaacactattgtgcattatatgacaaaagcgtacgcggcgcctaaataggcatgctagccgactgctttttatccacaataaaagaaatccgagtggtttacactctaaaaggttcacgaatgaacacactggacaggcatccgaatataaaactctaaagattacccaccaagtattataaaaattatggtaatgaataagtctaaatagcctaggctatgactatttaccataacaaaaataggtatataacataccaaggaagtgactatgataaaaacaagtcatcccaaattaacccagacagcttttgtagcctaataaagctaacaaaaagcagtataacacctttctgtcgggcaccttttaatttgcattgcaataattccaaagaattatatgaccgcataaaaaggatttttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgccgccggcgaactagggttctcaactccggccaaatccacctccgaaaagtgcatcaaaatccctcccgtgatccaccgcctcaatccctcacctctcccaagccatccctcaaatcaaatcaacacatttgagtgaaaccaa

SEQ ID NO: 19922 - DNA, 1501 bp, Oryza sativa
tgatcggctatgaataaaatgattacaagaaggagtcatggtgagtggtttacccttgagaagtgagacggggtagcaggagttggaggagtttgcttgggtgaagccgatggggttttatctccttcatcactcaattcggctgctgctgatcgacatcttcttcgatttcctcttcatccaaggtagatggatctaaggcaggcaagtcatcggctggcttgggtttattcttcttggttttctttttgggaaccagagccgatggatcaatagccgatgacttggtctttctcttcctaccaacatcggcaggttctctcatctgcccttgaagtagacttgaggtcctggggcatggtagccgatgactggaagagctaatccacctccatttggtagaaggcctggagcatatattatgtccctaccgctattgctcttgcgaggaggagaagattctgttgtctacaaggtaaagagagaagttagtcaagattcaagttagctaacaattattcaaacaaaattgataaactaaagatgtacctgagggacaacatcaggaaataggtctgtcatgtacatagaagccgactgatggaatatatgttgcttccattcaacccaccatctgtcaaagttcctactcttgaaccttgccagttctatgttctcgatactgcccaaaggaggtcctgggatgttaagcaaccgatccattatcaatgttgatgagatttctcctctgcactagatcttatcggcaaagaacaagccgattggtagctgccccatttcaaattgcctagctgagctcatcggatggtagaactcataggacacttgtatatttctcccttggtggatgccaacaggaaggatgcaaggactaatagcagccgagaagacttctctggatttgtcaaatttctcggagtcgatatcctcaaatctgaagtttgctgggaggtcaaagttcactgaatcctcatatgggaaccaaacccgagcatctctctggaatccctcatagaaactgcagaaccagtctttgagtagtttggctgatagctttgctccagaatcggctggtgtcgatgcagcttctccatacgacatgcatcggcgatgggtgacctcttctccatcatcattggtagtgggctccagccgtgggaattctacatctgtcagaggtggccgattcacaaccttcataacaacaaggttgagccatgtttgcaacaaccaccacggtccacccgcgcccactactgaacctgtggctatcttggccgatgcattgctcaacatttggtatagatagccgagaaggattttgcccaggggaaactacctcttagtctcaagggcttcagctaagaattgccaattggtggtagggccacagcttgatccgcaaaagaggaatttctcaagccacatcagaagaaaagatgtgtgctccctgggagtgacagatcctttgcccatgtat

SEQ ID NO: 19923 - DNA, 1501 bp, Oryza sativa
taaattacattgttatgccatggtctccatgattcttttttgaactcggactcttctagataagctttttaatggttgattgtgctctttccttaaccgaatccactaaagaatcttaccaaattttggtgttaacacagctgtctggattttctttgactactacgcgcaccaccacgtcttcatgcagccactatcgccgctctaggccagtggtttagctgctgtagctcaagctaccgacatcactgttccaggttgttggtcctgctacctcgcattcgtctttgtctacttccgccggcgtggtattaacaacaccactgtgtgcattcaacctgagtcgtccttgagcctggcaaacccggcacgacgtcttgttctcgacagttcgatagcattagctcttcagcgtcatcttcctcaacgactgcggcaatagcctcatcgttgtaacagcctaccctccagaaccacgtagccaacccatcgaacgggcatacgcacttactctttcgtacttgctttgtgtaaaagagttaacccatgagtgatatggttggagggatagactcttataagttggttccaaccttgctaaattagtaaggtggtacttaacatgcgcacacagatctcatggaccacacatgccaaatcctaattgggctagtatgtcacacaccccctcaaagaacctgacatcccagtcggtccaactaacaaatataaccacacatgcatataggcaaatattcagtaacatgccccctcatagcgcacatccatacgttcagcgctggcgaccatgtgtgcaccttggtccttggcgctccttgcacatcgcggcttagcatcctcgctcatcatcggcacacgacatcgaccacgcttattctacgtatggcttcttcaaccacgctttctcacaccctttgcttcggctatattggctattgcacaaaggctattcaacatatttgttgagctttctccattcgcgttgctcacgcttggattttgtcaggatgtaaaaacatatgctagttagagttatatcttggtatgattatgcttccttatatgtaatcatttcttatttctaccaatatatgtcaatacaataaaacatgttgagtaggcacggtactctctcccctatattattgaacatctgggacgatgcggcaccgatgggcgcttcaccgccgccttctcatttgccatcggccgcaactccacgaacctgatggcatggcgtcctacactcatatatacttcaggccttcaatcatacggtcacaaaataattgtccttagggcactcgtgaagtcgaggggtcacaattctcgcgactcgtgagaaagtctgttgggacactgaataatatgagatgttgggatgtcaaacatcattataacaatatcatgtatccgaaatcccgtataacaaatactgaattcatgttttcatttgggtgtagctatatttatggcgcca

SEQ ID NO: 19924 - DNA, 1210 bp, Oryza sativa
tagataaagatgaaagtttcactatcaaacacaatatggtggggttccgattacaggcagacgggcgatttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatgtatacacagcccattgggccaaaagaggtgacgcagcaccatggacaaaaaatagttgggagtaaaatgacaattgcggccgctccagaatagatatggacatgtggctggatccatttgaaagtagacttgataagctttccatgaagtacttgcacgcccaaatcggagttcgcatgaagtcgtggcggccgttagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatttcctttcccataaataaaatagtagtaggtgcttggtctttatctttcctttcatgtaagcacttgctatgaataatgtggctcattggtgttaaccccaatgtttgccaaagtttgttttgtttcatgcttaataaagttcaggttttgaataagtgtgggggatatatcccagcctttgacatgcatatactcggaaaattgattaaatgtttgaacacctggaagcattgaactctgcagaaagttgcagaggtattgggcaccagagtggttcggccgagccagtgttggccccaatacctctcaattttcacaggtaagtaggtgagcacgtcttgtatctgtatatctccaccatggcatagtactagagctgaaaattcagaaaacaattggttcaagcataagtatcagataaaatttccaactaatgaaattcctcatgtgattgatcttagggttaattggatccatgccccttcaaatgtggcaaattaaaaatataccactactattcacgttatctgctagatgccattgta

SEQ ID NO: 19925 - DNA, 1501 bp, Oryza sativa
gagatatataaattttctcataactaaaagtgatgtaactcaaaaattccacatcatccaacttgttctttgtcttcttccgcatgacaatctctcaaaattttgaaattagtatacgtgtgcttacaactaaatttgattttttttgaaagaaaacttgtaaaattgaaatttaaacttgcatatttggggactaatatatcacatattattctatcttattaaaaatattttttaataattatttggaggacatgaaaaaaaacgagtggacatctctcgaggaattaaaggattatgttgtacttttgcattcctattacaaagatgataatgtggatgacatatagggaaagaaaaagataaagcagtgacatataaagcaatagcaactttttatggcattattgggataatttcgtttttgcccccactttgatttctaatattaattttgcccctactttttagggttttcgtttttgcccccacttttttttgaaccgaaagatacttttgcccctgttttggatggaggagttaacggtgttaaataggatatttatgccctctcccataactattcatcaattgtgtttttccccattatgcaatgactttggaaattttttttattgagtgaattacactttggactagttttaattacctaagttgcatactggactaggaacgtacaaccattttcactttgaaccaggttttgttactaaactatgcaatttggactagttgacccacatgtcagcctcagccattcatcttcctcttttattagtccctatcctgatcgggcagagctcatctcttccccagtaatgcagcagtagcagcctggcaggctgcacgaacattgagtggccgccggcatgtcctctgcagctcttccccgcatccctctctcttgaagatgaccgctcgtccgttccattggctgtgcccgctgcgtgggatgaaatggcgccaccgtcgacgaccgctccaccggctgacgcgatgtgcaagatggaatgggctctgtcattggcgttgccactgggagacgagtgcgggcgcccctcgagcttgactggtgaaggcacgtacaaccgtcgatccatcctcgggtaggagcttaatctcctcgcgttcagcttggcgctcgatcgatctcggtccatccattggccaacctgcgttcctcaagatcggacttcgattggaatcaacgccaagcaaatcacaccagcaaagcttcactcgtgctggactgctggccactgaccacgggcccaagatgagattgatgcattcgtcggtgaagacggagagatggaagaaaacactttctacatgacatgtgggccactagtccaagatgaaagttttggtaacttcatatatgtattaaaatgaaaacatgggatagcatccagtccattgtgcaacacaggtaagaaaaccaggaccaatatgcaatttactttttattttttgaata

SEQ ID NO: 19926 - DNA, 1268 bp, Oryza sativa
ccgtttcagttttatttccatctccgatgctgaaattaccaaatttggtcactaacacatgccccccaagtccagaatatttggtaatgtttcggatttgccatatccgttcctccaagaatatcgctcaatgccgtttttccgactgttaccgcctcgctttaaatactaaccatcgtccccgagaaatttcacaccattagctccgttttcactgcttaagccaacctcgtcttttctctctccggcgatcccctcagtgcaaaaggcgatctcaaggcgacttcccctccggctaaatcttccgcccgcagagatgtcgtcctccgctagcccgtccgtcgcaccatcggccaaatatgtggaggcaagtacgcatcggctagatcctctcctttcgcaatagattggtttttccttgcctcatcttgttttcttcttctctgttcttgtttatatctggagcacttgtccaatctggttacgatcccaagtctgtcacatgagcaccactattttcttggcccaatcggcaatctcgatcccactgaatttattatcgctaaaaccaataggatcccttttagattggccaacccgaatttaagtcactggaagaataccttcaaatcttggccttctcttgagaaaacttcccctgagaaaagttgggctgtgtggtataagcgtgtgtcggctagcaagcaagttcattgggatgaactaggaatcagccaagtacttgctcttactttagcaaattcggctaaagatgaacccctgatggcctatgctacttacttctggtccaataccctcaatgcttttctattcaatcaagggccaatgactcccaccctgctcgatatcaccatgcttactggattggatgtaacttgcatcggctaaccccatgagcttgaacatcaaaaaccagtttgattttaggaccaagagcataggtggctagtctggctatgttgccgcatacatgggcaaaggatctgtcactcccagggagcacacatcttttcttctgatgtggcttgagaaattcctcttttgcggatcaagctgtggccctaccaccaattggcaattcttagctgaagcccttgagactaagaggtagtttcccctgggcaaaatccttctcggctatctataccaaatgttgagcaatgcatcggccaagatagccacaggttcagtagtgggcgcgggtggaccgtggtggttgttgcaaacatggctcaaccttgttgtta

SEQ ID NO: 19927 - DNA, 761 bp, Oryza sativa
cgatctttcggtgagttgtgatcactatatttggaagaacgttgacgatccgactacaaccgtacgagacgttatgttgcgcttagcgatcgatacacctctccgtggggtggttatcttgccggtgcagatcacccctattcctgccagcaattcgaagaacaagcaagaccaagaataaagcattctgatattgcaaataggaatttaatcaaatgataagtggggtccgaagaacaaccagacggacggtctagccgacacgcgcgctgcaagcaagtagcaatggctaaactttaatctaacaaaacccaagaaaccctgaaggggtacctaactatttataaaggtgggaggacgaccaagagggtccaagggtcgtgctccaccagattggggcgcaccccacatgggccccacatgggccagggtcccaaacaaagttacaagtccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccatttgaagtcagcaatgtaacacgtggccgaatcagattgcagcacatggaggacttgatcttgatgtcttcttgttgattcatgatgtgagcaatgatcgtatccatagtagccatggtcacatcatcctccccttcttcatagatg

SEQ ID NO: 19928 - DNA, 258 bp, Oryza sativa
ccgtggatttattccaaatgggggtgcattctcatttctcaccggccggtgaccttcttcttgtgatgcttatatatgactatgtatgtagtgtgcgctactctgtccgaaatccgagtcgtttgaggtttcttttgtcgtgtcgatgaaatgaaggtagacaaaggtgatcctgcgatcgacggagtagtggcggcgctctgcgtggcgtcagctgtgatggttgccgtcgtcgacggcgccaaggaagatgggcgc

SEQ ID NO: 19929 - DNA, 473 bp, Oryza sativa
ccgctcgcccttctctcctggcaatgtatgggatagagagaagagggaggctgacatgtgggaccacacgggccacaccttttttattaattttttgtgtagctgacatatgggtcccattatttttattattttttcgagataaaattgccacgtaatcgctacgtcaatgccacgtgggacggagacctagtcaaaggctccacgtagacgccatgtcaaccaaaactgccctccatactgccgagggatcttgtttgcccaattttcgtaagttgggggatgggtcgtacccggttttgcggttaagggacgaaaatcagactgaccgacaaatagagggatctaaagtgaacttattccagacgcaaaattgtcggtgctggcccatggaactaaaaccagctcttgggccaaaccaggccaggccgattgtccctcacgccaaaccatcacgtgtgcgcttcgacctt

SEQ ID NO: 19930 - DNA, 432 bp, Oryza sativa
atagggcgattttttttcggtacccgatgggcaccctgttgatggtcacctggactaggtttcgggttcccaggttttggggttactgccttatggggctttacatcttgtttacagtagtgagtatagctatagcgagctcttctggatgatacatatttttatacataaatagcagctagtcgtttgcagtatatataagtgtttgcaatttttccagttgctgcagagcaatggttcatttcgatggggatggttcacgaggtgcaagatgcctccaggctgcaatacaacttcttatcttggcagctgatgcatacagcccttcacactgaattggcttgtactggtctggcatgttcctgtggattcttctgtaccttcattttacgagttcatgagttcaggccagaggggagatcttgctggcga

SEQ ID NO: 19931 - DNA, 406 bp, Oryza sativa
cctccattactaatgtcaaggcccacttagcatgaaggcccaaaaactacgtcgagcttagcaaaatgtgtgcccgtattgagtgggcccaactgacacgaatacttccgttgtaaatggaataagtccacctgacattcctcatctttctatcggagtttaaaccgtattcttaaatcgcccctcaacttacaaaactggcttaaattagacctcatagcaatatgaaattatgaatagatgactttattgacatggcatcctagtcagaatgaagaaaattttaaaaatatacatggggcccacttgtaagtggccacctcacttcaaccaatacttccaagttaccctctcctctcttctcttcctctcatctcctccatgccgtcgagcaccggtggtaagc

SEQ ID NO: 19932 - DNA, 353 bp, Oryza sativa
aattcgagctcggtacccatcaaaattttgaaaatttcggtaatttctggcaaaaattatttgaaattttgattgattttgaataaaatttgatcaaattaaaaaaaccaaaaaaaatggacgagatttgagcataccggtaggggccaaatttcggaaatttcgaaccacgggcacacaggcacatgcacgtgacgtgacgtggcgggctctatcctggcttcatctagaatgtcgccttccacctcctgccaccttcttcccctttccagactcctttccactcctcctgcaccgaccccgccggctatatacacacccgctcgccgccgccttatcaccaagaacgagaa

SEQ ID NO: 19933 - DNA, 665 bp, Oryza sativa
taacttgcagagtcacatggccggagggaaaataattcccctctacttcacatacccccgggtccatatctccgacgtagcccccggcgctatatcagatatcgatttcctgagatcgttctgacatggcgcctcacgactcctcgagctggggttgtgggcccggcaggaatccaaaaggatatcgccgcgtggccaggttggcgtgctaaccataacagcggtttgaccgccactgaccgcgctcatgatgaagatgcttgaggcgtgataaccgagagggggggtcagtcagaccacgcctcgattctctcgctcgctactcctgcggcggtagttgtgacggtttgctcaacttgcgctcatggccgttgcgcacttcaccttgagtgtgccactgacagacgcactaaaggcgggagcggatacaacgggcgacgtgatgagtgggcgcaggatgcgaagagacaaatgcgggcgcgaggatcgtgggagcaagtatgggagcgcgaaacgaggaggcgagcgcggatgaggggaggcggaggcggagactctgtccccttcctttcgccaaccgcccactcgtcctttcgcttctcgaaccctaacattctcgccacctcatactgtctcgcgctccacgctctccgccatttctccgc

SEQ ID NO: 19934 - DNA, 1501 bp, Oryza sativa
agcggcgcaaggcgaagagtagcgccaggccagaggcgtctcaggcgaagggtgcaaggcgaagactgtctgccgaaggaggatgacttcgccttgacaagttcgcccccgcgagggccgaggaaacctttccggcccatcaggccggcgatcgccagacggcccatcaggggcccatgagcccctataacattatgtacccctgtaaatgccccttctgtaagggtaatcatgtaaattcccctgtacaacctaaaccctggtagtaaggacctgtaatggggctataaatagtctcctagggccatgtaatggggggatcccaagtaaaattcaaaatttagtacacttcatttttccaaccactgttgagtaaccacgtctttcgacgtatgcagttttcgtttcgacaacagctggcgccgaccgtggggactccgagcgaaaccactgagagcgaatgccaccgaagagggtcgtgaaggagaaggttgccaggcggaaggagagcgacgccggaccagacatggccgccgaggaaggagcagagccttcggcgcccgtggccgaagctggaggagcacaagcgccatcacaaccgccttcggcccctgcaacctcggtgcacgtgccgaacgaggccgacgtggcaaaggcggctgcggcggcaagggcactccagaccagggcggagatcctttcgacaagccaaccggtggtgccccaggcagctccatcacagccggcagctaccacaaccgcgctcaccgttgtacagtcccaaaccagccttgaccccgaagcacaagccgaagccgacatggaagccatgcggcagaacatgacacggctccaagacatgcttcgccaaatgcaagaacaacaacaagcatacgaggcggcaaggcgggtcaaggccacgtcggctccaatccttcagtattcggcaggctatgtcccacatcaagtccatccgcaagtgacgacccagccctttccgccacaagccgcacaggcgccggtgtagttcgccgggcagcatcaaccaactggccaagtgccacaaacagtggcggaagggacttcggctctgcaggcgcaactccaagctttccttcagcaactcaaccaaccccactacatttcaagtacaaccccatcggttcacccggtggggaatacaagtcaaggtgcgcctacttggttgccatcgattcagtcaggctcgggagcttcgccgtggaatcagggactgtagttcgactgcgccaacgttgctcaggcgccaaccgttcggcagcaagctccgaccccaggcttcggaacaaaccaagcaccaatccaagctgctatgacgtggtcgcagccaatttttgacccatccatggcggctcagcaagtgcctccagttggagccgggcagccgaacgccatggcccaacctcacgcacaagctgcgatttcgcccttcaccagaccgtacccgcagcaaggtgcggta

SEQ ID NO: 19935 - DNA, 1501 bp, Oryza sativa
gtggaccccacaattattaccattccaaccatcctactctccctcagtcaccagaattttccccaccccactgaggcatcgatgaaaatagcggtagctcgcgcgagtggagccatggcgacggtggtggcactcgcttgtggcaacggcggcagtggtcgcgtgcagcggcccatagaattcgcagcagaggccgcggagctcgcgggtatacacggagtcgacaacggcgtttgcgggcacggatggatccggcggcggcaatgatgaagctcgcgggtagatctagctacgagactcatgggcgtggatggatccggcggcggcacacatgggcacaggtggatccgacggcggcggagctcgtgagaggacttcggctgcaacggtgctcgtgggtgggcgtgagtggatccggcgacgacgctcgcgggcgcgggtgtatccggcggcagcaggaattgggcacaggtggatccgacggcggcggagctcgtgagaggacttcggctgcaacggtgctcgtgggtgggcgtgagtggatccggcgacgacgctcgcgggcgcgggtgtatccggcggcagcaggaatactcgccaccatctcccggcggttcttcagcaaatctatccaggtgtattcttcccttctcccatggaggcaagcaactgaattagagagagatgggctagcagtaccatagcagagagaagaacgaatgttttattgcttatagccggtccttagccaataaacaatcccgaacaaattatttataaacgcagatttataagagtaaaaaatagttttcttgaaaaatccaatacataaatattcgtaacaaaatgtcaaacaccaaataaatttagttaccttcctactttacatagaatgagcgatcatattcgacgaccaaaatgcaaccggccggctgccggcacgcgcctagtctcgtgacgtacgttgtcgtcacacgtggtcatgtagaatttttattgttggatttattatggggtattttgagtttcttgccggcactcataacctctggtagacttactattggataatttgaatatccttgatacattgatgttgctacaaggatgtcgacgtctcaacatgatcttattatatactagcgcgccggtagtctctatgaccaacaaattaccccactcctcggccattgacctctccctagtcttcctctcgactcgcgagaattatgacgcctccacttcaccagcacagtatccgtgagttgaaagctcaatctgtgaccaagctcaatccgtgagttgatttcaatttttgtcaaaatgctgccgaaattttatcaaaattccgtcaaattcaaattttgtccaaattgtaatgtcaaaatctgtccaaatctgtcatttaattttaaacatattcaaaaaataaaaagtaaattgcatattggtcctggttttcttacctgtgttgcacaatggactggatgctatcccatgt

SEQ ID NO: 19936 - DNA, 1501 bp, Oryza sativa
ttgttgaagcaagggtaataggagaatcgctacatcactggtcgaggactaggcagtagtcgtaactcgaccacttgaagtggaaatagtgggagaaacgctacatcgctggtcgcagaccaggcagtagtcgtaactcgaccacttgaagtggaagtagtgggagaaacgctacatcgctagtcgaggaccaggcagtagtcgtaactcgaccacttaaagtggaaatagtgggagaaacgctacatcgctggtcgaggaccaggcagtagtcgtgactcgaccacttaaagtttggcgagagagatcactgcgttttactagttcgagaaccagaagtaggagtcttttaatcacctataggggtgctgaagttggtttattacatgtgcatatcatgtggccagcatgactcacatacccaacttatagcatatccggatgtccgctcgcaatcatgtcgggtgatcaaaccgacgccgtttgcgaggaatcatccgttaacaaccttttcttgagtagtccagcaatggccggtgctataagataggtcgtcggtcttcgttggtaagttgggtgcgacgactccgcatttgtcgagaatgttctcgatagtggggtgtactcaaccacaacctactcgagtgctcaaatgttctcgaaaaatattttctagaaggcaagacatgcagtagagaatatcgagtatgtactcaaaaactgcatggatcttctagtattatcaggacataacgagcagatgtaaatgtcagggcattatgtaaaccgtaaacaagaatgatttatacagaagaagacagaacgagcccccagcgttagatcgtagtcgatttaacatcggggacacccgcgcaacagatattattgtataaagaacatgctctgggtaaatataataaattatagatctaacaatactgtgtgatctgaatatgtacgataaattgcagataaaatattgcgtacctttgtagatacatgccggatgtatttacgaaattagtagatcaatttaaaaaaccaatctaccaattaccttgttgcgtactcgttcgatatcatgcgatctgacatcttttggtacgccacggagcttgaggcttggatgatctcgatagaccaagttgtcgatgacgatgatggttccgatctggttaggttggatctccccctcagctgaagtcatcgagtagctcgttgtcggagaatccatcttttgaacccatctcgtcgaaatcctgaagcaccaaaatccccctacctggcgcgccactgtcgacgtttgatgtcgtaattctggtatttgtatggtatggggatcgtcggtgctaggatatacgcaagactgaggtaaaagagatggagacatggatttttatacaggttcgggcccctgagttgtcaggtaataaccctacatcctgttggccgaagccggtattgctcttattcactataatcacacaagtacaatatttgg

SEQ ID NO: 19937 - DNA, 1501 bp, Oryza sativa
tccaatattgatcggctcgaagcccgtaagattgagctcttggcacaacttgaagaatgcaacgccgagctggatatggaacataaaaagctagccgatctcccaaaatctatcgaagaacagaaggcaagactaaaattggccatcaagaatgttgctgatctcaccaagtctttaaaagtcatccctggaactgacactcaagatgcccaagtaattgaagaagtagaacaaatcaggcaaagggctatttcggctatccagcaatatttgtctcaatgatatcttgtgtaataggtcttagaaatttttgtaatcggctaagaaactttggctctttatcgaacttatcctcataattttatgccgattcaatagaactccatattttgctcaaaaatttgcaattttcatatatgtgcccccctaattttacaatctcaaaagcattgataaaattataacttgaactaagggcgatatgaaaaaatcggccattgtcccatcggcaaaccacaaccggttacgataagaaaaaacaactaagggcgatataacaatatcggccattgtacatcggcaaaccacaaccgagtacaatatgaaaaacaactaagggcgatataacaatatcggtcatctgaaggcgatgtaaacacatcggctatcatgtatcggcaacattagccgatcatgcgttaacccaaacacttgggtaatatttcttcaagtacttgccatttagtgctcgtccataaacttctccatcgagtccttgcaacatgtaagctcccttagacataactctatagatttggaacggtccttcccaattcggtgaccacttgccgaatttgctatcccgactcccaatcggcaaaatcaacttccatacaagttcaccttccgaaatagttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatc

SEQ ID NO: 19938 - DNA, 1501 bp, Oryza sativa
tttgggactgtacaacggtgagcgcggttgtggtagctgccggctgtgatggagctgcctggggcaccaccggttggcttgtcgaaaggatctccgccctggtctggagtgcccttgccgccgcagccgcctttgccacgtcggcctcgttcggcacgtgcaccgaggttgcaggggccgaaggcggttgtgatggcgcttgtgctcctccagcttcggccacgggcgccgaaggctctgctccttcctcggcggccatgtctggtccggcgtcgctctccttccgcctggcaaccttctccttcacgaccctcttcggtggcattcgctctcagtggtttcgctcggagtccccacggtcggcgccagctgttgtcgaaacgaaaactgcatacgtcgaaagacgtggttactcaacagtggttggaaaaatgaagtgtactaaattttgaattttacttgggatccccccattacatggccctaggagactatttatagccccattacaggtccttactaccagggtttaggttgtacaggggaatttacatgattacccttacagaaggggcatttacaggggtacataatgttataggggctcatgggcccctgatgggccgtctggcgatcgccggcctgatgggccggaaaggtttcctcggccctcgcgggggcgaacttgtcaaggcgaagtcatcctccttcggcagacagtcttcgccttgcacccttcgcctgagacgcctctggcctggcgctactcttcgccttgcgccgctctcgctccatagccttcgccatgggtttcggcaggtttggtcgcagggcctcatgccatccgccaacacagatcaacaggttctccacatgcatcttcctcttcatgatctgaacccatttatgagtacaaatggtactcagcaagacatgcttatgataaacatgcagtattgagagctggaaggtttaaaccctaaccttaacagttatttcttagaggctaacttaataaacatttaatataaacaacactattgaacatttaatttaaacaataataacgagcataaaaaaaatacaaatcttacttatagataacttaaatagaacatcaaataataaataagttaaccatattaattagtagccatttagtttaacttgtgcccataatctggaatcacccatagacacatctccattaaccgagagcacggcgtatacgaatactcaacgactctgcagcgtctgcctagctttacccacacgatacccacagctggccgggctgaaaagtaacaaggtgtaatattgctccatatatctctcccttctgcctagtaagttaaaggatgctcgggatgttgctcggagtgatccggtccgaggtgtgtgccaacctacctccgcatccacttaccattgtttgttactcgatgggcagcccagaacttcatggacccatagggtagttctgaattctcggggcccatca

SEQ ID NO: 19939 - DNA, 1501 bp, Oryza sativa
ttccttatccttggtaacctttgcaagggcccttaatctagactgaaccaagtcttccctttcattggccatgaggttataatactcatcggctgttaaatcattttgcaactccgttctccttgagccaattctaacttcccatggcaaaatagcctcatgtccataaacaagcttataaggagggacttggatcgatccatgacaagccatccgataagaccacaatgcttcggctaatcgagtatgccatagccaaggataatcagaaatctttctcttaatcaatttgatcaaactcttattagatgcctcggcttgcccattagcttgtgtataatatggtgaagaattcaacaatttgatacccatgctataggcaaactgaacaaactcatcggacacgaaaattgaaccttgaccggttgtaatggtttgatgtggggacacccgataaagtcatggtgcacccacgaatacgtaaccgcccaggatgttcagttacgcatgaaatgatataaaagcataaagttcgattatacaatacttaagtcacttagttcacaacacaacataaatacaaatcattacatatatggcctataaagccttatttctataaacagataaactactagactccatcacaggaactgcctgagcgtaggatgacgtagaaaccatagttgtcccactctaatagattgttgtcgaaacgacaactgcatacgtcgaaagacgtggttactcaacagtggttggaaaaatgaagtgtactaaattttgaattttacatgggatccccccattacatggccctaggggactatttatagccccattacaggtccttactaccagggtttaggttgtacaggggaatttacatgattacccttaaagaaggggcatttacaggggtacataatgttataggggctcatgggcccctgatgggccgtttggcgatcgccggcctgatgggccggaaaggcttcctcggccctcgcgggggcgaacttgtcaaggcgaagtcatcctccttcggcagacagtcttcgccttgcacccttcgtctgagacgcctctggcctagcgctactcttcgccttgcgctgctctcgctccatagccttcgccatgggtttcggcaggtttcgtcgaagggcctgatgccatccgccaacaagcccctcacgggcaagggtgagactggagcttcggccaagaccgtgcaaaccatgtggtatggtatgcggcgccccctttcgaccgatgctcctaccgaaaccaacattatacctgcgaatgaagattattatttgtgcggctggtattattttgccgcgcttcgcctcgtgcgattgatggttatatatattcttttttcctgggccgaacgaaacagtattgggccttcctttcttgggctttttactgtgctgctcggtcgacaggaatttaccgtttcgcctacccttgcgacacgtggcgctttatt

SEQ ID NO: 19940 - DNA, 895 bp, Oryza sativa
tcacagaccggataaacgagcgcgctgcactggttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgagagcggtccgactcctcggggagacaaagaggggggcggccacatcaccctcgggcccgacccccccgagggggtcaggccacgtgggtgattgctcctgccccaagcctctagtcatgatactcccggtcccatgtcaccgacagtagcccccggcgttatgccagggcgatcgccctcctcgagggaagcggtcgggcgtgacgccacttacttaggcctggtgacaagtggggctggtctctacagttgggcagaaacccaacggtcgcaaatcacacacatcggcaatggtaactcggctgtcaataatgggcggtctcttcaagactgccacattactcgagtagcacgcgaatcgggacgagccagttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacagcgttggcaagggtataaagacaccgaggaaaagatttgcttccttcctctcgccattattccccttgtctacgccgcttgcgccctaactccttgtttcctgtgccctaccctcgccacacgcgctcgctctcaaacatctcttcttccggcgtca

SEQ ID NO: 19941 - DNA, 1501 bp, Oryza sativa
gtccgctcagccaaacttttgactgcgcggcagtccgcgaggtcgtgaagggaggtgttgtggacggtgcaccacttgccggttgggcgctccctgctgggagcgctggcctccttctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccacggtagtctggggctccttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcacaaatcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtggggagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatctaggcgctgccgcgccgtcatgaccaagttggccacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatctttcgaccctctcgagcacctcctcccgcctaggactttggcgtggagggggcggtggagtacgagctcgacggcgtgggttcggctccccgtcgtcaccgctaacactcggagagaggttgtgcgcctttgcttgttcggccattgggctga

SEQ ID NO: 19942 - DNA, 1501 bp, Oryza sativa
aatctccttggtttcctcagggttggttcggtatggcgcacggttcggtagggaagcacctgggatcaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcataggcaactgaaggtgatgcaatcaactcagtaatatcagatttagtagcaagtaagcatttgggtttcaaattgattgtctcaggtttcttgccatcagattgctcttttttatcactctcacatttggatttggcagccttagcaacatcatcacgcaaaatatcttcaggagacatgggatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcgccttaccactgttgttcagccattggatgtagtatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatctgcaaatgcagcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcggcctttgccgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccttgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaatctattcagcaagtcacgtgcatagtaa

SEQ ID NO: 19943 - DNA, 1501 bp, Oryza sativa
ataataaagacgtgccttttttatcatgtttgtatggtgtaccccggcttttcctgggacggggattaatacactagcgttcgggaaaatgcaaattttctcggtcgcgatattgagtccgaacagacttcatctgggcctgcgtgctccttttattaagggctgatctgccctgtaacaggggaggattttattttggttgagtcgttcagggtttgtttttccctatcgtactgtggtgatggcgctcacatcatctccctgctattgattttctttgccgccgctggtggatctagaaggaagaacatggctagagatctgtttttctggctgagttccttcggttcctgtgagttccatcttctctctgttcctgtattgttgttgcacgggtcgaggagcttacctgttgattttggtagagtttcacgtgattggattgctgcatcgttttatctgagcaaggctatattggttatttatttacaacagctaatttgtaccgtgaaagagaggggaaatcggggcgctcgttgccgggtgctcatcataacccctgcaggaaagttttcaaactgacgggtgagtcctcaagttcaattcacactggaggtaagtcagggctcgagaaacaaatcagtaaattgcagacatgcaaaggatgaacacatcaccattcaaagtgcacggtaagtatactgttgaatgttcctttgttatgttcgtgcaattttaactaaagccttgtatgagttgtgcttaaacgaaaatttggtgaatagtaaaaattggaaaaaaatgtttttaggataaaaaaaaggactgtctctcgaaaaataaaataaaatgttggcaaacttgtcggatccacgcttcttaagttttgaatccaatttcattttagcgtggatgtgaacaattaatcttgaggctatgataaaatattttcaaatctttgtagtccctctagtatttgttgtccactaaccttttgcaggaaataaaaaggcaatcaaagagcaatgtacaaaaacttcaaacacttatatcacactccttgtccatgagaaaagatatgcacagggagccaagtagaacaaatgcaaaacttgttgcattcttgcattcggttcaaatcatggtaagacctatctggtaggaatctcatacaccatgtgcatcctcatctcatgtctccatcctgccaagatacccaccatatccattgttgccataaaataaaaaaataaaaaaatgataataaaataaaataaagttggctccttggtcttcgaaccaagtgagtcatttttgcttcactcgtgtctttgtttttctttttgtgttcaataaagagtcccaggtaaaaagacaagtgtggggttatcttgcacatcaacaccgtaaccaaagcaagatcaccccaggagtgatgagtcatgacgaaccacacaagggaaattgttgcgatcagaaccaatgaggggtcagccaaatc

SEQ ID NO: 19944 - DNA, 160 bp, Oryza sativa
tggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagc

SEQ ID NO: 19945 - DNA, 236 bp, Oryza sativa
ataccattttctcttttttttaacattagcaaatcattacttttttaaaaaacttttatttccattttttaaataccattttttaacattagtaaatcattacttttttttaaacattttatttccatttttaattttttttccttatacatttcctttgctttttttttaaaaaaaaacactgtgcactggcggcctggcggctggcggcctggcggcctggcggccagtgcagc

SEQ ID NO: 19946 - DNA, 605 bp, Oryza sativa
ctactatagggcgaattcttttctcggtacccgatccccccccccccaacacgggaaccgtccgatcgagaacgtgcggttgaacaatcaagcggacagaggcgagcacagtatatggtgcaagctgcggatgccagcgacgaatatatgaagcagaaattttgatttttgagaaagagcaggtggtctatcgatcgatcacatccaaggcaatttcttcatacggatatcatgtcccaagacgtgcatccagctccagcttgctagctcccgattccagtcatccagtgtctcaaactgaatcagaccttgtttaccgatttactgaaccaaatataagcagaaggaaagaacaggtggttcagattccacaatcagaataactctctctgaacattgcttgtttctgcacttttgttcttgctactagctgagcaaagttgatgaaatgcggtgatctacaacatcaagacatcaaacacacaatcaaagtaacaactgataaggagaggttatatacaaaaggaagcaaatagaggagcaaggaaggaacagaaggttcagacttcacaatcagaatttagaactctactctgaactatagg

SEQ ID NO: 19947 - DNA, 608 bp, Oryza sativa
ttccctcataaaaatgctactaaattttggaaaaacatcaaactaaaccaacgctatcaaaatttggtacaaaagcctatagcgattggtgaaggttataggaaaaagaatatttcgacaaaaaacaaggggagtactaatcttctttgctgctacatgatggcattaagtgaaaagcgagcagacgaaagatttcatgtacaagaattttacatttcaaggcttacagcctctcgagataacaacgaaacgcgagctaaaaagcgaaatggataagtgaagcaagcccatagtcattgcccaggaaggcaaactaggccggcccattaattcctcctacgaatcgatctgggctgtgaccctagtacccgacgtgtatataacaacatcctctccatcgcttagggtttctcctcggacgcagccggcggcttagggttttgtagctgtcgccgatccaaggtacgcagcctccgagcgccgcctctctctcacacacacgagcgcttccttactcgagatctctcgcgcccctctccgcttcgattctctgtttgttgatcgattttggtttgttccgtcgccttcgccgcaggtccgaggagcga

SEQ ID NO: 19948 - DNA, 1501 bp, Oryza sativa
atgagcttgaaagtttctctttcaaaatcccgtaggattcatgctcacagaaggaatccccagagtcctgttcgattattaccactttcctgtgtgaggaccacaaccacctctcggtcctcatttctaacatgtttagaagtgtggttgtggatgcttatgtttatcataaatactgcaaatctcgtatttgtttgtggcactaatcctgcagagcaatgtcccaaaggtcgagcttgtgaccataaacaaagcactgccgggagataccccggattatcatggtaagctttctttctaataaaagcaagaaccagtttctaggattatatgcagcttcaggtattcttggtcgctaaccatttcaggttgagattaagaacgagggtcatgcgatgcctaagaactcggtagctacatcaactgtatactttggtgatcctaggtattggaacacgctccataggagaatccgacatcacacacttggtttttgatgtcttgcaacacaaaagaccaagtgtgggggggaaggtcgacgagcttttcatgatgagttccatcaaccaaggccatcttggtttgaagttggtgttagtcctagcttgctaaaaaaagaaaaaaaaagaagataaaaaaaagaggagaaaagagagataaaagaaaagaaaaaaataggagaagaagaaaagagcaagagagctgaagagctacatttggatcaaaaggcgcattacgtgcgtgtctttgaaatgtaactatacacctcgctagtaggaatcatgctacctggctacaactagtccctctctcgagctcatgtgccgccttggctcagccttcgtctgctcctagctatgcacaacttctcgctcccgcagcacctacgcgcatacaagcaagaggagttgccctcttcttttctaggcgtttgctgctctactccagttggcagttgcacattttgccaaaaagagaggtatcctacgtctctacagcattgtgccaacggatcacgccttcaaggcacaaggatattgcacctgagatgtgtgcataaccaaacagctcgccttagtatggtaaaagtgccttcctccgctacaatctacattgcgatggaggagaaatcgacaatcatatgtgaccataccaccgctccagaggtttcaacatacacatcatgctggcggtaagtacactcaggtatacgaaaggcagaaaaagattcaccgcatcttttactcatacttatctctatttgaatgagacttgagtatacatggttttgtttcttatgtctatttgcatatgctctggcttgggtgttttcgcgagacatccataggctttttaaattaagcatggtgcttaggttaaactagactactttaatcaaattagacatggagtcgagtttgattaatgaactctcagagtaaatatgttcatggacattggacatatatttgctgtggactaacctgatgtgtccaagacc

SEQ ID NO: 19949 - DNA, 1012 bp, Oryza sativa
gtgcattcgttggacaatagataatcccttaaccttgtacatgaaaaatataagcacaagcacaacttctccacaggagaatatctagtctctgcatccaagagccgatgactcaagtagaatacactctttctttcccttcgagctcatgaatccagaccgagccgattgacttctcaccggccgacagatataacctaaaaggtgtccccttctgtggaggaatcaaaaatggaggagagctaagatatttcttaatattatccaaagctttctattgctctgccctccaagtaaacttttgatcggctttcaatattaataatggtgtaaaaggctctaaccgtccagataaattagaaataaacctcctaacaaaatttatcttgccgatcatctcctgtaactctgtcttgttctccggaggctgaatcttcttgattgcattaacactcctttgagttacctcgatccccctctcatgaacaagaaacctcaagaactggccagctgatacgccaaaagcacattttgtcgggttcatcttcaggccatatttcctggttctctcaaaaaccttcctcaaatcagctatgtggtcttctatctctttagatttaacaaccacatcatcaatgtagacctcgaccaaccagccgatcagatcatgatatatataattcatggctctttgatatgtagccccccagcacttgtcaagccaaaactcattacaacccactcaaacaagccgattgcactaggacacctaaaaactgtcttatggatatcttcttcggccataaagatttgattgtatcctatattaccatcgataaaacttaaaatcttgtgtcctgaggcagcatcaaccagctgatcagctactggcattggatactcgtcctttggggtagctttatgtaaatctctgaagtcaatgcacaccctcaccttgctgttcttcttgataacaggaactatactagaaacccactaggcatatcggcaa

SEQ ID NO: 19950 - DNA, 460 bp, Oryza sativa
aatcgattttaacacggatgtgtcgtaacaaatttctagacaaaaacaccttgaatttcttgaatttttataattggtatatagatatagatagatacattctaaagctatataaacgccacataggacaaagacccagttaagaccaccacataggcgccacatcagctaaaaccatcttcaaaatcaccgagggacatagtttgcaccggttttaatagttagaggagtcgatataccggttttgtggtcggaggacatgaatcatactcgggagatagttgagggagtcaaagtatacgttttctttctgggttatacgtagagtgggttgggctttcttcctcaaaatgttggcccatcaagcaatccgtcaagtgggccaaaacaaagtgaagctacgggttgcactaaaccctaaaatcctctctctctctctctcccccttgtaccgaccagc

SEQ ID NO: 19951 - DNA, 1501 bp, Oryza sativa
tggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctctttagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcacagacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgatatcacaagatagcactaggaacaactcatgcacaactctgatatatgaagttcagctcaaacataacagtattttctcttttctttctttcttctttcttcttttcttttttttttctttccttttcttttctgtttttttttggtgcggctttttttttctttttttt

SEQ ID NO: 19952 - DNA, 380 bp, Oryza sativa
tttgagctacgcacattatatctttaagacatagttggcttagagctacgcgcattatggtttaagtagtcggtatactatctaagttcagccactcgcaaattcacaccgtatatgctatatatttatggtcaagtcactaggcttactgactttgtagttcttgactatatatttagttgttttctctctaactaagcacataattggaggctatgactaattaggtgtatctattcgatgcacttatttatttaatttttcttcataatccctccatagcttcttgcaatattttgacgaggactcttgaaggaagaactcccgaagccttttcaaggaagataaaatcactctgcaatgataaaaaaaaacctaga

SEQ ID NO: 19953 - DNA, 286 bp, Oryza sativa
accgatcattcatcattcttgcgttttttctatcatctcctttacaatggcatttctattaaaattctgtacttttccaatagggatacgcaaaatggacagactatatatgtataaactgtagaaacaaatatgctagtttatttgctataaaagcagaatcaatatatagaaagaaacagaggaggagaacaatatacaatgctgcaacagtagaagtgaaagcagaaccgttgccgtggccattcctgccaatagaaccgtcgccgttacttttcttgccacc

SEQ ID NO: 19954 - DNA, 1501 bp, Oryza sativa
tgaattacataaacaagattagagtatcataaagatggaagcactaatcccgagaacgcaagccactataataagttttacctcttgttgaagatagaaaccgatgtagctcaacccgaaagtaagaactcgtcgaaacaaaacgaaagtaaagggtggcgatgcgccgagattatattgaacgtgtattagattcattacatggggctcggggtctatttatacccgagattacaaaatatatccatgtcggacacgactcttacctctaacaaactctaagataccataagtctttgcggcagacttttgcccaaacatatctctaaggaaattacatgaaatatcctaattaatagatacaattgccttctcaagactcaatccgtgcatggcaatcctcatgaagcacattaactcaacccgacaacgtgtactgcgtcacattgtcggactcggctcaatcggctaaccttgtccaactcggactctgccgatcccagttgcagccgattcggactttagccgtgccttttcttatcctaccatctaataaggcttatgtggagctcagggtatggaaaagagtagagcattacttgcttcacatatattgcgaagtcaaataatgcatccacggaaatacaagacatactttctagtcaagaatgtgcatgtgtatgtgtatggtgaatttgtgggtggaaaatggaaaataaaaataacttcttttgtatacctcctccatttattctcttttgaattttgggagagtgcatggctatctccttattttcttttcctctttttttttctcatcatcatgctccatacttgtatgagcaccttttttttctttctttttcatagccatgcttctctctcttttttcttttttttgaaagaacattggaggaagaggcataaatgacatggagtatttatttttgtggaagatggacaaaatgaatgacaaatgaggaatgctaacttccggtgtagaagttaagcattggtgggtgtatgtggagtgtatgtgatattgaccatgaaagtatgaaaagcatttcactagggtcacaaaacttgacaacgctcaatataatgacaggcagcgtatgtagcaagctaatcatgaatgatcaacctatggctctagtgggaataaaaatattaatgaggagtttagcatcgttatatatttttttcttttttataaaattcccaagtgcacaacatgaagagcaggatttccatcatcagactatatctcattcatcaattacctagatagcatggggtccctattggataagtcaccacaagcaacaagtaatgagcaaagaataataggcatgcatgctattttcagggaaccaagaactctaattgtaccatccatagcttgggttcaattatcttagatattttagaattgatgatcaaattgaactcaagatagaatggatgtccaaaggaaaaattgtgcaaacctgcgctc

SEQ ID NO: 19955 - DNA, 548 bp, Oryza sativa
ttcctgcagcccatcgagctctacaactttagtgtagggtatatctccatccatggtcgtttgaaaaattcaaaaaaaaagatcacatcacttgtaacactttgatataggccatgtctccatccgagatcatttgaaaaattcaaaattacatatttcaaaatagctctcaccacctataatgaatatttgggcatgtaaactatcacaaattcaaatactatcagttttaaagttatagatctcatcaagatctataacttccatatagggtatgtctctatcagaggttctttgaaaatttcaaaaattttaatttttcctcatccatgactgttcgtaacgttatccgtgaagggtgttaattaagatccgtcacggatgagtgctgttatgtttgaagggtcatctcattacacctatcatggatgatatgttatccgtgattgggaattgttgtaacctgttataagtcatccgtgacgtgttagaactacgaccggacaaacatgactttaaatctgtgacggggcatggtagtgacccat

SEQ ID NO: 19956 - DNA, 1501 bp, Oryza sativa
cacattcagttaatcatagagctacaagtcagacttgcttggcaaaccagggagagctggtgctggtagcaagttatatagttttaccttaacttaattcaagaatcttaacccttagaaatcttctctacatttcacctattatttagttgttgtccttggacgaacatgtttctaagattcgacacacgcgttccctgtgatttgatacccaaggaacactctaaggtgaagtgctataattgtatccatacgcctgcggatttatctgtgatcgtggcaaataccaataagcatttatggcatcgttgtcggggaacagttgttatgttatgtttgaacctagttcttcctctcatcctttattttatttcttcttttcttttcttttctaccatggagtaactatctagtcaaaactttttcactctgaatggcgagctctttgagccacccccttcttcaaaacctactctcacatctaactatgaactccgtcctggcgttatagccatggttcgggaacaatccttctcgcgccgttaggaagacacatggtgaggggtaactcaacaccaagttatgtcttccttttttttcccgttaacccatgttgtctctatacggatgaaaattgttaacttttggcagagtgagaaggattatgcattgtatcccgatgttttcaccgaaggtttgtttgcacagtagaaggtatggattgtatcctagagaacacctccttcatccacagtgaaactctccaggaaatcaagcatacccataaggagccctcaattgttgaatccaagcccatactttgtacatcacaagattcaccctttgaaccatcatctgaacctcatgaaccgaaggaagaagaaattcagccttcgaaaatccctttcgtgttcgaggaaggtctttttgaagactatagaaacacctcgaactattcctatcaaaagagatcacatgctcaaagggacagtaaaggagttaactaccatcatgagcgatgtgtggttaagggaagtggagccgtcttctgaagtaattcggatttcgcccccttacttagctattcaatgtcttgtgaaggagactgtggtgattgttctctataatcccactgtcggtgctaacatcctgtttgcaacttttgcgttaactttgttgacggtcgttaagtaccaatttctttcaccaaatagcacaattaataaaggaaaattagcatttcttacacgtatagcaataataaataatgtagttgtattatgattggagaatcaacctggtgttggtatttcttaacgacattactagaaatataattcccagcaatggcgcataaatacttctggtatattatggttacagagttcatccgcaagcgcacggatataccgttgtagcatttcacccgagagtattccaagggtatcgtatttattttatcccatgggaagatcatgtagagagaactcaactaatattt

SEQ ID NO: 19957 - DNA, 778 bp, Oryza sativa
attccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagattttaattgaattatgacgcaataatgaattatttttgaaaaggaaaaagggaattattgcgtcagcggctagggtttgcggtggaccgggcgcacggcagcggttcacgggaacggacggccgagattgatccatccaaaacggacggccgagatcgagcggatctacggcggctcacggcagacggccacga

SEQ ID NO: 19958 - DNA, 532 bp, Oryza sativa
taaataaaatgagtgagatttcgaacctagaccggctaacactacacatctcctgtcgagctagccataagatccctagaagcttctctattggttcatagaggattttgaagtactactttacgtttgtttgggcatgacctttttttttcaaccatgtaaatttctagagatatcaaactaatttcacccttaaccatcagctctcctaaacaacaatatttgtattcttgctccatgttggcaatttatattccttagttttccgcgcgaatactttccgaaatactaaacgataagttttctaaaaaaatataaaaaagtttgctttaaaaattcatattaatctattttcattttcttaaaaaactaatatataattgaaattatgtgttaatccgtgccccgttttacttgctagtggtggtttccaacccctcgtttcgaactcagccaaatctctttggacggagggattagatagctgggcaccgtgttattgccttttccttttggtcctttggtccggtca

SEQ ID NO: 19959 - DNA, 657 bp, Oryza sativa
gcgcgaggtgtgggcgcggagtggaggcgcgacgtggagcggagaaggcgggaaacggcggcggcgtggcggtttcggcggcagcggcggttggagctccggctccaacggccggaggtaggagacgaccgataggtggggcccacctgtcggcgtcccgagagaggagggaggggcggcttgggccggcccacaaggagaaggggctgcgggagagggataggccgacggcccaataaagaaaaaggagggaaaagaaaagaaaaaagagaaaaaggattttcctgggactaaaaatattgcacttgctcaattttaattggttaaaattatttccaaggctctgaaaatttccactaaaaatcatgttaatgtattggagcatggggaactcaagaaaaattccaccacgccgaattcgattattaaatgcatttattaattagggatttagctctaggttaattaagataatttcttcgggcaatttatttaaccaatttttttaaagcaagaaaagggggggaaacttcagggtgtgacaaacctacccccccttaaacggaatctcgaccccgagattcggaagaattggtgaagaggtgcggatgggcggtctttaactcattttctctttcctaggtggcctcttcttct

SEQ ID NO: 19960 - DNA, 1501 bp, Oryza sativa
ttcttgtgattcgatcctacaagtggtttcaaagccttgttttcttctttggatttttatcgatccaaagtttttgccatggctactcctgctaggttttcaactaagcctcatgtttttgatggaacggatttttctcattggtgtagtaggatgtaatcttatattatggctgaagattatgatatttggagaaaagtttctcatccttatgtgattcttgaagctattaatactgctgctgaaaaaactgcttttgaacaaaattgcaaagctcgcaatattcttttgagtggtatttctcgttcagattatgatcgtgttgctcatcttcaaactgctcaggagatttggagtgctttgagtaattttcatcaaggaacaaataatattaaagaacttcgtcgtgatcttttcaaaaaggagtatattaaatttgagatgaaacctggagaagctttggatgactatctttctcggtttaataaaattttgagtgatcgtagatctgttgattcttcttatgatgctaattatccacaatctgagatttctcgccactttttgaatggtcttgacatatctatttgggagatgaaagttacatctattcacgaatctattaacacgtctactttgactttggattcactttatacaaaattgaaaacacatgagatgaatgttctttctcgaaaagttgattctaagtcgagtgctttagtttcctctttggatgttgatgcttcttcatctaagtcttcttttcttgctgtttttaatgccacatccgatgatcaactcgaacaaatcgaggaggaggatttggctttggtttcttatttgaaaaattctttgctaagattttctgatggtaaaaagaacctcaacatgattttggatcaatcagagattagcacacataaccgtggtttaggttttaatccttatgctcacaattttagacatcctcctgttgtgttaggtgttggtgctagaagtggcaagattttggttaaacttgatactaacaaaactgtgcttaaatctgttggtgtcatatctaatatgaatgcatcttcttcaaaatccaatgttgtgcatgcaaaatctcatgttgttgctcatgttgataaatctactagtgctaccaatgtgtctaatcatcgtgaaaaatatacttgttctttttgtggcaaagatggacatattgttggtttttgtttcagattagttcataaacagaaaaaggagagagagagattgcctttgcaaaatcaaagtggcaaaaatctggttttcccttgaggaaaccggtctgaccgcagtgggtcccgcggtcggaccggcgaccggtcagaccggctgaacagcctcggtcagaccgaccaccggtcagaccggctacacaccctcggtcataccggcctcggaggaatttttctgtaaattctaaaattgattttgcacgtggatatatgcctattggatcttctggtcg

SEQ ID NO: 19961 - DNA, 1501 bp, Oryza sativa
caaaactccaagacacgcttcgccagatgcaagagcagcaacaagcgtacgaagcagcaagacaagccaaggctcacacccaacagttctacgctcagccccaagttctttctccatacgctatgcaggcgtcggtgtacttcgccaagcccgccccggccattgccgcgcgtccaacgcctcaaatgatcccggcaccggttcgcccggcggcacctcaagcccaatacccgaagcctgctaccacgcttttcggcgtgacgccgcaagctatgatggaagcagcttcgaccttgcaagcgcagtttcaagccttcttgcaacaactcaatcaaccccacaacaatataccaagaaattcatctccggccacggccgagggaggcccaagtcaaggtgcttcgacgggacagctgtccagccagttcgctttgctaagtcaagctcaaggcccaccgccatagttcgacccaagcacagcggcccaggcacccatgactttcgcattggccgtaccccatgggtacggaacagccccaccgcaaagccaagcctggaatcaagctatgtttgaccctgctacggcgaggcaagctacttcgacagaccagcagaatcaggcagtgatgttcggcatgggacatcaatctacggctcaacctcaagtgcaagctgtagcttcgctattcacgcctccgtacccacaactgaactggccttcccaacaaggggctacaaccaagccaggtggcgaaaagggtttgcccctcagctggggaatcaaaagtcaccccatcccaccccagttcaagttccctccagtcccaaggtattcgggtgaaacggatctgaaagagttcctgtccatctacgagtccgcaattgaggcggctcacggcgatgagaacactaaggcaaaggtaattcgcctcgcactcgatggcatagcccgatcttggtacttcaatctgcctgttaatagctttactcattggagcaattgcgcagcgttttcgtccttaactttcgaggtacttatgaggagccgaaaactcaccaagaccttttgggcatttgccaaaggccgggggaatcgacaagggaatacatgcgccgattctcgcaagcacggtgccaagtgcaggatataaccgaagcatctgtcgtcaacgcaacttcggccggcttgctcgagggtgaactcacaagaaagctcgcacgcaaggaacccaaaactctcaaacacctctttcgcataatcgacggatacgctcgaggcgaagaagacaccaagcgaaggcaagagatacaagccgaatatgacaaggccgccgcagctgcagcagccacttcgcaagccaacgcccaagctcaggttccgcctcaagttgcaagttcggcgcctgtcctggttcaaccaaccctcccggcgaatcaaggacaacacccaaggtcgaaccaagccccgataacctggaggaaatttaggaccgaacgagct

SEQ ID NO: 19962 - DNA, 160 bp, Oryza sativa
ctatagggcgaattcgagctcggtacccaaataaaataatgcaggattggaacatcttcagatgtggagttttgtgcaagatattacaatcattgtgatgttgtcaaagtcgtccaaatacttgcctcttcagatgcatatacagatatatgtaggagaa

SEQ ID NO: 19963 - DNA, 526 bp, Oryza sativa
tctttgttgcgtttactgtagccacaggtttttgtgtgtgtgtgttactaccacggctggactctccctgcaggcagcatccatcgctgttgcacttttgagcggtagttcttccttgcaatgcaggcgcgtctagattcattgcaaagttggactgatcttatttttcctgctattcgtgacgagacagatcagcacgacgcatacggcaaaaaaatggctgctctaattttggcattttagaagatgcgccgtgattttcaggagagagtgatgcgcgtggcgggctatttcttccattccagcagtagctagtaggcgccagatcattcgtgtgatatggcaaacgcaacagttcacacgttgccgactatccttctatggataaacacattgcctatatgcgacacggcgctaatgcagtatcaagttgccatggtggcatacttgcctttcccaaccccagatgtaatgtaacagaacagatgccagccaattcaacaaacaggtcgaacaattcaacaag

SEQ ID NO: 19964 - DNA, 558 bp, Oryza sativa
tgtctcgagagcaaaatgtagaagctaatgatttggcccaaggagtatcagggtacaagctgatcttacctgatttagccttatatttcatgtgcttaattggtatgcttgatctgccttttatattgagatcttgttgcttttaggtatattaagcttcttgtttgatatatttagcttgctttaatatcttaatatagagtagtatcagagtattagcctgtacttgctagatctatctgatcggctatgctataaacatttataatctccttgttagtatatatttcgatctaagtgatttatactgtttcggcatggcgaccgatatgtcccaatcacttgatttaagtatatatcgacataagtattgtatactgttaatatctatagccgaccgagtagatttagttctttattatttattaacatatgccgatcgatgcaaagatgacatcggctcaaagataaatgatatgtcatcggcaactagccaatcggctatcgtttatggatttaacctcggtttctttgtcttcatttcttgttgattacagg

SEQ ID NO: 19965 - DNA, 1501 bp, Oryza sativa
acgggaagtcatccttcggacacatcttgttgaggtccgtgaagtcgacacacattcgccacttgccatttgacttcctcaccagtactgggtttgctaaccactctgggtggtcgatctctcgtatcactcccgcttttagcagcttgttcacttctgctttcaccgcctcccggcgatcggccgacattttcctcaacttttgcttcttcggccttgcttcaggcttgactgcgagatggtgcattatgaggtctggcgagacaccccctacttcgtctggcccccaagcgaagatgtcgatgttcttcttaagcacaaccatggtgttgtcaatttcttgttcgctcaggtctccaccaagcgatatgaccttggtggggtcggaatcatctatttgtcgctagatgaccttgccgtgggggtgggcttcggaactggttttgttttctcttgtccttcaacctctacggtgtggacttccctaccgaaaggggccactgtagcggtcgaaggctgggaacccttgacaactattacgccggtcgagcgtggcatcttgagcttgaggtagttgtgatgagagactgcttcgaacttggtcatagtgcccctgccgaagatggcgttgtagttgtatgggatgtcaacaatgtcgaagagtatctcctcttctcttctattctcttgcaagccaaaggcgactttgacgagggtttgtcccagaacttgcactgtttcacctccaaatcctctgagcgaagttggtgcttgggatagcgccaatgtcggcagacccatcttggcgtatgtcccggcgaacatgacatcagccgaacttcctccgtcgatcaggatgcgccggacttcaaaaccagccatttctgcagaaacaaccagcgggtcctgatgcgggaaaagaactccttcggcatcttctggcccgaaggatattggctgtgacaagtatcttggtgccccatcttcggccgaaacgatgttgtgcactgttcgaagttgcatcttcttttgccatttagacacttgtgaggggggatcagatcttgtaatgacttgaatcactcttcgccgcacgtcttggcgttgttctacttgaggtgcttggttagggatcgcttcgcgcggcgcctcttcgacccttccttgttgctgccttggcgcttgagcgttacattgctgtcggatgtttcgacattactcggttgtgtgcgaagagtgtccatgaaaggcgtagtacaagaccttcttgactttcttgtggaagggctgctgctgtccacccgcctgctgggagtcgaactcctttcggagggcctgcacttcctcgaccgccattaccgccttgccagctcgttcggtcctaaatttcctccaggttatcggggcttggttcgaccttgggtgttgtccttgattcgccgggagggttggttgaaccaggacaggcgccgaacttgcaacttgaggcggaacctgagct

SEQ ID NO: 19966 - DNA, 260 bp, Oryza sativa
gcgagaagccaccttaggccggaggaaagagagaggagtagggaagtggaaaactttactgtagcaagtattcgcgagaggtctactgagaggtccgccacgcctgttgtgctcactccaaattttccaagcccggtgagcgagtcatacgtgcgtttcagtgtcatcatttttcttaaaaaaaacgcgtggcctttttgctctcctctactgttgttcgtgagtgtaccttgctacgatcagggccggccctagggcta

SEQ ID NO: 19967 - DNA, 366 bp, Oryza sativa
gggatgacgggtgggccccacccgtcagcgagggtggcgggcgggcccgcccgtcagcggcgcgcgcgcggggagaaggcccgggtggcccgcggggagaaggagagagggggagggaactgggccgagccggcccaagaggggaaggggggaaaaggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctagg

SEQ ID NO: 19968 - DNA, 774 bp, Oryza sativa
atagggcgaattcgagctcggtacccctagatctctttacggtcaaatgattggtgcttccataggaaaaacaagaggagaacatgacaggaaagaaagttaaatcaatgtttacatgaacattgccacatatatttcgatgaaagaaggccaccgcatcaccttttgttattttgcatggtaccacatcaagccaccttccacagatacaaaggtttcaattgacttcacaacaaacgggcctcatattcttcatcaggcggctaatgattggactaattatagttttaagaaaatggacaaacctgttttgtcaagcctatttcttaattataaaaacttaaaaaggataaacatgacagtatttggcaagctactaggttgcttttaaaaacctctttgtttatgcctttcctttagttgttgtgccattcacatggcttagttcatagtaggagtgtaggacacttagcacttggtggctactgcttaccagaagactctatccggttttgatacccacagatctgaaagaaaggaaagctgaacaagggggccatgctgtcaattcagcactatgatttgtggggcctgattacccttttttcatatcttatctagtactactaggcagattcactgaagaagtatcatccaaggaattccactcctttactccattcattataccagtacaaaatatatgcttccttttcagcaagtttaggtatctaattcttgatgttaggtgcatcttgcattaagtcatagatg

SEQ ID NO: 19969 - DNA, 473 bp, Oryza sativa
tttcgcccgcgattccctgtccaaacccacaccaccaatccgcatgacggattaattaggcttaataaattcgtctcgcgattttcaggtgagttatgaaattagttttttcattcgtgttcgaaaacttcttccgacatccggtcaaataaaatgtttgatgtgacatctaaattttttttcgcgaactaaaaaaaaggccctagtcactagtgtgggaggcgttgactggacttcgaagcatatgagatcaggataaaaacctttgctatatatattcctcatcagctgctgtaacggactgaatagaggaggctgctctactagcctagtagtagtactgtagtatagagataacttgcacgccgtctttagcgacgattggagcagtcgtgtttcagcttctggtgacgacgacgacactgtcagcagcagccccgaccccgatagccctgcctggttgcccggaaagc

SEQ ID NO: 19970 - DNA, 153 bp, Oryza sativa
taagaaggcctgaacctgtataaaattccttgtctttaaacccatccacttttccagcctgatagccacccccttttagtattgtcgaaatcttgtttcaacagttggcacgccaggtatgggaagcgtcaagttcttcgccgactagtgcga

SEQ ID NO: 19971 - DNA, 313 bp, Oryza sativa
aactattactgtaataacaaattttccaagaatctggatgaatagagaatatgcagagatcaatctgccatctaacataaagaaggaagtgatagttttgttcaaaataaacattaggatacatcactgatcatacaaaaagcccagccttgctggatccctccttgcgttgcaggccacttcctgtcttgtgtcagtctagttctggaaaattatcatgtttctatcttcacaaataatcaagatgctgttaaagtagatgtttgcaccattggcctctgacaccagcctatgaggcttgctacccaacagt

SEQ ID NO: 19972 - DNA, 203 bp, Oryza sativa
agaaaaataataagaaaggcaaaaaatatgccttccaaaaaagaacataacatttccgtcataatctttacctatctatcaatctatctattctttctattatatactaaaaatccattaaacttcctacaaacgctcctaaatcgacatgtggcatcctataaacgctctcgagtcgccacacgtcactctattaaaataga

SEQ ID NO: 19973 - DNA, 930 bp, Oryza sativa
aaggaaaaaaagaggagaagaaaaagaaaaaaaagtaaaggggtcccatttgttagtcaaaataatgccacgtcatttctgcgtggcatgccacatcaagccacataggatcctgaaggagttgtagcgatttgggacctagatgacatactataacaagttatgggacttggatatgcattttgagagtttagggacttagatgacatacccctacaagtttaaggaccgcccgtgcactttactctataaaaaatgtctcaaaatagtacttcagtatataacatttacatgatcaatagcaagtgctcaaaatagtacttcagtatataacatttacataatcaacagcaagtgcatatcttctatagtgtgaccagtagaagtttatatggtatgcaaaccatagaggtttatatctcagttactcttaggacattgtctcataatagtactccagtcaattgttatcggaatagtgctcgacgtcgttgtcttaactgaagtgcaaaaaaggagatgtcgtgtgtgaacatgctggaaacatcttaaaaattgaaatgacaactatgcatttctggtatggacttacggaccccatgagcatgtccatcatcctagcagttgggcactggaagggatttcacactgcacatgtccatcatcctagcagttactgccaaaaaatactgctcaatctcggcttctagctaacttcccagccatccgagggtgacccatcgtaatgctggtttaaattgatttatgaaatctgacttcaacagaaatactgtaaaaaaaagccacatcctgtttctggaaaaaaaactgaagtatgtgttggaagtaatgtgtggatcagttgattttgttgaaggaataacaatattggaaaaatacggagcacaataaaacttcagatagaaaaca

SEQ ID NO: 19974 - DNA, 1501 bp, Oryza sativa
gcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagccccacatcatatcaccatgtccctcaataccaccacggtacctcgaaaaggagctgtgacaataccccttgcacaacacaatccaccatagcgcacctttcctggatcataatcacccccttataaaacaaggcatggactccccagcgacccccgtgggcttatctccgccacttctcagtctagtgctccgcaatgaaccatgttatacaaaaggtaaagccgttgcccacgctggcttgtggttggcatggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacga

SEQ ID NO: 19975 - DNA, 558 bp, Oryza sativa
acgtgaacggagtgtgttaagcaggtcaatcttttcatttcgatcagaacagagtcaaaacgcatttggcaaatagtatataccctataacgtaatcctacaccatataaaacatgcccaacctatagcggttataaatccactattcaaaatgtaagtatcgatgggaccatttgccatatcattgttaattcaatcttaccttgtcaccgaaacaagacgctccgcgtaacatgaagttaaattttcatatttgaaggcctggtcgcggaaatatcaatttataagttaaaaacattaagcattgctgcctaaataaaattcatatatgcttaatagtccacattaatgcccatgcatatcggtttcatctgttttcacctaaagtcacaaaatatagccgctgctctatcctgagagtgaataggtaggcatttcgttctttgctggtatcgttgatgaccgccgtgatacaatcgatccatggtttgatgctagcaaggggctattttcatttatgttctgcctcctaaatgtcctttcgttcttccatctagg

SEQ ID NO: 19976 - DNA, 1501 bp, Oryza sativa
accggcagttagcgctcacttttgagattctttctcagccattggcctctttgagcttggttaatcggtagaggggatggctgaccatttgtgagatttcttttccctatgctgatggtagaggagtgttggaaatgaggactgcgaattccttcagaaaacatcaagaagacatttaagctatcatgacttaacaaataaataaaaggtttgaagtaagattacttagcattggagtgtatgacacatcacatgtagattgtaaagggcctttcgcaccgcaaaagctagccattgaggtgaggggctctcccccacttatatcttaggtcctttgcccttccacaactaatgtgagactattcaacaatctcccccttcacacattggtgtcccttagcccttcaccgccccttcaccgtgtatagaccccacacttatatcttaggtcctttgcccttccacaaccaatgtgggactattcaacaatctcccccttcacacattggtgtccctcagcccttcaccgccccttcaccgtgtatagaccccacagaacaggtccacggtccatcaagtatacgagccccgcaggcacccacggtccatcagatcttcacacactgtgttcatcgggtcagagatgttaacctagtcagactctgataccaattgtagtatcgtaaaggggctttcacacttcaaaagctagccattgaggtgaggggctcccccacttatatcttaggtcatttgcacttccacaaccaatgtgggactattcaacaattagatgtaattgggcactgatgataaccttgtggcggaataattttttcatccgtctataaggagcccctttctcatttttgttgggtgtctcccaagtgggattaggttctcccttgtgttcacatgctaggtggacacgatctttcaaaccctgggtctgacggagtgtcacatcctggttttcgtttcaggatttataaattatataataaattattattagaatttatattaaatgttcattaatttactagtgatgtgggaaatcaaaatttctaaatataaagcatggatggatttaatttttattaaattctccatggttaattatactatgtggaattttctttgattttttgaagctcaattcttaattttaatcatacaaagaacatttcagtaattattcacatattaaattaatcattaaatggtctgactataatcttgttaagtactttggttgtccaagtattttcaggatttttgttgaaattatctgagcattgaaagtatttttaacaattcaaacatcatttcagtgtttaatttatttggaaaagtaattaaaatccccttttccttttcgggctgaaactcgaaaagttcacctttagtcctcggcccattctcccttcctttcagctggctttattcctcctctgaagtccatttcctgtccctccttcaatcgggctggagaaaaaga

SEQ ID NO: 19977 - DNA, 1501 bp, Oryza sativa
agaacatttttagttggataaaaaagggcaatggagctttatgatttttagtcctgattggtgttaccaaccggattaaagacagccggggctaaagataaaaacatttttatacttcttcttcctcctccagcccgagccattgctacaaaggtttggaggaagaagggaggtgctaccaaatttttttgtgaaagtgtttcggtgataatatacaaatcgaaggaatctaaaaggttagcaactccatcctctgataatgtatgcttagtatattacatttatagttatggttatatacattattgtctctgaaaaggtttatggaaaatgacaagagagaaaatttgttaggataaaaataggttacttttaaaattagaaacatgtggataaaaatgttataaaatagatgacaaaggaaaaatatagaaaattaagataaaagaatagaaaacaaagttaatttaataaaatagttagaaaaagtacaatacattaaacatatcattagaactttaaaaataattaataatattaataatatgtgggattattgtatgattatttgtatatagttattgtatgattatttaattagcttgactttcgtggattttatttttacgatttttgtgcatttcaggtagatggatcggcaatggatgtacaccgcggaacgacggtcgacaaagtttattgaaggcttgcattattttttgagtgttgccaatgctaacaagcataagggttttacatgttgtccatacaaaaagtgcaaaaaccaaaagtagtattctacatcatgaactatttatgcccacttgtttcagtcgaggttaatgcctagctaaaattgttggacctcgcacgaaaagttaggggttgcgatggaggaagatgacgtaaaagacgagaacattccggactgggctcaatacggtggatttgatgaaaatacaacaaacgaggcggacgagtgttgacgaaaaatacgaggcctgagagatctgcttaactccagtgcaggtccaaaactcgccttcgggtatgctagcgtgccagttgatttgatcctgcaatcaacaagaaacaaagacaaagaaactgtagttaaatccataaacgatagccgatcggctgagtgccgatgacatatcatttatctttgggctgatgtcatatatgaatcgatcggcagtccttaataaataagaaagaactacatctactcgatcggctgtagatatcaccaatatataatcctgacgtcgatatatacttaaatcaagtgattgggatagatcggttgccatgccgagacagtataaatcacttagatcgaaatatgtactaacaacaagattatatatgttcatagcatagccgatcaaatagatctagcatgtatcggctaattctccgataccactctatattaagatattaaagcaagtagaatataccaaacagaagcctaatatacttaaatgcaataaga

SEQ ID NO: 19978 - DNA, 807 bp, Oryza sativa
gttagtgaaatcgctctctaaacctgtcaaggaagttaggccttgggtgtcacatcgaacgtttaatcggatgttgaaaggggttttcaaacacgaatgaaaaaactaatttcatagctcacctggaaacagcgagacaaatttatttcgcctaattaatcgatcattagcacatatgggttactgtagcacttatgactaatcatagactaattaggctcaaaaattcgtctcgcgattttcgtgcgaactgtataatttgttttttcgtctatatgtagtgcactatttagatgtctaaatatttgatgtgatgtttttggaaaaaaaatttaaactaaatcagaggccttaaaataaaagagttaggatatccggtgttggttcattatagtctgcacttattgcgatacgaggggcgtcaaggacaagaagtagagaaaatctcgtatacgagagagacgtccccaccttgggccccagcacaacacaagtccggcgtcgtttcctcacgtcgctccaaaacgtgctgcacccatcagtcgcttccagcccgctaacgggcggagcgatgaacggacggctcacgctgctccctccgatccacgacgcgagccatgagtaccccgcacttttgccgcggggcccataagggccatcaaccgacggccctggtgccgcctcgccccacccgtcggccgtcgggacgggagacccctccctcccccgcgatcccgcctcggcatattcgccgtccttcgcctcgcggcgggcgcagtgagccgtggccgtggcaggcagccatca

SEQ ID NO: 19979 - DNA, 1501 bp, Oryza sativa
ggatagaccgccaaacgtgtgttccattggcttttgaggtttgtcgaaacaagatttcggcaatactaaaagggggtggctatcaagctagaaaagtggatgggtttgaagacaaaggatttatacaggttcaggccttcttattcaaggagtaataccctactcctgtccggggatgaatccgccgagtgtattattggatgtataatctccagaaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacagataaagatattctatctatattcggtatcctatatccagtctaaatataatcgccgtgtagatatggggtatccataatctccacagtagcccccgagacctttgcagtcaacaatcatagctttctcaaaaataataatccgagtgctttaatttcttcctgctaaggcctgccgagtagcgaagacaaagactgtaatgggcgaaaagataaaaaacattgtgcatcgaatagatgcacctaattaggtgtagcccccgactatatgattagttaacaaacgaaacatgtagtcgagaacaaaattatagcataatcatgtatcatatgacaaaagcatatgcggcgcccaacaaggcatttagccgactgctttccagccatagtaaaaagaatctgagtgaataacactctaaaaagttcacaaatgaacacatttgacaggcacccgagtagaaaactctaaagataacccatcaaatattataaaaattatggtaattaataagtctaatagcctaggctatgactcttcaccataattaaaataggcatataacacgccaagagaatgaccattgtaaaaacaagtcatcccaaattaacccagacagcttttgcagcctaaaaaagcttacaaaaatagtataacacttttctgtcgggtaccttttaatttgcattgcaataattccaaagaattatataaccgcattaaaaaggattttatcagcattgagccacaccattgtgagcataaattgccaaagcaaaaatgcctaagtccctaaggagcacaacgggccacgctgttaataatattgggctgaagtactgttcaggcctaggcccattagcacccccgaaacccttaacagaaaatcccgaaatctaagctgcgcttcgtcttccccaccgggactctcgccattttccccattccttgctatagtatagaactgcgccggcgaaactagggttcaccattctgctccaatccaccttcaaaaagttcaccaaaatcctccccgcgactcaccgcttcaattccacatctctccccagccatccctcgaatcagatcagctcattcggatcaaatcga

SEQ ID NO: 19980 - DNA, 1501 bp, Oryza sativa
actgcaagattaacatattccatacgtgagggcagaattaagggtagttttttgttttctatcgtactaaataattggcactattagaaccatggaaagtttgggtactactaattttttttttagggtagagttgcatggatcatctttggttagaaccaatttagagtcaaatttgattggtacatgtagagttaccatattaatttaggcattgctaatagtttagctttaatgcgaactactcacatctactattcaaaaaaccaattgattggtagggcacattttagtatccaaaaattgctctaaatatattatgatatctttagtgagtttaagcgatggccatgaagccccttaggtagagactaactatgctctctccatccccgaaaaaaaaaaaaaaaaaaaaaaactatgctctctccagtcttttttttcctcaaaaagtctaactatgctctctccaggtaagcagtactacttgtcatagttctgcaaactgttgtgcaacatgagtcaactagtttgtctgcgggcacacgcggagtatttaagttgtaaagaaggaaagatgactatagccaactagtttgtctgcgtaatgtatatgtccaatatcctccctcagcactactacagatccggacttcagtgacgggtcatctgtgacaggccaacgcaactcgtcaaagatgagtcatctctgacgggccgaaaaaatatcctcttcaatatatggctaccagggaggacccgtcacagatgtgaggtcatctgtgacggcttgcacttgtaacccgtcacagatcgtctgtgacggtcacaaccatggctcatcacagatgacatgtcatctgtgacgggtgtagtattatgaaccatcacaaaagagaccactcaactctgacgggtctttaactaacacacgtcacagataacgttatctctgacaggtggtagttatgacccgtcagtgatgagtgaaaattcaaattttaaaattttgcaaaaaacctcagattgagacatgtcttacataaaagttgtagctctcaatgatatccacaactttataactaacaacatttctattagagatcgtttacatccccgaacatgcattacaagttgatcagatctacttttaaaaacaaaattttgagtttttttcaaatgacatggatggatacatgccccgtatcaaagtcatagaactcaatcagatctacaacattataattgaaaatattttcatttcacaaagtttacatgttcaaaatacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataacaacattgggtgagtagtc

SEQ ID NO: 19981 - DNA, 1319 bp, Oryza sativa
tcctgcagcccatgtcactgccataaggtgtttgaggaagatcttgtttctggacttatcttgaggttagttaataatttactggaaatgatttaattgattatgacctagtttacatattaatctacatatgatgtaacctgaaatgtgatttgattatatatgatttgatggaacctgaaatgtgggcatgctcaagatgatatctcttcaagttgctgaaatgataatataggctataatgtcaatagcttgctgtatggagcagtgtttctttaagcttgctataggactgttattctattccctattatgtagaagtaatattgagtccatgtcttcaaaattattgcctaagtggacactttggcagacaacaaaaaaagctccaattctgactttaaaatcagaatccgaaatttatgagcagtgattcaatctgaaatttgtgattgttgggcatgtttatcttttgaatttgaatagtatatattgatatatgatctcactgaagctgaatctgaaaatttataattatgtatctgaatctatttttttagtatgtcaggtaataatatctagaagatctgttcaatgtgggtcacatctgtgcgattggaagaatgcaatgtgatcttctgctgctgcacatgtaaccggtcgatctcattgccaagcaaggataatttacttcctagttgtctgaacatgtaataattcactttgttgctacctgaacatgtcacctgggaccatgatattcattgccatgtgattttgatatcttttaccttgcctcgaataatgatacatgttcctattttaatataaatgatgattttgtttcctttgttgtgtgaacatgctatctgcacatctgtatacatgtggtttaaaattagaacgatagaaccagtgttgagtccaacaaacaagtccaatcttctacattgtcagaccatacgatgtctcccaataaaccacctagcagatgacgtcgaagacaatgttgatgtcgacattggcgactccaaccttggctctgacgtcaaccttgatgatgatgccgccgtcgacaccgacctcgcccttgaggatgatgctgttgtcgacctcgacctcaacgatgatgccgccgatgacgccgacctcgacctcgaggatgatgctgccgtcgatgtcgacctcgacgatgatgccgccgtcgacgccgacatcgacctcaacctcgatgatgatgccgccgtcgaccttgaccttgacgatgatgctgccatggaccttgacaactttcatcctatgaatatatacagcatgga

SEQ ID NO: 19982 - DNA, 1314 bp, Oryza sativa
cactcatattctcctgctaattgactgattacaaacaaggaatcacccataatctcaatagcatcggcttcaacctctttaagcaattgcaaccccttgagaaccgcttcatacttgtcttgattgttagttgcataaggcttaatagtataggcaaactcaaaacttgccccccgagaggaaattataaccaagccgataccacaaccatgagtacaaactgacccatcaaagaacaatgtccaaggcacaatttcaactgagccgattgagtcatcacgatgatccacaataaaatcggctatagcttgtcccttaaccgctttcggtgactcataccgaagatcaaactctgttaaagcaaatatccacttgccaaccctgcctttcaagattggagccgataacatgtatttgatcacatcggctttgcatatcacagtgcattcattggataatagataatgccttaacttagtgcaagagaaatacaaacacaagcacaaattttccacaggagaataccttgtttctgcatctaaaagccttcggcttaaataaaatacaaccctctctttcccatcaagctcctggatcagcaccgagccgattgatttttctccagccgatagatacaatttgaaaggaatccccttctgtagaggaatcaacactggtggggaactaagatattccttaatattatccaaagctttctgttgctctgccccccaggtgaattctttatcagcctttaaccttaacaaaggtgtaaacagttctaatcggccagacaaattagagataaaccttctgacaaaatttaccttgccgatcaactcttgcaacttcttcttattctctggaggttgaattttcttgattgcattaatactccattgagttatttcaatccccctttcatgaactaagaatcccaaaaactgaccagccgatacgccaaaggcacacttcgttgggttcatctttaagccatatttccgagccctttcaaaaaccttcctcaaatcggctatgtggttctctatttccttagacttgacaaccacgtcatcaatataaacttcaaccaaccagccgattaggtaattcatagccctttgatatgtagctccagcacttttcaaaccaaaagtcatcacaacccattcaaacaagccgattgcaccaggacatctaaaagttgttttatgaatatcttcttctgccataaagatctgattgtaaccaacattaccatccataaaactcaatatcttatgcccggaagcagcatcgaccaattgatctgca

SEQ ID NO: 19983 - DNA, 1501 bp, Oryza sativa
atggtttatcagaccttctcaagaaacataggatgatcaacaaaaacacggtcaactccccttttatagcagtggaagaagcgcactgtttctgtcctgtcaccaatattgacctacagaagtaaaaaggaaaaattagcatctacaacatcagaaaactggtataagttaaatccagctaaatacgtacagcatggttaaaaactttacctcgacaaggacatttgtatcccatgcatctttgtattgatcataacgaggaactattgtcatgacacgatgtcccattgcctatgataaaatgagtttcttcacacaagatgaactgtacataaagggcaagtgcaatgcaatgtaggaaaaaacatatgaatgataaatcctgcattaaatattagcatgatgtacaaaacttgtatcttgttaactcaacttcaaccagttatctcaatgaaacctagttgcataagaatgtgcaatcgaacaggagcataaattgtttgcagaatcagatcaaacccctgtgtttgtgaatatatttttttgctagaaacactgaggtttgatctgactgttggatttaacaatacgtgacaaagaatatttacagcaagagcagggggcagtccccctagaacatcaccgaggcctccagttttgcaccatgggtgacattcagttgcaataaaaattattgtcattccagcagagcatactataggcatgtgagacctcctaggcttagtgcaaattccagtgcttgttgctattcttttggccatatgtttgttaatccgcacagaaagggtatccctctttaggaacctaactccatagttgtacgattgttggaattgcatatgaggtgattgctttaaagcgccaacaccatttgtttggtaagagcagtaggtaggtgttgaacccattgttctagccattcagtgacacctacaaaaatgccaaatggtggttagaagttctgctctagaaataattctcgtttggaaaaacttaataatgtaatgatctaatccacagtgtgctcatctaatccaagatgtgctgaatgaaaggcaacattattatactaccaaaactttgaaaatttaggacaaaacaaaaatggttcctagatatttactatactaccaaaatgttgcacattgctatggaattaaaaaatcgaatcagcacattgcaaagaggaaatatattttatttttagagcttacaaatggtttctagatatttactatactaccaaaatgttgcacattgttatggaattaaaaaatcgaatcagcacattgcaaagcggaaatatattttgatttttggagcttacttttagaattaattggaggttcactcccgtaaaaaaggatctagttattattggtgtgcaaggatgaacatgattgagagctccaaggtctaaccgtgagtccgtgacttctactgttgtaccagaaagtggatagatggtgatcccacatgg

SEQ ID NO: 19984 - DNA, 1501 bp, Oryza sativa
tctacagatgcaccaaacgaaagtggccatagggcagtcaaaaatgatatggtcagtcgtttccttgttgccacagagcaggcaattttcagacccaaccgaccctttaagtttcaattgctcacaagattggattttgtctctcagggctagccaaatgaaatgtttcaacttcatagggcaaggacaacgccagacaaactgtaatctctcatctaaagcacctctgaacaaaatagctctgtacaaggattttgtggtatacttcttattagaatttagacaccatctcaaggtatcaggggaagaggacaagaccaggttctcaatgatcagcttaatttgacgccattgttccaattctatgggacccatagatccaagtgtttcaggtctgcaatcaaaatctcttgttgattgcagatcataaatagctcagtaaaaatgatcttcagagggcagtcgccctgccaaatatccagccaaaagaagatgtgagtgccattccccacctgccattctgagcccaagttaaaccactttcttgtattgagaattcctgaccaaaattgagaaactctctttgaggagcactgaaagacaccaccaaagatcaagtattttctcctcagtaattccacacataaactctcatcagaggattcaatcttaaaaatccatttggctagtagagcagcattcaaagtcctagtctcagtaaggcccagacccccaaactctttaggaaaagcaaggtcagaccacttaaccatgtggtatttccttccttgcttattccctgcccaatagtatctgcctctaatggagtcaaagttctgatgtaaaccctcataaagttggtaaaagtccatcgcataggatgagtgatgaatttgccatcaccaactcccaaaattctgatatgtgaccatgtgggatcaccatctatccactttctggtacaacagtagaagtcacggactcacggttagaccttggagctctcaatcatgttcatccttgcacaccaataataactagatccttttttacgggagtgaacctccaattaattctaaaagtaagctccaaaaatcaaaatatatttccgctttgcaatgtgctgattcgattttttaattccataacaatgtgcaacattttggtagtatagtaaatatctagaaaccatttgtaagctctaaaaataaaatatatttcctctttgcaatgtgctgattcgattttttaattccatagcaatgtgcaacattttggtagtatagtaaatatctaggaaccatttttgttttgtcctaaattttcaaagttttggtagtataataatgttgcctttcattcagcacatcttggattagatgagcacactgtggattagatcattacattattaagtttttccaaacgagaattatttctagagcagaacttctaaccaccatttggcatttttgtaggtgtcactgaatggctagaacaa

SEQ ID NO: 19985 - DNA, 285 bp, Oryza sativa
tgagcatcttgatgtccaaaagggttggtgtcatcaacccatgtccaaagatgaaggcattaatggtgttaaaccagaaacatgttgcggccgataacatagatttgttctttggcatatcggctaaagacagttgaaggcactgttctatttttgtcttcctccatgacgattgcttggtagtcaatacccttttaaactaatctttccactcatgaagttttgggggccaagatctgaagacatttggccaatgactgagttctggtttgattctctaaaagg

SEQ ID NO: 19986 - DNA, 1501 bp, Oryza sativa
tggagtcctgggaaggcaattgtatctactaattaggacattttatgtaatttcattagagatatgcttgggcaaaagtctgctgtaaagacttgtcgtatcttagagtttgttagagataagagtcgtgtccggtatgggaatgttttgtaattctcgggtataaattgccccgaaccccatgtaatcaaactaacacacgttcaatacaatttcggcgcatcgccaccctttttgctttcgttttatttcggcgagttcttgctttcgggttgagctgcatcggtttcgatcttcaacaagaggtaaaacttgttatggcggcttgcgttctcgggattagtgcttccatctttatgacactctaatcttgtttatgtaattcatcgagttatcatatatcttatataatcttcgataatatcgtcatctaacctacaatcggctaacatctgttaatagaaggcgtccgattaggttaaatagcgacgttagcttggattatataagatatccaccactctatgaaacatccaacgacttgattgtctagatattgctcttcttttcatacttaatgctgcatcagttgagtttgatctattaagtcgtgcttagaatttcaatctctagcctgtcttctggttgccgattagggtagtatcggggtttcagccgatcttacctggtttaactatatttgctttatgtgctttactgacatgttaaatctgccctttatgtcaagatcttattgcatttaagtatattaggcttctgtttggtatattctacttgcgttaatatcttaatatagagtggtatcggagtattatccacaaccagagttctaaatggaaacgacaaggactactcggattgtatccatatgggtttccctagttctacttggacaaggggacacctatgggtataaatataagaccccctaggaggagaggggacacgaccacctcaatcaacaaccaccacaatctacggaataacagaagccacaacaaacaagccaacatacgccaagacaagacaccggatatcgacttcagggataagcacggctagtcccctacggtgtctccggataccgtcaggagagacaaaagctctatctctaatctcgccggacacgaactcgaggaaaaatgctaccctgttgtcgactacgagtcagaacctcagaccgccacgtcgacaacagttagataggctaccccaaatattgtactgttgtgattatggtgaataaaagcaacactggctccggccaacaggatgtaaggttattacctgacaattcaggggctcgaagctatataaaaatcttcgtctccatctcttttacttcagtctcgcatatatcctagcatcaacgatccccataccatgcaaataccggaatcgcgacatcaaacgtcgacagtggcgcgccaggtagggggattttggtgctttaggatttcgacgagatgggttcaagaga

SEQ ID NO: 19987 - DNA, 1501 bp, Oryza sativa
agaacatttttagttggataaaaaagggcaatggagctttatgatttttagtcctgattggtgttaccaaccggattaaagacagccggggctaaagataaaaacatttttatacttcttcttcctcctccagcccgagccattgctacaaaggtttggaggaagaagggaggtgctaccaaatttttttgtgaaagtgtttcggtgataatatacaaatcgaaggaatctaaaaggttagcaactccatcctctgataatgtatgcttagtatattacatttatagttatggttatatacattattgtctctgaaaaggtttatggaaaatgacaagagagaaaatttgttaggataaaaataggttacttttaaaattagaaacatgtggataaaaatgttataaaatagatgacaaaggaaaaatatagaaaattaagataaaagaatagaaaacaaagttaatttaataaaatagttagaaaaagtacaatacattaaacatatcattagaactttaaaaataattaataatattaataatatgtgggattattgtatgattatttgtatatagttattgtatgattatttaattagcttgactttcgtggattttatttttacgatttttgtgcatttcaggtagatggatcggcaatggatgtacaccgcggaacgacggtcgacaaagtttattgaaggcttgcattattttttgagtgttgccaatgctaacaagcataagggttttacatgttgtccatacaaaaagtgcaaaaaccaaaagtagtattctacatcatgaactatttatgcccacttgtttcagtcgaggttaatgcctagctaaaattgttggacctcgcacgaaaagttaggggttgcgatggaggaagatgacgtagaagacgagaacattccggactgggctcaatacggtggatttgatgaaaatacaacaaacgaggcggacgagtgttgacgaaaaatacgaggcctgagagatctgcttaactccagtgcaggtccaaaactcgccttcgggtatgctagcgtgccagttgatttgatcctgcaatcaacaagaaacaaagacaaagaaactgtagttaaatccataaacgatagccgatcggctgagtgccgatgacatatcatttatctttgggctgatgtcatatatgaatcgatcggcagtccttaataaataagaaagaactacatctactcgatcggctgtagatatcaccaatatataatcctgacgtcgatatatacttaaatcaagtgattgggatagatcggttgccatgccgagacagtataaatcacttagatcgaaatatgtactaacaacaagattatatatgttcatagcatagccgatcaaatagatctagcatgtatcggctaattctccgataccactctatattaagatattaaagcaagtagaatataccaaacagaagcctaatatacttaaatgcaataaga

SEQ ID NO: 19988 - DNA, 176 bp, Oryza sativa
attcctgcagccctgggacaaaaaatgacttataataaaaaaaattcaactataaagttgtagatcgcgtcgagggctagaagtttgatataaagtttgtttcattagagttcacatgaaaaagttatgaattatttttaaatataaagtctttagaccgtcctatttgacccaga

SEQ ID NO: 19989 - DNA, 1501 bp, Oryza sativa
tggttcaagaagttgacgacgtgatcggcttggttgagtgtgtcttccttgaggagggtgtcgaggagagtgatcgccgcaaccgcgttctgttggggggtgcggaagaccgctgtcccctcaacgtcttgctgcccgataagttctcgcgctcgtcgccctgcgtctaaggctctttgtcatcggtccttagcctcctttgcagcccgttcacgttcctgttgctcacgctgcagccattcttgctcttgtgcttggcgctcctcttccagtcggcattgctcggcctcctgttgtacgcgtcgtccttctgcttctcgggcttggcgctgttcttccgtctcgttgtcggccatgaagacgccgaagtagagaggggtgtagttatcttcaaagctttcggcgaagtcgtcgaggttgtggtcgtcgtaacaatagccgaattcatcatactctacgatctctgttggttgtgagtcgacaccgggggagctgaagtagccttccaattgatccgtcgaaaccgtgccgagtggctggagtatgatgccgacttccctagagctaggccggatcggtgctgaagccggatcctgcctaggcctacggggagaagacatccttgtaataaagacggcagccagatcatcggggagtttcatcaggattggcgggtaggacctatcgtcttgatctggtggcgttgaagtagattggatctcgtccgagtggtttgaaaccgactcgtcggagatgaccttggggtagatctcggccgagttcgggataccgaacagagcggagatccggcctcttcccgactggttcgaatccgagtcgaggagagaaatcttgccgaagtcgttggtgatgaagtctagactgccgaaccggaacgcctgcccgggagaaagacgaagtcgtcgatgccggagacggaacccatcgcacttaatcggcgaagaacttgatgctacccctacctggcgcgccaactgtcgaaacaagatttcggcaatactaaaagggggtggctaccaagctggaaaagtggatgggtttagagataagaaattttatacaggttcaggccttcttaatcaagaagtaatacccgactcctgtccggggattgatccgccgagtgtattattgatcgtatgatctgggagaaaaaacgtgtccctagagggacccggacccctccttatataggggaaggggtccgtattataaaatacagtccatatccctaacgaaatatgtaattacagataaaatacaatcgtaaccgattagaatctcggatatttccttcacatacaaaaaacttaacccacccgagtcctcttgaagatattctatctatacatagtaccctgtacccagtcggactatacatgccatgtagatatggggtatccataatctccacatcttgaaaaagaagaaggacgtgtgggccaacagacaccccatcacaaactctctacattttata

SEQ ID NO: 19990 - DNA, 1501 bp, Oryza sativa
aggttcgtgagtgcgtcgggagtgtttagaagattaattgaaaaccgattattgcaaggcaagtcacacagatcctaaacccaatcctttgagcatgttgatcctatatttaaattctctatttatttcaactgtgcatttattttcgaatgtcactgggtggtgtgaatctattcctttgttatggcctgtttgcattgattactttattctttgataccttgggttattataacttgactagttgagctttatatattggttcagctagatattacatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcacgagctactgttgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtaattatgatccaggaatggtgcactgtggtgagttgtgttgtgcagagggtattgtcacagcctctatttgggtactttccagtatcgtgacgcatggtagacatgatgttgaggctgtgtcttgtgggtacagtggtacacctctggccagagtaaaactattcaaatagccgtgcccgcggttatgggcgggttgagcaatgtttttcgtgattagtctcacctctcacaataattatggatgttatacctggtaataatttgcttagctcctggtttggagttagatctgtacagccgggtatggttgttcaggatggttgggcctgtgcagcatgggtgtgctattcagtgttgattaaaatttctgattaattactccactgttttacttctcttaaatgttttgctaaatgctgcttttgcaaatgagcctatattatgccatcctttggtatccttgtgcacttgcatatttgttgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgttgtttttcttttttttttaagtatgtaacgttattattatgatggatttgtatattaaattgtcagtttgtgtacctcggctgattcctggacgaggattttatgcacaaattagttcggaaattattagtgaatttccgggcgtgacagctgggctcgaggtgcgtggttcggttttgttagtcgtacctcgggtactataaggattaa

SEQ ID NO: 19991 - DNA, 867 bp, Oryza sativa
ttacaggtgcaatcaggagctcacctgtaatccatgcccatgggtggtggttaaagagaaaccttatatggcataatatgttaaattgcttcctaaaagttggcattgtagtcgatttccttaatactccctcatttactaaacgtttgacgccattgatttttttaaacatatttaaccgttcgttttatttaaaaacttttgtgaaatgtgtaaaactatatgtaaacataaaagtatatttaacaataaatcaaatggtaggaaaaaaattaataattacttaaacttttttaataagacgaatggtcaaatattttttaaaaattaacagcgttaaatattttggagggagtacatagaaacattttggagggagtacatagaattttattgtagtagatttaataagtcagacctagcacgatagttatacctcaaagttgcatgccatgtgtgatatttgttaacttcgtggcaagattatataaatccgggttgattccgttcgtcttgtccttgccttcgtccatagttgccccttgatcctaaagcgcagcagcagatttatgagtaacttgtattggtggtatacaaatttgttaggtggatacgatttagtacagtacacgaaattgtctagttcgtaagaacgatgataaaataacttgcaatgttaattttataaagctgatattgattaggatactaatatttaccaatactagtggaaatggttagtactagatctctaccactaactttgatcgtatattttgtattttttatggttatggtttgcacttaacgaccattaacaataggctgcatgggtgtttgacatgccatggtgctgaggagcacaca

SEQ ID NO: 19992 - DNA, 213 bp, Oryza sativa
gtgttgaatctttgacaaggcatatgcgagattgtgagcacatgcatcacatcaccttaggtttccatgtaatgatatattaagttggctttgaacctacattattcagtgctagtggtgattattcacaagttacaagtcatgttggctttgccttttctttcagtttaaaactgattgacataagatgtttgttttcaggcctgcataaaa

SEQ ID NO: 19993 - DNA, 1501 bp, Oryza sativa
caaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtagcaccaaccggggctaaagatcaccgggataccaaccgggactaaagttggtaataccaaccgggactaaagttacgatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagattgtttctccaccagtgcacataaaaatttttatttttccagacgactgcctccagacaggcaaaatccccacacgggaaaatgaatttgaccgtccgaaaaaatagttcatgtagaagtgcgtgttcgaggccgacaaccaggtcaggaactggaataatgatcaggagctcaatcaagtcctagtatgtatatgtataagtgaaacactgaggttgttaaagtgccccagaatatctactgtaactatcacatattagagactagcatattgggcatgcgttgcatcgggattttaattaaagaaaactattattacctcattattactattattttatgcatacattatcttaaatcctttggcccgttctacaatcattttcttttttataaaatgtagagagtttgtgatggggtgtctgttggcccacacgtccttcttctttttcaagatgtggagattatggataccccatatctacatggcatgtatagtccgactgggtacagggtactatgtatagatagaatatcttcaagaggactcgggtgggttaagttttttgtatgtgaaggaaatatccgagattctaatcggttacgattgtattttatctgtaattacatatttcgttagggatatggactgtattttataatacggaccccttcccctatataaggaggggtccgggtccctctagggacacgttttttctcccagatcatacgatcaataatacactcggcggatcaatccccggacaggagtcgggtattacttcttgattaagaaggcctgaacctgtataaaatttcttatctctaaacccatccacttttccagcttggtagccacccccttttagtattgccgaaatcttgtttcgacagttggcgcgccaggtaggggtagcatcaagttcttcgccgattaagtgcga

SEQ ID NO: 19994 - DNA, 1501 bp, Oryza sativa
caaagtacaggcggcagctgttccacccacttgccggcataaggattcagtcggtcgaaaactcgtgcctttattccttggagtaccattccattggctcgttctacctgtccattgctcatggggtgtgctacgtaggcataacagattttaatgccgaagtcttcacaaaagtatttaaatactccgctagtgaattgagtgccattatcagtgatgatccgattaggtaccccaaaccggtgcacaatatttatgaagaaatctctagccttgtctgccgtgattgtgatgaccggtttagcttcaatccacttggagaatttgtcaacagctacaaagagatgagtataactgccgattgcctttttaaacgggccgaccatgtcaagggcccaaaccgcaaacggccaagacaacgggatagtctataactcttaagctggaagatgagtttgtctggcaaaaaattggcaaccctcacatgtccgcacaattttgtcggcatcggacacagctgtgggccagaaaaaaccttgccggtaagccttgccaacaatggtccgtgcggcagcatgattgccacagatgccggaatgtatatcgtttaacaattgtctcccctcctctaaggacacgcagcattgcaagattcctgatgggcttttcttgtacagctcggtctcatgaataatatagagcctactgcgcctagagattcgctcggcttcatctttatcttgagggagttcttgtttggtcagaaatcgtataaggggctctctccagtcggcttcaatcattgctacatcttgagtgtccatggtgtcacgtcctgataaattcatcccgaaataaaaatcattccctaaaaggaataatagaataaattaaaattcaaaaagaaattggcaaacactaaaatacgtataagaaaaattcgaatgtggcccggagaatttttgttaaattctccttggtctaaaatgagccctcaaattttacttgaattttcagagcaccggaaatatttattaagcaacaaaaacaattatcaaagcttaataaaaagaaaacctaaaaataatcctccttttcctttgggccaagtctagcccaaagcctccctctctctccccaggcccgcggccgaagtcattccctcctccctttctttttccctccccctcccggcccactccctcctcctccctctccctcccgggctgcctctccctcctctcctcctgggccgcctccgggcccaagccgaggggcgccctcccgaccgtgccgcgcacgtgcacgcgctgaccgcgcgcccgcgtggggcccacgcgccaggtcgtcgtcctcctcccgcccagcctcctcctactccgtgaaccctagccatttcctccctcaaatccgcacgattcaaaccgggaattccaaaattgattagggggaattaatcccctttccctcctctctatttcccccttaattcccccttgaa

SEQ ID NO: 19995 - DNA, 1501 bp, Oryza sativa
aattttagaagattcattgtgtttttactattaataaaaaaaccttaatgaattattgcacattaaagcccaagggctgacattagtgaggggaaggccggcaccagcaagcggggcccacccaacagtgacacaagtgggcctttccactatggaccgggaccactgggatagtccacgggaatcgacaatctagattggcctgaggttgatccaatggctacggggcagtgcagccacccgcgacgacgactggcagtgcgcacaaaaggcagcgatgcatccagagaggcaacgacacgcatgggaagggagctagaaggggattgacagcggccaatacaggagaggacggtgatgacaatggttacctagcgaatgaggaggcggacagcaatggcggcacctagggaaggagagggaatgagggtgcatggtggtgagcattgctggccggaggagaggggaatggtggagctcactggcgaacgagggaggcgggttcccatgttgaggaatggcgaccaaccggtggccgaggtgcttgatgaggatacaactagctcaaatataaccatgactaccttatgtattcatcaacgaaaggtgcatatgttctatattatatttacttgttatatctttgaacaaacattgctacacaatgagtttcgtgtgttttcatttgcagaggttgattggggactaaaccaagaccttctccaagtcaattcctacttcaccacgtcacttttggtccatagaagacaagaaataaagatctacacattttggatttggattcggattcaggcctcctgacagcatcaacttcaaacggacctagccgctgatctataaggaatctcgggacccatgagtacttgttggaaagcttatgaagtttagtttcagatggttttggtaccacatcaaaattcccaccaagctatcaggaatctgcgaaacaaaccacgtatctcatccagtccgaatctgatatgggtcttgggccatgtaattgtgtcatgggctaagcccaagggggtgtgtgccctagggcaaccctaggacatcctaaatcatatttattcagtagttgttatagtttagagtcgggttttgcttagattatttctgccatttgttgatgtgaaaacacggtgccctgggagatctgcttaactccagtgcaggtcctaggctagccccgagtgtgtcaagggcgtgccagctgatttggtcctgcaatcggcaagaaagaataaaagtagaattagtcgactgatagtgtatcgtttatggtctcagccgatggagttagaccaaatcggctatggactggatatatcaaagaataataaaccctaaacacgtccaatcggatgtaatactatctatgtagtttaacagattgatttaaaacgatattatgaaagtagctgacgtgacagtatttagagaaagaaagataacgtactagctaatactctagtaacaa

SEQ ID NO: 19996 - DNA, 1501 bp, Oryza sativa
tggccaccaattacctactcttgtgtcgaaacaagatttcggcaatactaaaaggggtggctattaagctggaaaagtggatgggtttagagacaaggaattttatacaggttcaggccttcttaatcaagaagtaataccctacttctgtccggggattgatccgccgagtgtattattgatcatatgatctgggagaaaaaacgtgtccctagagggattcggacccctccttatatagcggaaggggtccgtattacaaaatacagcccatatccctaacggaatatgtaattacagataaaatacaatcgtaaccaactagaatctcggatatttccttgacatacaagtttaaacttaacccgagtcctcttgaagatattctatctatacatggtaccttgtacccagtcggactatacatgccgtgtagatatggggtatccataatctccacagtagcccccgagatctttgcagtcgacgaaatagccttctcttggaacataaagtaataatcccagtgcttcaatttcttctgtatagatctccgaataccaaaaccaaagactgtgaaggtttaaaatagaaaaaaccgggtgcatcgactagatgcacctaattaggtgtagccccagactatgtggttagttagaaaactaaacatatagtcaagaaccaagtggttttacaaccaaacatcatataacaaagcatatgcggcattcaataaaacatccagccgactgcttttagctttaacataccaagaacggaaatatgagaaagcccgagtgatagacactcctaaggtccataaataaacatatttgacaagaatccgagtaaaaaactcttaagatgatccaccaaatatgataagaatcatggcaattaacgagtctaaacagcttaggctatgactctcaccataatcaaaataagcatataacatgctaagagaatgaccatgagaaaactaatcatctcgaatcaacccaaacagcttttgcagcctaaaaaagcttacaaaaatagtataacacttttctgttgggtacctttttgttcgcatcgtagtgattccaaaggatcatctaactgcattaaaaaggattttaacagcatcgggccacaccattgtgagcacaaattgccaaagcaaaaaatgcctaattccccagggatcacaacaagccacgctgaaaatagaattgggctgaagtactgtttttaggcccaagcccattagtactcctgataccctaataacgccaaagagaaataaaacgtctcttcgtcttcctcgccgagactctcgccactttccccatttcctgctacagtgcaaaattgcgccggcaaagctagggttcatcgatctgctccaatccatcctccaaaactccacaaaaaaccttccgcgcaaccaccgcactgatccctcatccactctctgccatttccaaagcaaatcgcatcacccaattcgcatcca

SEQ ID NO: 19997 - DNA, 1501 bp, Oryza sativa
tattacacacttcaaaaatcaatttattggattgaatcaggataaacatttgacatttgttcagatatatgcttagaaacttgcatgttcagatatgtgtttacgctctccttggagagtatgtgtgactttttctttgtactaagctgagtacctagttggttgcaaggagatattaggtaagatcttttttattgggttaattggatccataccattataaatttgcttgttttgaaatataccattacaattcacgaagttagaaacataccattacaatttaacatatattagatatgtgccactgctttgaaagggtaagtagtggcatgtctcaaatacctcacaaattgtaatggcatggttccaatttaatgaattgtaatggcatatttcaaaactgaagaaattacaatggcatcgatccaattaacccttttttatttgtaatattatagtatcatgacactaacataggatcagaatattgtgaaattttagaaaatatatattttatataaaatacataatatgttgtataaattaaagcaaataacattgatttaaataaatttaattgttttatgtaaacttcagcatatttatttaaattattttcaatccaccttatgttaaaataatatttggggcctgtttgacacagcttcagctctagctctacctctcctggagctggaactcagccgaacaatttcagctctacctagaataggagcggagttaggtggagctctctcacaaaatgaacaagagatatagagctgggtttaggcatctccataactccactccagaccaaacttctagagctaaatttagtagttggagctctaccaaacaagcccttggtacgatgatagcgaatttcgcctacttattcgaaaactttccatggtccgcctccgaatcttagtatcatgatgatatataagattttgtagaatcgtgtgaaaattaatactaaaattaagatactttaaaaattaggatacgtgagaacgatatcgtctcaacttggtagacactcataacctatcagcagtgcatcattccggatgtacactacacgtgcaaatctgctatgctaactgccccacaaaacaagcagtacttgtctatccaacacaggtggtctccaccctaaccggattcgggcgcatgcccgtacccccggtcagacccgcaaccgaccactttttccatttaagaaaacgctctgctcatctcatctccacccgttttcctcgtctcgctagtcaaataatccatacatctctctctttctctctctctctcctcaagttgcttacgtggccaaccgcgtgcgtcgccgtcgcctccctataaatatgtacgcacgcgcgctcaccttaccgccaaccgccactcactgtactcatccatcgatcgctagctgcgcacgccactgcggccgcgtccgcctcacctaaccctggcctgctcgatcgccggccga

SEQ ID NO: 19998 - DNA, 1501 bp, Oryza sativa
gcatagtagggtttcattttcataaacaacatttaataaacatttcagaatttaataaaacagttaagtaataattaaacaatattaatccaacgctatacaacataccctgttgcataggcccaaccatactgaacaaccatcccggctgtacagttctatctccaaaccaggaatataccattccaaaccaggagctaaccaaattattaccaattaaagcatcttttattatgatgagaggtgtgagactaatcatgaaagacattgttagacccgcccatgaccgtgggcacggctattcgaatagttttactctggccaaagatgtaccactgtacccacaagacacgatttcacacatgttgccatgccctgaagtaccaccacggcactgcaaagggggaaatcgtgacaatacccttcgcacaacacaactcaccacagtgcaccattcctggatcataatcacccccttataaaacaaggcatggactccctagcgacccccgtgggcttatctccgccacttctcagtctggtgccccgcaatgaaccatgctatacaaaaggtaaagccgttgcccacgttggcttgtggttggcacggttaatgtttcacaaccgaaactcgtgaaccggtccttaattgtcatgagcacgtctctcaaaaccatgtgctcacaacccaccattatcatattttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagaccaactagtcaagttataataacccaaggtatcaaggaataaagtaatcaagaacaaaagagctataacaaacaataggttaattccacctaatgacattcgaaaataaatgcaatagttgaatagaaacagtagctttaaacgggatcaatatgctcaaagggttgtttgggatctgtgtgagttgccttgctggccttggaactcttcaaattcttctcctgcgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagatttaatcggattaaaacacttatatagattttaattgaattatgacgcaataatgaattatttttgaaaaggaaaaaggatttattgcgtcagcggctagggtttgcggtggaccgagcgcacggcggcggttcacgggaacgaacggccgagatcgatccatccaaatcggacgaccgagatccatcggtccacgaccggaccacgacggacggcaacga

SEQ ID NO: 19999 - DNA, 1501 bp, Oryza sativa
ctgttattccgtagattgtggtggttgttgattgaggtggtcgtgtcccctctcctcctagggggtcttatatttatacccataggtgtccccttgtccaagtagaactagggaaacccatatggatacaatccgagtagtccttgtcgtttccatttagaactctggttgtggataatactccgataccactctatattaagatattaacgcaagtagaatataccaaacagaagcctaatatacttaaatgcaataagatcttgacataaagggcagatttaacatgtcagtaaagcacataaagcaaatatagttaaaccaggtaagatcggctgaaaccccgatactaccctaatcggcaaccagaagacaggctagagattgaaattctaagcacgacttaatagatcaaactcaactgatgcagcattaagtatgaaaagaagagcaatatctagacaatcaagtcgttggatgtttcatagagtggtggatatcttatataatccaagctaacgtcgctatttaacctaatcggacgccttctattaacagatgttagccgattgtaggttagatgacgatattatcgaagattatataagatatatgataactcgatgaattacataaacaagattagagtgtcataaagatggaagcactaatcccgagaacgcaagccgccataacaagttttacctcttgttgaagatcgaaaccgatgcagctcaacccgaaagcaagaactcgccgaaataaaacgaaagcaaaaagggtggcgatgcgccgaaattgtattgaacgtgtgttagtttgattacatggggttcggggcaatttatacccgagaattacaaaacattcccataccggacacgactcttatctctaacaaactctaagatacgacaagtctttacagcagacttttgcccaagcatatctctaatgaaattacataaaatgtcctaattagtagatacaattgccttcccaggactccatccatgcgtggcaatcatcttgaagcacttcaacccaacccgatgttgtgcaccaagtcgtattgtcagaatcggctgcatcatctaaccaagtctgactccaactcagccgatccaatcgtagccgatccggactccagccgattcttactctgtttccgcgacaatcttcatcttcgattccgcttcaatctagtcttcatctccgatactgatattacaaatttggtcgttaacaacgaggatgttgaagacaacgacggtgcggatgatcttggtcagatgttgcatgacgtaaaggaggactgcaaaagtgaaaaggagatgcagaaactagagcgcatgtcagcggaccaaacatcgttgtacccaggttgcgaataggggcacaaaaagttgggtaccacacaaggcataaaattagagcgtatgttagcggaccacaaaacgtcgttgtactacgttggaattcttgcaatggaatgccaaaa

SEQ ID NO: 20000 - DNA, 1501 bp, Oryza sativa
ctggatcctgcagaacaaacatataggatgagtagtatctgatataaatataatactcgagaaaaaaatcaagtattttaaaatatttataaatatatatttctcctcttgttaattttgatttccccgagcagatgactcattacgtttaaacactctgcccgactagtcatagccaccaagcactgggagtcggcctaagcacttcccaaacatgcatatgagtgacatgagttcaccattaatagaacaaagtttcacggatcaaaatttactactcgggtacttttgcgattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtagatgatgaagcccattaacggcggcgaagtctgccaaccgtataggcaaaaacaccagtcggcggcggcgaaggccagccggtcggcgaagacgtggacgcccatgaacggtggtgtgaccaaccaaccgtataggcgaggacaccagtcggcggcaacggaggcaagccggcggtgaagtcgtagacgcccaacagcagcggcataataggctagccgtgtaggcggaggcaccagtcggcggcgacggaggcaggccggcggtgaagtcatagacgcccaacagcggcggcataataggccagccgtgtaggcggaggcaccagtcggcggcgacggaggcaggccggcggtgaagtcatagacgcccaacagcggcggcataataggccagccgtgtaggcggaggcaccagtcggcggcgacggaggcaggccggcggtgaagtcatagacgcccaacagcggcggcataataggccagccgtgtaggcggaggcaccagtcggcggcaacggaggcaggccggcggtgaagtcatagacgcccaacagcggcggcataataggccagccgtgtaggcggaggcaccaatcggcggcgacggaggcaggccggcggtgaagacgtggacgcccatgaacggtggtgtgaccaaccaaccgtataggcggggactccagtcggcggcgacggaggcaggccggcggtgaagtcgtagacgcccaacag

SEQ ID NO: 20001 - DNA, 1501 bp, Oryza sativa
tcaaactccaccaaacccaacgggcaacacttcactagtgtctctctctctctctcacctctttttctactcggccgtacatgcctcctgttctcagatggataatcatgctgtactccccaactaaatggtgtgttcctttttaaaaaatcactaatctctcttactcaaaatgagggctgatttggtttaaagccaaaactgccatacaaaaatattggtattttaaacagtaattttggcaatgtttggtctactaccaatacttgtcaataccacacaaatgttaccaaaatattggcattggcaaaaatttactcatgatttggcattggcatagttacaaaccaaacaagccctaagttaacataaaatatactaagttgatttattttggaatgaagaaaatagatgaaaccttattcattgttgcatgataattatatatgggttgtaaaattttcttttgtattcctatatatttttctatgcgctttttatatatggtacttgatcgattatctaaatattataaatggtttggaggtatagcgtagccttttttttataagagagtcgatatgcatttttttgatgaattatttaaaggctaaaaccaattaaaatgatatagcatcatgatagaaaaataattaacattaactattaactatatttagtgcagatgaaatttatagatattagatagatagaatttgtacacaagttttcttaaaaggaattgagtaactttatttttttatagtttgtaataatttatacttaattactatcaagtgtccaaacgaactcacccttagtccaaacaagtgtatatttcttttttaaaaaaatctatatagagatatcttagaaaagtttttaaaatctatttttttaactttcttatatttgatttatcctattttgctctagaagagttatcataaaatgaaaaaagctattctctctttctgtaaatataagcacttttggaatagagctcaaacttttaaagtttggctgcaaatagaaaaaaaatcataaaaattgatgatgtgagaattatgtttatcttcataaaaatcttaattcctgtttaacttatgaggttttctgtctttttactcagtatttacttttggaccactaagactaagactagaactaaaagcttcgcactaaattactattattgattatatcagtttcgatttataagccgcacggccgcggctgaaatgtggagattatgggtaccccatatccacacggcatggttatccgactagtaataggggataacatatatgtatggaatatgtaacagatcgtgacttgggtattacgtttccttgtatattacggaacggcctaaagtcctggtttgataatattgtaaaatagatttaggaaaccgatgccgtattggttaaggtttctatcttgtaatcctgccccccaccctatataaggtgggcaggagaccctctagggggca

SEQ ID NO: 20002 - DNA, 424 bp, Oryza sativa
atggctcaaataatggagaaggaaaagggaaaagacaatgagaaaacactcgtggaggaagaaataactgggggcaatctggaagaggccgaggacaatggtggaattctggcagaggtagaggatgatggttgaataatgatagaagcggaggaaaagagtatcagcctaatcatagcaagttttgtcaagcacatggtctaggtggtcattctacggaagaatgctatagcaagttttgccaaatccatggtctaggaggccattccactgaagaatgtaggcacatggcttacttagtggaaaagcatgtcggtcgatatgagaacaagcattagggggcttgagatcagcgagggaaaaatgccatagaagcaccacaagtcatgaaaatagaagaaattgaagaagctccaaaaagagt

SEQ ID NO: 20003 - DNA, 1501 bp, Oryza sativa
tttttgccacctctgctgggcaatattatctctgtattggtcgtcttgtctctatgccaactgcgtcagctaccatcaatgaacaattgtgactacgtgctcaggggcttactagctcaaatacaagtattatatcttcaatttggacttgctctggatacatgcaacatgaattcatgatcatgggtctattttatatgctcaaagactggactatttattattccccgtaagggttatcaactgaatacttgcgccagttgggattcaattgttacatctattttggagtatcccataagggataatcactcagatcagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcgactttttaggagtcggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaaccatgtgtcttttagggacttaagcacatctgttaaagcagtgtgcgcatggcgtatgcccaatactttggaaatttctttattcacagcattcaagcttctttatagttgtcttgctatgtgaactttcaaagatgttgtcaactttaggttgtatgcatcatattttgccaagcagtcggtatatcacttggatcatattattcggggattcacaccgcatatgctatatattgatatcaagtcacttggttgattacaattatcaaaaccactcggttggttagattatttattccttgactatatgtttggttggttcaattaaccacatagtcgggggctgcacctattaggtgcatctattcgatgtacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttcctt

SEQ ID NO: 20004 - DNA, 419 bp, Oryza sativa
catttactcgcacatttagtaatgcaaatctcagcacaatgaattactggtactagcatccaagtcaagttcatggaaccgaatctgagagtacattaaacaccaaagatatatcatatcatatcaaatattcaaatcaaacggctagaatgcaaaacatacacgcacgcatgtcacgcgtttgagccagtcgaggaccaccggtgggcccagctgtcagcgaacgtgggagttggcacaggagagcgcgtcatcgagccgagccgatcgatcagtgggtgagggtgagagtggccggccttggccttctataaaacgtggcacctctcgctcctcctcgcatcatcgctcgcagtcgcagcacaaaaacatttctctcgcgagtcgcgagttgcaccgatcgaattaagggtcgaaga

SEQ ID NO: 20005 - DNA, 247 bp, Oryza sativa
cccacatccacaccacccaccctgccaccccggccttttggttgttgcgttcccgtcacccccttttttcttgccttcgcgtgttgaccaagcagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagt

SEQ ID NO: 20006 - DNA, 161 bp, Oryza sativa
atgatgagaagtacctacgtacttcggccagtttgtcttgcattcgtggagcggatctatagtataaggaccgatgactctcaataaaatccagtggcggagccagaaattatataacactggtagagaaaggggctttactcccggttagaaacccccct

SEQ ID NO: 20007 - DNA, 1501 bp, Oryza sativa
cttgttccggatacattccacatggattcatagtcatgagtctattttctatgctcaaagactggaccaattattattccccgtaagggctatcaaccgaatacttgcgccagttgggattcaattattatatttattttggagtatcccataagggataatcattcagatcagaagctattcatatgagctacacttggtctatattacccggaagatttattactcgggagcatgttacatgcgtcatcctttaaagggtgtcgaatgcatattttttggcctaggcctaatatgtctgcaacccatattttcaggtatggcctgtcacgttcttttagggacttaggcactttttgcttatgccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctaattatatattgtggtcattttctaggcggttggtaaatcctttatgagtttatttactcggattttacaccacatatgccatatatttccaggtgtggtgaaaccatgtgtcttttagggactaaagcacgtctgttaaagcagtatgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtacttgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctacataaggagggcagggagcccctctaggggca

SEQ ID NO: 20008 - DNA, 1501 bp, Oryza sativa
attatagtgcgccagactgagaagtggcgagaagtccatgggggtcgctggggagtccatgccttgtttataagggggtgattataatccaggtacggtgcactgtggtgaattgtgttatgcgaggggtattgtcacgactcctttccgaggtaccgtggtggtattgaggcacatggtgacatgatgtggggttgtgtcttgtgggtacagtggtacacctctgatcagagttttaatctattcgaatagccgtacccgcggttatgggtgagttgagcaatgtttttcgtgattagtctcacactactcattaatggtaattatgtggtaattaatttagttcctggtttggaatggttaattcctggtttggaggtttaatttgttcaaccggggttggttgttcaaatgtggttgggcctatgcaacatgggtatgttgtatggtgtttatttaatattgattaattatacaactgttttactattctcttaaatatttattaaatgctgttttctgcaaatgagctatattgtgccatcctttgttattttgtgcacttgcatatttgttgtgtggcttgttgagtatgttatatgctcattcttgcaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctagacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaaatagaactgctcttctctattctcttacaaattaattaagttggcagcacatgcgaggttatgcacaaaacttatttaattcaatttcttttcttttaaaagaaaaaggttgttcttttcaaaatgtttctttttctctttacccaaaattttattgattagtcggcactgtacatttattatggtatcgaattaatcatgttagcactagtactacttatctttcctatggtgacattgtaccgtgcttataatagatcataattatcttagctttattttaaatatttgttaaaaaaaataataatatatttgcccctgtctaaaaagttaaattctaaaaaaaatatttataaaatagctttgtatgtgtcttttcttttatttttcttccttttgggtcaaaaatcagttaagtctagttggtgcagctaacttagaaaaatatgcattaattcttctcttctatgtttctttaga

SEQ ID NO: 20009 - DNA, 1402 bp, Oryza sativa
acgaggcggacaaagccggcggctcggcttgcacgtggacggtgagctacggtggtcggcagcgaagggggaaaggctgccgaggttccccacggcttggcgcacctaacggcggcgagggaaagcgccggcgacggttgaggaggcgcgacggcacggctggacgatggccggcggcggcggcggcttgctcggcgtggcggcggcgctacggagcacgggagagcacgggaaagggggcaaactaaagagtaggatgaggggatgctttatataggcttggattgaagagatcgaactccaaacgagaggaattgatccgagaagattaaaactcggttttggagataaactcgaaaacgagtttgattcgaacaagatactcaacgatttgttccaaaacttgaggggaaagatagaggagattgagaggaacaaaacccctcaatcaatcggaagaaattgggagagatcggagcggatttggagtggagaagagggcggctcgggcacggcatggcttcggccggccggctgctagagcttgaagaagctcccgacaggtggggcccacctgtcggtggcttgagggagaggggtgaccggctcggcttgagccgactcggccggttttgggccggctcggccgctagggagagaaggaatgttgggccaaaatcggcccaacaacttaagggagggcttttggaactttttaaaaaaaacaatttgtgaaatgatgtttcatttattaaaaatatttcccttgctcaaataattcccagaaaattctagaaaatagaggaacaagtaaagtatttaataaaattttatctaactcaattttatattgagatttagcaaattaaaaaaaaagatcttctcttttaaccttttaaaattaataattgagctccgaaaaatccgagaaaattccagagagtataattaaccatggagaatttaataaaaattaaatccatccatgctttatatttagaaaattttatttcccacatttaacttcacttgtaaattaaagaacatttaatataaaatctattattaatttattaaataatttataaaccctaagacgaaaatcagggtgtgacaagtctaccccccttacaaagaatctcgtcccgagattcggaacggctagaaagaaaaaggcataggtaaactgcagtctatcttattccataactccgataattattctaaggctttaaagaaaactactactgctttgaaactggtcgctgagctgtaacacttgaagacacaaccggcactgcattcgctcctgtgaagacaatgttgttgacttggccttgtggctgttgacgcttcggcttcggacactcttttacgaagtgacctggctcataacaattga

SEQ ID NO: 20010 - DNA, 310 bp, Oryza sativa
tcaagtgacaagcatgacttgccttgctctgctgctggaggaacctcggcgactatttcgaagtacaccggatcgtcttaggaaccggaatctagcgacatacaaggcaaacaatgcaaacaggctaaaagactactgaaacagggaacaaaaccatttttaatggattctacacatttttcttgatttactgagacttgaatgggcttaaacggagctcggatgaattagttatgaattttagaagattcactgtgtttattactataacaaaaatccttaaataatttattgcgcaatattttccagg

SEQ ID NO: 20011 - DNA, 480 bp, Oryza sativa
attcctgcagcccagcactttcttttgcatacaacaaatgaaggaaacatctgacctagacaccacggctacgttatcgattagtactctagtcttagccaataattttcttctttatccagagtcttaatactagaacacttactagagcaatcattataaatactaagtgacaaacctacaatgacgagaagctatcttacttaaataagaaaagtaaacaccataaggaaatctcgaatacttactttgttgaagaaagcattcgccgaggtacacaaaatgaagtcaaccactaacctatacaccacgcctaagtgattctagcctcacgcaagaacttccttctttatctagaatattagtactagagcacttaataataatactaagtgatgtacccgcaacgatggcaatatatcacacttaagcaaataaattaaattccaaagggaaatctcgaacacttactttattaaa

SEQ ID NO: 20012 - DNA, 394 bp, Oryza sativa
tttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataag

SEQ ID NO: 20013 - DNA, 1024 bp, Oryza sativa
ggtggtcagaccggtggcatcgcactggtcagaccaacggggacacggcggtcaaaccggcggcggcggcgacaggaggcaggggtgatctttcagcggttaaatcgggtgatgaacaccggtcagatcgatttacatcagatacaatggtaacttgtaattccgctaaaagtttcggtttttaagtactataaccattcactcccctctggttggcttagtttttgctattcgatccttcaaagaatttattaaaccccatgcaattaatggttacagtgtgcaggtaggccagccaagaggggaaaggaggaaagtacgttaaggaggaagaaaaacaacaagggcaatatatagatggactctatccacagcgaccaccactccatttcatctcatccttccccaacctttctcttctccttgaacacacccctctcttcctcattatagagaggatttagcaaacatgcacatatacaaagagcaggaggctgaaccatccactggcctgatggtaattgcttttcttggcctggaaactcctaaatttcctcctctttttcagtgtcattttgcaagagggtttggatttcttttttaattgtatgcatatgggagctttgggaaagtagaaaagtagaatcatggctgctagctgatgtgtgagaatagctagatggccatgaagacggggagatatagctagagatctttactctttaagcaaaacaagaaaaagaagaaaaaaaggtgaaaggaaggcacaagatcaaagagattgatcaccacaggaccaaagatctctccttttttcttttgatctacaagaattatacaactcacgaaaggagctgtagttgcatatattaatttttaagagagatgatggccatgatgtctatggcacttcttgattttcttgccatagatccatcttccggtcttgcaatttcttgattatgttggcttatgcagtgctgttgagttgttgcatagaggactgatccatatctctggaatt

SEQ ID NO: 20014 - DNA, 282 bp, Oryza sativa
attttttttctttttgcttttggtaaatgtagccaaaagatcattgatacaggagaatattatatttatcttaacgatcttgcgaactctgtcaaacctatgggctcactggacaataacacatgtgaattggcattaattggtctgtctactgatatcaaggacaattcgaagagaatttttcctgccagaataggagtgagtatataaaatttacaaattaaaatctctttttaatgtactattactatcattgcaacaccttatgtttttttttccaca

SEQ ID NO: 20015 - DNA, 525 bp, Oryza sativa
ttcctgcagcccagatcgatccccagtagaatgactcctgttcagacttcttcatgtagctccctccccggccagaccagtcaatttgacattattcttggagacaaacagatgaacacaacaatggtatatacagtccagtgtttgtacagtatgacactcaatctaactggcatcctgatttttttttgcaaattttattagcaatgactatggaagtcagagtgacatttttttacgaccaaacaatgctttagattaaacattaaataatatcatgccacagttgttctattgtttcggaaatataatgaacaaactgccactaactctcttttttttttggttgatatccttcaggaaaaaaccccatgttattttgaagatttgagcttagaaatatgtataatttgtcaagaaaaactctagaaaaaacttttactgtggtcaacagttcgtagttattcttccttccaatacacgcaattaactatttttgtgtgctacactacgcacaaatgcagc

SEQ ID NO: 20016 - DNA, 326 bp, Oryza sativa
ttcctgcagccctgcgctagtattagagtagtaattaaaaacttaggtgtggtgtctacgttagagattacctttgttggttgggtatctcacggatttgtcagaggtaggcgacaggtgatgacagccctgaatcccgtcctagtgatcctccatgttcggatacattatagagccatagacggaaccacgctggcagactagcaggagtcggtgcccgaagcaataggtaggaaattaccttcaacttagcgtagataattaaaatatatagaaagtcctctctagccttgctagcctactaacggttgttgtccttggatagt

SEQ ID NO: 20017 - DNA, 439 bp, Oryza sativa
gtcagccgcgtcgtgagtctgggccaaggctgtcccaacaagcctcggtccaggcgccatcgctcctatcttttttactgcgaacaaacgcgttttggcggtcgcgctcgcctttttggcgccaaacgaggccatgccccaggcgatcatctgacaacatgctgggacagcgaaccacggattcaaccattgatcaagcacaggtgaagttctggcctcttctcttccttttttttagcaaattatttgattgtcttccacctcctccattagactgttggaattcatcaaagaagcctccagcaaaatctacatatttgagatggaagaaaacaggtctgtaagctatggttgttacttttttccccatgatcgggtagattttacttgttcgatgaccaccaaatcattttttttgttcctgtagagtgggtgtgct

SEQ ID NO: 20018 - DNA, 1501 bp, Oryza sativa
tcaataaaattttgggtaaagagaaaaagaaacattttgaaaagaacaacctttttcttttaaaagaaaagaaattgaattaaataagttttgtgcataacctcgcatgtgctgccaacttaattaatttgtaagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtctaggaatcaaccgaggcacacaatgacaatattgataatagagtacaaatgaataactatttaatattcgcaaataataaattattacagaggtagatagttcctctcaaagaaaaataacattctacgcagcggaaaaataaaactaaaacaatctacggaacagcgatggcgactccactccacaggcaacttaaccgagaacaagcctaatcctccagatcatcaccttcactgagatactcctcttctgatgaatgaatattgcaagaatgagcatataacatactcaacaagccacacaacaaatatgcaagtgcacaaaataacaaaggatggcacaatatagctcatttgcagaaaacagcatttaataaatatttaagagaatagtaaaacagttgtataattaatcaatattaaataaacaccatacaacatacccatgttgcataggcccaaccacatttgaacaaccaaccccggttgaacaaattaaacctccaaaccaggaattaaccattccaaaccaggaactaaattaattaccacataattaccattaatgagtagtgtgagactaatcacgaaaaacattgctcaactcacccataaccgcgggtacggctattcgaatagattaaaactctgatcagaggtgtaccactgtacccacaagacacaaccccacatcatgtcaccatgtgcctcaataccaccacggtacctcggaaaggagtcgtgacaatacccctcgcataacacaattcaccacagtgcaccgtacctggattataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccaagttttaattatcaattaattatcatcacacgatttaccatcgtgagctaccattgaatataaccctaattaataataataattatgtaatataatttatatttaaccccatttagttagctaatgtttctaagcatggctaagcaaacctacatatagcatttagctgaaccaa

SEQ ID NO: 20019 - DNA, 1501 bp, Oryza sativa
gttgtgaaacattaaccgtaccaaccacaagccagcgtgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcagggggtaatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataaatatggatgttaatacttgctaataatttgcttagctcctggtttggagttagatttgttcagccgggtatggttgttcaggatggttgggcctgtgcagcatgggtgtgctgttcagtgttgattaaaatttctgattaattactccactgttttatttctcttaaatgttttgctaaatgctgcttttgcaaatgagcctatattatgccatcctttggtatctttgtgcacttgcatatttgctgtgtggcttgttgagtatgtcatatgctcattcttgcaataatcatcaaacctcagttgaagataaaggatccagaaggagaagacgtttggcttataccccagctgagctgcctgtgggagtggagccggagcttcgctagattttatttttccgttgctgttttcttttcttttgtaagtattaacgatattattatgatagatttgtatattaaattgtcagtttgtgtacctcggctgattcctggacgaggattttatgcacaaataagttcggaaattactagtgaattgctgggcgtgacaagttggtatcagagccatctcgactgtaggataagccaaatggtcaaacctgaaggactatttttccgaaaaaaataatttgtgaaaatttctcctttcttccttatctagaattctttgcaaattgtttcattgtctactctcttccctctttcaacttgagtagttgttaaacttgatggagaaactcgaagacgtcgatgttgtcaacttctgcaagtcaagtggatcgaggaataagaagatgatagtcgaatcaaagtgttcagctgtcaagatagagtgaagtttggaacctagtttagaacctatgccgccaaagtgtctttgaagaatagttagtagggtagaacgctgttgtttgctttgtgtgtaggtatggttgcattcccgtcattgatgtagtccagtgatgagcgtgcaactgtactaggttgtttgtttaatcaacttgaacaatataacgaactacacacatcagatcagtggtaacctagttaaggtcttatctttagtgtaacccctctccttctatcctttctaatctgcaataga

SEQ ID NO: 20020 - DNA, 1501 bp, Oryza sativa
ggcagctgagctgagctggtctagtcttgctgcgagaccatttatgaaatgctgacttggccttctaattgccatcaattatcttatttttaaactgccgttaattaatcaactgatagctacttgcacgcgtgatgcgcatatttatatgcgtgtgcttgaaggccatctccatccgaccatgggtctgatggctgcattgaatccagggcacacaatttctcatacatgtatagcttaattagtagcagtaattagctttattgtacaacagtagttattttcagattaatttttctgtacttcaaaaaaatacattttctaaaaaaaatactttacttatattacttagactatttgttatgagttacttcctccgtactcgtaaagtaagtcgtttaggacaatgtttaagtcaaaccttgggaatataaataatgaataactctcaagttgttgagtttgaaaatataaaaattatatgaatagatttgtcttgaaaaatactttaataaaagtatacataagtaacaagaagtcaaatttgtgttttggagaccgcgtcgttgttctaaacgacttcctttacgagtacggagggagtattagttatgtttatttattaaagtatctaatttatccatataatataattgagtagataatcgacaataacaatccgctgaataatctattcgaaaataaacataattgttcagggaaggaatccgaataagaaaagtcatgccactatagtgctaaccgaacataatattctacctgaatgtctgaatgatctgatggatgctgcatatgccttagcttgctccattatctacaacatcgatgcaaagttgaattgattaattaattataatgaaaaactgcccgtgcgaagttaaggaacacgtgcgatttagatcgacaccaacaataacaagcatgatctgatctatctaacccattgcaggcgtcagatcgattagattcccccacatgcataattagcatatgcttaataatccgatcatcttgtaggtcagctgaattcctcatggtgcccagcttagctgcatctgcagataaggatatgagtgaccgacctgctaattaccatcggtccttcatgctttgtctttgtgggtggtggggcgcttaatttttcatgcagcataatgctggaaatttgacaacacatggagagcttttggcagcttgagagtgtcactcagctagctgaaaattgttcttgtcgctcacagaaacacaggaggttaaggctccgttcgaatcttaaagattagggttaagtaaaggcacgcaaaataagaaagtcattagcgtatgattaattgagttttaatataacataattgaataatagattatttgatattttagagcaactaagtattatacagaacataccgtttaatagtttgaaaatgtgctaacagatatcaagatagaatttatatcttaattagaaaagaacatggtc

SEQ ID NO: 20021 - DNA, 1227 bp, Oryza sativa
aggtggtcggggcggcggctgcgggcgctacctccgcaggtgagcgagttcctcagccccgagcagctggtccccggctcgccggctgacaccggcgacgtctcctccctcatcccaatcaggcaaagtactctatacatattgtacttcaccagcattatcctactcgctccgttctatattataaatcgtttaaattattttttatcaattttttttaggtttgatcaaatttacagaaaaaattagcaaacatttataacaccaaattagtttcattagatttagcattgaatatattttgataatatgtttgttttgtattgaaaatgttactatatttttctctaaacttagtcaaacttaaaaaagtttgataaaataaaaattcgaacgatttataatatgaaacggagggagtactaagtaaagtatatactggtacctgcaatacttgatagcaaaatcaagcaagtacaggatgaaatacgtgattaacttatgcttaagggttaagactctaattttaggattacagagctaatcaatacattgtgttaactaactttaagcttatatggcatcagataatattacaagacatgtatatatattaccaatgaaaataacaaattattccttggccttcgaagaagcagcaagataatgtcaggaaagacaatgttttgtatgaacaaaatataactgtatgattgtatcttatatgaaagtgggtgtaaatttattgtgttccaatgggctatgaaacatccaaattctcatctttaactgggccaaactaggccttgctgtgtcttgggctaggtagaacctgggttgggcttgggctaaccaggtcattgttggaagtgccttagtttcacatgattttttatttttgtgcttagcattttttatctccaacaattgacaaaaaccaggacttgatagtcactgtatggtcagtgagctcagactcaaaacatgacagtctagatggttactgtattttacaccagctgcaaaaacatgcgatcaatacgcatctaattaacagcataacctcacatctgacaaatgccacaaaattcaggactcattgatttttgcctctctgttttttctttaacttttgttgatggatgttcttgcgcctgtgtgcaaaatgcagtgctctgatgctgttcttctacttcgtgtccaactgggtggtgcctgagttaatca

SEQ ID NO: 20022 - DNA, 1501 bp, Oryza sativa
gcaattttgcaggctgcgaaagtagattagggctgtgtttagatctaaattttggatctaaacttccaacttcttccatcacatcaacctgtcatacacacacaatttttcagtcacatcgtatcaattttaaccaaacttacaactttgaaagaaactaaatacagcctagaagaagtgggtaggaaacaagaagagacagcaggtaagagcaagtacacaagaataatagcatagaacaagtaaggttttctatattacaaaataagttaaataaccatatctacaaaaacatgtttcctaatgcacaataaataaatagataagaacaccaacagcaatgagatgctggaaagtgcatagttaatggctcaatatctggacacgcatagaattctccaaaatctactccagctgcaagaacaatacttaagcatgattaggaattgaatacaacaccagctacaattattcggagtatccaaacacagcagctgaacccacataaatatatataatccaaagacagcatggacaacagtactcttttcatcagattatacaatcagccaaaaaacaaatctgaaaaacagagaagaaaaaagatatgtacccattctttgtgatcatttaaggaggaaccagcccaatgttctagaacaaaagcttttcgtcaaagcaaaatcaacattggcaacactcagaaaacattaaattattggagattatcatgctctagtatcttggttgcccttatgcccagactttggggcccaatttctgtgttttgtgccaaacccaccacaatgatgataattagttaatcacttggcttgctttaagatgcatggctccttcctttttgttataataataatgctaacactgatcacaattggtgcaccatgcctccatctccactaaactaacctgtgattgctctgcagtttatctcctatggcccaccaaccacttgagagaataatcaattgcaaatatgcaaatggtttataatccactctttagaaggaaaaaaaaataaagaaggcatcaagcaaaggaagatatgatatgctcatggaggaaccaaagaatatatactggtgaatatatctatccattgatgtactgctgataataagcatatgttcctgatgaacaacatgaatcttgcatggttaataacataagacagacagcacatggatcaaaatcttactgatgcccaaagatatatatgaatatatatcgagtaaaataaaaactcttgttggaattcttgtatacaactattttataaaacccaaagagaggggcaaaaattaatagagtaaatatcagctgttcttcatcaatctagagctccctttgggtatacatgcttctttgttgatgaacaatattatttgcgaacagcttaaatatgtactaaaaaaccatctcatttgaatcaaattaagcaaacgaaggggaaaaattaattgaaagaaagaacttcttt

SEQ ID NO: 20023 - DNA, 1311 bp, Oryza sativa
tcatcatatttaagtatgcctgttcctgacttcctatccctgccggttcataggattacattgttgattctaaaagaaccggtagtgatgggacggtttggaaggccatttctacaatagcgtgtcaggtataatatgacataaattagtaatcccttcatcccaaaatataagcaattttagaatagtgataaatcaaatatttttaactttgactattaatagaaaaaaatcaaacatgtaaaaatgatattactagtggatttatcattaaataaactatcataatatgtaacttgtttatttaaaacatcatttttttaaaaaaaatattgttggtcaaagtatcatctcaaagacggtgttgaagtctaaaattacttattttttttttaaattgagcgaggatttgtttgctttctatttgcaactatgaaggccatgtttagttcccacgcaaaaacttttcaccctgtcaaatctaatgtttagacagatgtatggagtattaaatatagacaaaaaaaactaattacatagattgtgtgtaaattgcgagacgaatcttttaaacctaattgctctatgatttgacaatgtggtactacagtaaacatttgctaatgatggattaattaggcttaataaatttgtctcgcagtttacacgtggaatctgtaatttgttttgttattagtttacatttaatacttaaatgtgtgttcgtatatccagtataacacgccaaaacttttcacccctgaaactaaacattgccgaaattatttgcttgtatcgactgttatatggtctcggataatttaaattttgttcatgtaactcgcaggttataacccaagaccacaaaaacataattgctctcgacaatgtggaacaatcgttgtcccatttccttttggccttgaagagggttgtgccgccagggaagtgtttcagctctcgtgcctaggcaagccaaattctgtgctgcagtacaatgacttcatcggtgttcagtatataaatgtcagtgaggggcttgttggcattaaatacaactcatctttcgtggagatcttattcaatatgttttcgcaattcagattttcatctcaaggagtagtatccaacatatttggtaaagggcctaacctgtatgtggatccaacggaatcagcctcggtgcagtgggcagttgccaatctgacctgccaacaggcgcagcaaaacacttcgacatatgcttgtgtaagtaccaatagctcctgctccagggtcatcagcaccatgcaaggttatgttggctacagg

SEQ ID NO: 20024 - DNA, 313 bp, Oryza sativa
gtgaagcagactctgaattttaactaagttgctaaattcaatttgatctcaggctacaaatcgcaaaaactctcattgactttcagcattcaaatcataaaaactctaattgatttcagcaattcgagtttttaattgttcaatcaatctttggatcttgatggtgctgatcatggaggcacagctagcagaccatggttgtaactaacacatatgcttgactgtactgattaatcaatgagagttttttggttgaactaatgaaatttctactgtagtcgagagaaatgacagctaaaagaacaaagtgaaa

SEQ ID NO: 20025 - DNA, 368 bp, Oryza sativa
attattttgtgtgtaatcgatatgtgggtcccacagtttttaaaattattttttatccgattgccacgtaagcgccacctgggaccagacctagtcataccaagcatgtaagcgccaggtcatctcaaaccgggcacaatactaccaacggacctcgtctgcacagttttggtaagttgggggatgcgatgtatctggttttgtagacggagagatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacga

SEQ ID NO: 20026 - DNA, 1501 bp, Oryza sativa
tcaataaaattttgggtaaagagaaaaagaaacattttgaaaagaacaacctttttcttttaaaagaaaagaaattgaattaaataagttttgtgcataacctcgcatgtgctgccaacttaattaatttgtaagagaatagagaagagcagttctatttttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtctaggaatcaaccgaggcacacaatgacaatattgataatagagtacaaatgaataactatttaatattcgcaaataataaattattacagaggtagatagttcctctcaaagaaaaataacattctacgcagcggaaaaataaaactaaaacaatctacggaacagcgatggcgactccactccacaggcaacttaaccgagaacaagcctaatcctccagatcatcaccttcactgagatactcctcttctgatgaatgaatattgcaagaatgagcatataacatactcaacaagccacacaacaaatatgcaagtgcacaaaataacaaaggatggcacaatatagctcatttgcagaaaacagcatttaataaatatttaagagaatagtaaaacagttgtataattaatcaatattaattaaacaccatacaacatacccatgttgcataggcccaatcacatttgaacaaccaaccccggttgaacaaattaaacctccaaaccaggaattaaccattccaaaccaggaactaaattaattaccacataattaccattaatgagtagtgtgagactaatcacgaaaaacattgctcaactcacccataaccgcgggtacggctattcgaatagattaaaactctgatcagaggtgtaccactgtacccacaagacacaaccccacatcatgtcaccatgtgcctcaataccaccacggtacctcggaaaggagtcgtgacaatacccctcgcataacacaattcaccacagtgcaccgtacctggattataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccaagttttaattatcaattaattatcatcacacgatttaccatcgtgagctaccattgaatataaccctaattaataataataattatgtaatataatttatatttaaccccatttagttagctaatgtttctaagcatggctaagcaaacctacatatagcatttagctgaaccaa

SEQ ID NO: 20027 - DNA, 1501 bp, Oryza sativa
ttattatattatatgtgcacgtctagtagatattctccaaattgacttgagcatatctaatgcatactcaggtatataaacaatctcaaatattaaagttgacaagtacgtacaaagtttgttgatacaatattgataataaaatgtgttttgatccagcttcatgtctagttaataatcttttaaaacaagaaccattatttaagtatgcctgttcctgacttcctatccctgccggttcataggattacattgttgattctaaaagaaccggtagtgatgggacggtttggaaggccatttctacaatagcgtgtcaggtataatatgacataaattagtaatcccttcatcccaaaatataagcaattttagaatagtgataaatcaaatatttttaactttgactattaatagaaaaaaatcaaacatgtaaaaatgatattactagtggatttatcattaaataaaccttcctacttggtacctggttaattaaaaacatcttgtttttaagaaagacttgatgggccaagtttccttttaaagacggtgtatgaacctaaaattactatatgttttttaaattgagcgaagattcgcttgctatctatttgcatctatgaaggccatgtttagttcccacgcaaaaacttttcaccctgtcaaatctaatgtttagacagatgtatggagtattaaatatagacaaaaaaaactaattacatagattgtgtgtaaattgcgagacgaatcttttaaacctaattgctctatgatttgacaatgtggtactacagtaaacatttgctaatgatggattaattaggcttaataaatttgtctcgcagtttacacgtggaatctgtaatttgttttgttattagtttacatttaatacttaaatgtgtgttcgtatatccagtataacacgccaaaacttttcacccctgaaactaaacattgccgaaattatttgcttgtatcgactgttatatggtctcggataatttaaattttgttcatgtaactcgcaggttataacccaagaccacaaaaacataattgctctcgacaatgtggaacaatcgttgtcccatttccttttggccttgaagagggttgtgccgccagggaagtgtttcagctctcgtgcctaggcaagccaaattctgtgctgcagtacaatgacttcatcggtgttcagtatataaatgtcagtgaggggcttgttggcattaaatacaactcatctttcgtggagatcttattcaatatgttttcgcaattcagattttcatctcaaggagtagtatccaacatatttggtaaagggcctaacctgtatgtggatccaacggaatcagcctcggtgcagtgggcagttgccaatctgacctgccaacaggcgcagcaaaacacttcgacatatgcttgtgtaagtaccaatagctcctgctccagggtcatcagcaccatgcaaggttatgttggctacagg

SEQ ID NO: 20028 - DNA, 417 bp, Oryza sativa
acaaatcttttaagtctaattagtccatgattagccataagtgctacagtaacccacataagttaatgacgggttattaggctcaaaagattcgtctcgcggtttccaggcgagttatgaaattagttttttcattcgtatccaaaaaacccttccgttattcggtcaaacatcggatgtaacactaaaaaatttcttttcgcgaactaaacaggccctatgtactccagaagatgacatgacacgacacggtgggtgtggtctcatcgatcggcaccacgtacgcggcctcggtctcaacgaacgaacgtctcgccggccggcctccagcttaatttgttctatataacccgggaggtgccatttgcaacgatcgaataccagcgagacaaccagacgccggcccttggaagctag

SEQ ID NO: 20029 - DNA, 1501 bp, Oryza sativa
cgctgatggtgctttggacgatgatgacgaaggagcagtaaaccagcgcagcacaggccctcatgctggtaatgaatcaacgctggcaactttttttttttgaatcgaatgcatgcaacttgcggcggcagcaaggcccaaatccatgccgaggcaagggctgggatgcaggacaaacaccatcaggtcgtatcgattccaccatgactcgctgactttgaacgatggaaaagaagaggtgcagaggaggaaggaaggaagcacagcgtggaggggagggggagcagcggaagcggtgcaccgggaggggaggagggacggtggagcaggcgcaccgggagggacggaggtagcgcaacaggacggcgcatccgccgccaggtcgcgcgaggggaagggaggagcgacgctagctagggtttatgtgggagcatcggttgaggagatctgagccgttcatttctgtctccccgatcctacggtgatgaaacagccgccacgctgggacacgtgtacagttggatccctgcctcaccgagatcggatggcacacgcgaatttgggtgtgtgtgttatttcacaaaatatgacgggttttttttgaaaaaacatatgacgtggcgtgcctaatttctcagcgatcctatgacgtttaagtaaaccaatatatgtactgtcccgaatgcagtgtaggaggtttaagttggagttcacatcatgcaatgattttgcacgaaaagatcatcattgatcgatcctgattgaacaggacatgtaacggtctaaccgtcacaagatcgagcaaacctaattaaattcatggatatatgtctgaatgcctctcgagtaattaagtgcgtttcgatctcacactctctctaactgtcactcacacacacgtttgtctttcagagaacaagttgcaacaagccctaatctgcacttaaatctgtcattttcgttcggttgcagagcgacatccaagttgcagtacttaccatgcacctttagatatgcctataaattggatcagtacttgatgcagtaggcatatgtagtggtagctgctttgattaattagccagttgggtgtccaaaatcatatcgaaatttagcttaattgacacgagagagatcagagacaggcatgcagatcatggcagtaaacacaagcttggaaccaacaaattgcttcctgctgctgtccaaggtatagtcgtcacactataattagtaccaacttgttttgcgtcttgtaaaaatttgtcagagttaatatgaagtcaatcttttaaaattttaaaaataaatatatatgcaaagctacatgaaatttataaagttaagctaatatatatatttagagtatttcttattcaagaaacaataaatttgaagtatatgaaagatggtgaaatattgatgcaaatctgtgtctctatttcagaacaaggatcaaactgagctgcggcgatcgtactcggaatactcgaacaccacc

SEQ ID NO: 20030 - DNA, 539 bp, Oryza sativa
tcgattaacacaggccgattcgtttttttaaaaaaaaagataaactcgcttgattttttttttaaaaaaaacagctcgcccagtacacaatgtaaataaacagctcgctcaattattattatttttaaagaaagcttgctttagtccaaaagtttttacatggcaaaaaaccaactcacttgatgatttcttaaaaaaaaaccagctcgctagatgtccgaaatgtaaaaaaaagaatatctctttcaattattttataaaaataaacaataagtttgcttagtccaaaagtttttacagggcattgagaccattgcaacgaatgttatctattgtaaagtggactcaggcattgcaagatactcaatctctgcaacacatgttctacaacacatattatctattgcaaattaggctcacccactaataagcgttgttaggctcgcattttggcaacgcatgcttaatgtgttgccaagtatgtattgctagaggggggttcctgttgcagtggaccttctcttatccaaatctgcagc

SEQ ID NO: 20031 - DNA, 1501 bp, Oryza sativa
tttgtgccctcaaataatgtcatatataaactcggtttaataaatccatcatgaaaaatctgttgacaacgcaccaaagcgtattctccattttagtttacttttcccttttgaccacgattcgaaacatgatcgtttgagtctcaaatactacatcattttgtattatttcttatttgccaacatttatcactttcttttcatacttcctcacttgttaaatagataaaaatttaaaatatgcacaaaaatatcactaagaatatttttatgttaatattaaatgtgtaattagaaaaaaaacaatggtaaacatagtgatcataactcaactgattaggttacttattatggagcctactcacctgattgcaggtcctaagacttagcacgagtgctcgtatttgtagttaattattcttttagtagtaaaccatgtatccatcgatagcggcgtcattaatctcaaaatatactggtctaatcttcagaggtaattataatgtatgatacatgtgtgtacatttatagagataagtatataagcatagtagtatgagcttttttttagaaaaaaggaaaacaatgatattatatgaaaagggtataaattacatgcccataaattcattgtgatttggttaggaaaggctggtgcggttgaaaacttcaattctagcccattcgcgatgttggccgctaggtcgattaggttgaaactccggattgatctattgtttgtcatggttatattttacaagatcgcagaaaccaagatttataagaccgtgtggttatcgcggttatcacgtgtggtaaccttttcagtttttaaaaccatggtatatctcgcgataaccgcgtagttatcgcggtaaccaccgctactacggaattctaaataggtaccagcctaaagatacaggtttaaagcaaaactggcacctattatcaattattaagtgcgggttagagacaaaaccggcaccaatactttaggttctggttattaacaaaaaaagaggcatctatagttcattcggccactacgggacaaacctatatgtaccggtttaatttaaaaaccagcacccatatatacttaggaccagtacctatgctattaggcattggtaccgctaaattagatctgactaggaaaccgattagagtttatgcagtagtgagccaaactgatgggtgacggtgtaaccccaccaccatacaatttgttaaaccctccgagcacgacaacctgcttgtggcaaacaccacgatgaatccggagctgccttgcgctggactcggctgttgggtactttggttcgctggtggttaggggtggatgccgagccagctcggctcggcttgactcgctctagctcgtttagtcgtttagacggctcgttatctaaacttttgaattatgatctaaattcatttgcacttaataaaagccagcttctgctgtagtggtgcagaggcccgtcaccgatgtaga

SEQ ID NO: 20032 - DNA, 801 bp, Oryza sativa
gatcggggcactgccaagtggtgagacctccggcgattgactgcggggttgaaagtcacgacgttgatggaggatcagcgccgggactattaaaggatagagagaatgtttttagtacaaatgattcaaggttaaacatgagaaataaactatcaaaattatattatcatccataaatgtaaattagtctcttgaaaattcagaacttagttaattcctttaattggaaaagaggcaacataaatgaaggggatcattgctttggtctaaatccagtgaaaatattgttagcacaaatttatttaaaatcctataggcatggcaatgtagagaaacagattggtaattgttttataaacaaatccagcggcataacatattggtgtaatactttcctactattgactactacctccgtcctattataagtgcagccatggtttttcgtacccaactttgaccgtccgttttatttgaaaaaattttaaaaaaatttaaaaacataagttacgagtaaagtactattcatgttttatcatctcataacaatataaatactaattataaaaaaattttaaataagacgaacgatcaaagttaggcgcggaaacttatggttgcacttataatgggacggagggagtacaactttgcttgattaacagggtagcagaaagtttctgcggcattcaatagaatgctgaatgtccatggtctgctcgtacatggcatgaactagtcagaatatcatgttcaactcaatagctaaataagtttaattggtgtttgcatcattgataa

SEQ ID NO: 20033 - DNA, 1501 bp, Oryza sativa
gtcttattttattacagagcaatcaaacttatggccaaaatcaccttgagaaacagaggaagattatttgtgtgaaggctagtcttcacttttttattgattggaactcacagtgtttaattataaaaataactagattattgtagtttgtgccaatattttgatattccatgcagaataaaggaaacatgaaccagaatgatcacatgcaacaagggaagaataattctaatgcttataaggtaaatttttacttctggagccacctaatataaagataagctatagaattctatttggtataatatgtttgtactttatagttaaattattgaatcttgatccaaataactttgtacataaacaacagtgcaacatagtgaacattatggatgccaattcattggagataaaacttttaatatgatgttcttttccatacttaattgctctttatgtagagataatgctcatggacatatatttatgcaccagattggaactaatgtattcttgaaaagctggaaaaatcgaaataagaatgtggctgttgcttcaattgtaagctgtgatccaacacgcaaagttgcaggtgttgagctaggaactgaatacttgatggtgcatgttcattttccattggcaaaatatgaagaattgatcaggccatacaaaggctacaaaattattagcaatgtcgtaaaacttgatattgcgtggccagcaatttttgtacggtgctatttctcaatttctttagatgtggtcttctttcttccaatgttgtatcaatggttgtttttttctgttacaggttgacaagataaatggatcatgatctggggcaatatggttactgcaaggtggacaactgtcatctaaagatcccttgtgaatatgatgatgactgtaatatggaagatggtggcaatgatagtggcaacttcagatgcatgtttttttttctatagtttagtttacatttgtgcatgatgttctgaacaaaatttaatgtcatgacttatgaggatgattttccatgtaatacaaaaaattctctttaattacaattagttttatgaatgacttggtttttctcatgtgtacatcatttgagtttatgtgcctctaacccaacaagataattgtgcaaaggcatgctggaatgaatagttgcctatattgcaatacttataagtgttggtgcaacttgattatagccgttgcaaggattatatagaattgttcatcaccgaaactaccaacgcatacaagtatggctgaaaactatttactttgttgctaactagcaacgtttattcttacatgttaccaacgattgtgtatgtgttgttattggtgctagcaacagcagcataggcaatgcatattaaatgcattgatagcgcatattaaatgcattgatacagaccctagcaatgcttattttcactttttgcaatacatatatgtattgctaaagggggttcctcttgtagtg

SEQ ID NO: 20034 - DNA, 1501 bp, Oryza sativa
cagtattttttgtttgcatcctaaggtggggaggggatggcatgcatgcacaggtattagttgtatcctcccaacttttggtgcatcaacacatgatagataatttttatttcgaacattaattttgtcttgggatcaaagatgtgaactcgtcaggaacaaatcagatctcgaaaaaggttagtgaaataccacatcaactctggttttaggagtcgacagacgcgtcatatctagtaatgcggttttgagacgaattacaaactaggcgacaaattaaatgacctaagtgaacttattatttccttggtttgcaagaagaagccatacattttctctttaaaaaaagcacgcacaggcccactgatgcgaagtctacagaaaaatcacatactccaatttgttagtctaaaggccgacagagaaccacagagacaaaaagcccacaaaacaaataaaacccacaaagcccgaacccaggaagcatttactgggcctgaagatatacagatccaaagcacattatgtgtgtttcaacatccaccctatattctatatcgaacggcttaagaaaaatgctagacaacacaatttcattttatagatgtgggtgtacatagacttatttctaatataaaatatgttttatacaattttgtggaggaattatcaagggaaaaaatgataatggtgtaggggaagcacttagttttagtgtctgccatctaattcaatatgcatagactaatcagtcatatctagcaagctatgcaagcacgtttgttgtttgccggcccccactgccatacacgcaaagtcttcgaattatattttgaaaatattactattttttcgtaattttgcaaaagtacaccggtttcaaaaattctacaaaaatttttgtgtataatacaacgttaggaagaaacaagaaagataaataacgttagatagtaaagcgaaccatttttaatcttttggaggggtaaataagttttttaaaaaataatagttagtaagtgatccaatgaaatagttgagggtaaaattgactttttttatatgaaaagaattacacaagaatcattagaggaattggcgaagccatgtccctttgtttccaagccatttggcaacaccatgccgtgccatccgatggattagcgccatccgatggattagccaatccaattggcgaatcgggtataattttacaattattctgaaaaccagtatattccttaaaaaaatatgtaaaagtttatattttcatatttaaaacaatagtcctcaagctatgctactcccatgttttctttaccgtttggagaggttaaactacccccaaagaaaaaaaaaccgttcttgcagtttctgtggtaacagtcaataaccgcatgaatttcatctaaaaaaatgaattcaaaattttcaaaaatcacacgggtgtgctgaccttagcgtaggcctatatgttatgctgccataatacttgtatagc

SEQ ID NO: 20035 - DNA, 1501 bp, Oryza sativa
aatgaaatagttgagggtaaaattgactttttttatatgaaaagaattacacaagaatcattagaggaattggcgaagccatgtccctttgtttccaagccatttggcaacaccatgccgtgccatccgatggattagcgccatccgatggattagccaatccaattggcgaatcgggtataattttacaattattctgaaaaccagtatattccttaaaaaaatatgtaaaagtttatattttcatatttaaaacaatagtcctcaagctatgctactcccatgttttctttaccgtttggagaggttaaactacccccaaagaaaaaaaaaccgttcttgcagtttctgtggtaacagtcaataaccgcatgaatttcatctaaaaaaatgaattcaaaattttcaaaaatcacacgggtgtgctgaccttagcgtaggcctatatgttatgctgccataatacttgtatagctttcaccgtgggtatattgtgacctcgaaatattctgtgatgagcatacgggaaaaccttctttggatttcatccaatatctttggaattcatttatttcttgtaggggtggctttctttagctttggcaaatttcatgtaacgggtttgtatggtcctgggatatgggtgtcaatccttataaactcactgggaaagtacaagttgctgttacgctagaaattcaaggttacacacgagttcctattcacagcgtgctgctaggggatttgttctaggtataggtaaggtcaaatccgtaggggttatacaaatacataggccccttttcttctatcgagttgtttagaagacatttccgttctacggtcctggctctaatgttgtgttcatcaggttgcaggtggataaatgtggatgtggggactcgggtcagggcacagcgtaactaacataggagagtggtttgtgcacgataagccatggtaaccgtatgctataaccgtggtatttgtgacttaaataatgaaagccactaagaaaaataaaaatcacaacctcacgtttgacaacaacaaaaataaaccataatataactgtcataaccacagagattattgtgaacataatatactatccacgagcatcaaatctttattttaaagcaatgcagctttgttgttatgctaaaatatgaagttagccttagaatatttcaaaaaataaaaaatcaccatacctcattacaaataatgtaatatttctccaaatgttttgagatttttcctttttctttttaagattgaactcgaataaatttctatacccccacgctgtcgtggttactgcggttatcggtagttgtagaaactctggttgacactggtgtgcctatgtgggagggagtgtaaattttgtgcagtaaatactccctccgtcccaactatatttttttataaggtcttcaatgacatatttttactattaatttattccatgttatgtttccaataaatatgaaactag

SEQ ID NO: 20036 - DNA, 1501 bp, Oryza sativa
gtatgttgtatggtgtttaattaatattgattaattatacaactgttttactattctcttaaatatttattaaatgctgttttctgcaaatgagctatattgtgccatcctttgttattttgtgcacttgcatatttgttgtgtggcttgttgagtatgttatatgctcattcttgcaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctagacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaaatagaactgctcttctctattctcttacaaattaattaagttggcagcacatgcgaggttatgcacaaaacttatttaattcaatttcttttcttttaaaagaaaaaggttgttcttttcaaaatgtttctttttctctttacccaaaattttattgattagtcggcactgtacatttattatggtatcgaattaatcatgttagcactagtactacttatctttcctatggtgacattgtaccgtgcttataatagatcataattatcttagctttattttaaatatttgttaaaaaaaataataatatatttgcccctgtctaaaaagttaaattctaaaaaaaatatttataaaatagctttgtatgtgtcttttcttttatttttcttccttttgggtcaaaaatcagttaagtctagttggtgcagctaacttagaaaaatatgcattaattcttctcttctatgtttctttagatgccgccccattcaccgagaaatttgatcgaggtgttaggattcgtcagggagttgaggttgatggcttttgaggtaggctatgaagttgctcccgagtatcgccaaatttcccatgaccccgacgaggagaagtgtcgtgttcgtgtgacattggctagtgatagtgaagaccttccgtcctttaagttcgaagttggaggaagatcgtactgccatgcttgtcaagaagtagctttggtggccattggagagttgcgacaacactttgaagaagagttggattcatcagctttccagtatcatcctcacaaggctcatggtcaagactatggaacctatacctgtcctgatggtgaagagagtgccactctgatgcatgtggtgcatatgcttagtgctatggatgcagtaagtgtggagcgagacaaagcagc

SEQ ID NO: 20037 - DNA, 1501 bp, Oryza sativa
gtgaggacattttttttctgtgaggatattaacagtaaacgcttccaaagattctttttccccctttcttttcgatgggaaaaacgcaccaaaagttctgaaaggattcgtgcagccccatatataactcctctcagaacgttctcctcctatacgagtataaatgctgctgtgtgattttctttttcctttttttagaacgtttgtgttttctcacgacaatcaataaaggcctcaaagaaatggtagaccccagaagtagccacctgtatccagattccatggggaggaaaacacacatgcgccggtggggccaggacgatggccgggaagttggagctctctctttctcgttctcctactccaacaaaaccggaaacctggactcccaaaaccgcggacgcagctggctgtttcggacgcccccgcggacccgcgatggcgacggacggccgagccgagtcgtcccggaaatctagggaatataattgcgcacaatcacgacgccatcacgctacagtagtaaccagtacccctctcctaggacaggtgccaggtgggacgcaggcacggcacgcgcgcgattttcacatcgctgcaaaaatggaatcacgatgcgcgcgctcaccgggtcggcgtcaccggccgcacccccaccaccactgcgttgtgagcacggccactccgcttatccgcagccgctggttatctccattattactgctccggctatggtgtggttgagattgatgggtaaaatataccttaccaaaattttgataaattgataatattactaatattttttattagaattatcttgataatgttgctaaaattctatgcacattgccaatatttgataacaaactaaacataaccacataattagcattcttaccaaataaacaatatggttgaaaatgtcattaatctgaacaggcccaatataatttcaaaccatactccctccattccataatataagtcacaaccactttttttaaatattctataatataagtcatgcatgcatgtagacaattaactataacaatttctccattaaattagtacttttttaattcatccactctcatgttctctaattctattggatgcatgtattgtatttattaggatgatccaaactacaagataataattattttcttggtttttgggttatgggtggttatgccttagggcatccacaatggttatctataggctctctacaagatatccatatcagcatattttcctacttggaagagattaaatgaagagagagcaaagctatctactaacctggagatagtctatagagaaaaacgaggcaacggattagagagctatagatacccatgtgtagatatgctattgaggtggtatattattaatctagttgctgagatgtacatattttatagatagcaccttactttaccattgcgggtgctcttttattttggaatggagggagtaccatttttgataa

SEQ ID NO: 20038 - DNA, 153 bp, Oryza sativa
tgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcacagcatatatgcaagt

SEQ ID NO: 20039 - DNA, 862 bp, Oryza sativa
ccacagatgttgccctttcatttcaacacttataggcctccagaaatgcagtggagaccagaattagttctcaactatggatatcattcaggaatccagccgaagaggccggcaagttctaacaccataggtttgcagcaccacagccccaaagttgtcatgagaataaggtgctccccccgcccctccctccccctagtttctcaaaagaaaagaaaaggaagaaaaataaaagattgttcttcgcctttcgcccttctcatgtgccatgtaatttcaaccaaagttggtacaagtgtataatcagaatgggagagcgtttttggaatttacaatggaaaagatcggcagaggttagggtccacgggcaccctgagagaataaggataatatctcttttcagttgctgcaaagattgggtcaggcaggcttgagtgtgtgtgttgtcccagtgattccacattctcttccctgccttataaagactcaagactctctgcttgagaccttgacatgagcagaggcagcagcagctagtcattggagaggcagatagtctgaagaagccaaggttgtctcactcccagaagaccatacacacataatccaatcaagtctttggttactacaaatagaggcactgaaaaaggctgcagaggatcttatcactactgataaatgtgcagcctactacaagcagacagacatttcagtgcatgactggaactgaacaggtctgtatgtactactgtgttagtttctttgaaccatgcaaggaagagaggcctttcgtatcatatgcttatgctcacacaagatgatatctgcaaattaggaacatgacatctttgatggcagatga

SEQ ID NO: 20040 - DNA, 1501 bp, Oryza sativa; identical to SEQ ID NO: 19758

SEQ ID NO: 20041 - DNA, 1501 bp, Oryza sativa
accacatggaataatatttactcaagctataattcttcataaacatatgagttaatatgggtcttattattgttttcctttattgtagatcttactcatccatgcatgttcaacgtttaatatacgataaaataatctatgctgtcattttttttaattgttaagacaatttcgatgagaatgacatgaaaagagaaagaatatgttccatgtgatatttttttaataaaaatgtagttaacatatttttatttttatttaaaaaaaaatgaacaatcaaggttcgtaaataaatattgctgatcgccaaatctgtgaaaaattgctgatcttaatttgcttcttccaattgtccttttgattgatggattgacctgttggaataaataggctaggcccaatttaattcattaaaatctcaagaggccacaagtaatgttagagagaataatactgtcttgaaaatttagatagaagaacctcaacttaaatagggtgatattggagattccctgttgaccggttgaggtgatggttggactgccacacgcatgcgcgcgcgccgagtcggcctcggccgtgggcgtagcgaggcgaggcggccgaccgagccgagcctgccagctgctcttccgttttgtaacatacgagaataaagtcaccattaacgaatgaaattcattgtgttgtaacctccacaacaaaagagaggtttatttgttgtaaccttcacaacaaatgaaatttattttgtggtaaccttcacaacaaatgagatttatttgtgtggtaatggagatctctctctaaatataacacaagacagaggctctcaaagagtgtgtcttcctacgttccttggcgatactctccttgtgttcctacgttgtctctctgtttccccagttctgttcatctcgcgcgcacgggtgatcggaacgagcaggtgcctccgaaactccgtcggcttgagaacctgcacgggtagacgggcgatcaagtttttgggtagcacttcaagcgcgactgctttgcatcatcttcaccaacatgtcgacaaccggcgacaacaacaacactggagacaaggagaaggagcctctcgtcaacaccaacggaggcaatactgcctcaaactccagcagagggccattctcgggatataacgtttcactattaccgttcgttcttcgtttcctacaactgtcggtcgcagtattattgcgttctcttatctatgttgatgcttattctatattaagcatgctcatgttgtacacatctagcactgtcactagatctactcaaattacaaatgtcatgtttattgtcttaatattttagactaaaatatgccgaattacgaccaaatttccaacaatccaaaaacttgataggtctttttcggtagttggctttgttgcatcactaaaaccacatgctttcgatggttcaaattataaaaggtggaaagcacgtgcacttttgtggttgacggtga

SEQ ID NO: 20042 - DNA, 349 bp, Oryza sativa
cgaataatgctagacacctatagtttaaacatatttcaaaatgtacctgaagatgactcttaagatggtaaagggttaatcccagaatttcccatgagcctcatgattgttttcggcggcccctctgaagaagtttcaagtgtagccattgtaagatatgcaaattaccattcctctgctgcttcaaagcatgaatgattaattaagttttgaatactcactgtccggccctcccagctgatttactgcttccacaaaacgctcatgcaactctgatgtccattttaaccgaggtttagcgtcggtcgagaggacaagccctgatgatgaatctgctccgccttgcagg

SEQ ID NO: 20043 - DNA, 1501 bp, Oryza sativa
tcttttttatcttaaagggatgattggattagtttatctcacttcacactaactggcctggcttacctctgcttcaatctctcatttcttgagtcactgatttctctttggcagtcttctaccgaatcctgccagggccctcagttgtcgcctctagctgcagctgttaaaattaattgagtagctagttgtgtgagtccatgcgaatcttaggaagaatagcacagatttttggcaggttgcggaaaacagtcgtaccgaccgattaaacggatgtgtccggttcttttctccaataaaagttaataaacttttggatactcgtggcacgcttttcaaactgctaaacggtacgtttcatgcaaaaactttctatatgaaagttgttctaaaatatcatattaatcctttttcaagtttgtaataattaaatctcaattaatcacatgttattactattttgttttgcgtgaaacatttaatctttatttttatctttatatttaggagattcaaacacttaatgaaacagtttgttatcgtgatacggtcgacatttatttttcatgaacattaaaaaattattttagcgattaattcaccatcttccgtttaattgttcgtggcatgtgtatttgatgactatccaaagttgtttttgggactttgtttagtatttcttatattctgttatgttttacttattgaatataaccaaacatgccattgtttgctgtatgaatgaccgttagaaactatattttaagttgatgttaattataaccattcaattaaaagataacattaatatattcaaattatatagttgtagccatttaaatgtccaaattacgtacttgccaacgtcatatttgccaacatcaaatttccacatagttcttattaatcttgtattctgattatcagtgaacgatacccttttcgtctgaaagcatatttcgtcttccacaacaatggtttttcatcaactttgatttccacgcattcttgtattacgtccagaaatatgcaccaccatggcatcataaattttaggggtctgcttatattgtagctaaaataaaccttatcaaattttggcattgtcaaaattccatcttactaaaattttagtaggatttcttatgtgtttaccagatttgataacaaactaaacgtaaatatttttaaaaatggtatggttaaaaataacattaatttgaacagcccctaggccatgcgtgtgtttgcagtcactataatctagtcacaaactaataccttttgacctaatttagagtagattatagttattttttaactcagaatagttgcatatacctatatatttgagttttgagattgcaaagcaaagcacggtacaatactaatgtttgtataggggaaaaaatataaaaatcagctcaaacgaattaccaggtctaaactctaaacactgggcataatgcctttctgatgttccagaatcagatctccaccg

SEQ ID NO: 20044 - DNA, 1501 bp, Oryza sativa
tacttttaccaaatatgaagactgtggagggctgaaaaataattgaatgtaaatttaggtgcatcgagtatatgcacctaataggtgtagcctccgaccatgtgattagttgaacaaaccaagcatatagtcaaggaataaataatctaactaactgagtggttttgataattgtaataaaccaaatgacttgatatcaatatatagcatatgcgatgtgaatccccgaataacatgatccaagtgatataccgactgctttgtaaactatgatgagtacaacctaaagttgcctacatcattaaaaattcacatagcaaaacagctataaagaagcttgaatgctgcgaataaagaaatttccaaagtattgggcatacgccatgcgcacactgctttaacagatgtgcttaagtccctaaaaaacacatggtttcaccatacctggaaatatatggcatatgtggtgtaaaatctgagtaaataaactcataaatgatttaccaaccgcctggaaaatgaccacaatgtataatcagcctaagccataatattagtcaataaaaatgcacacttacgtggcaaaaagcaacgatattgtatccaatcaattgcttgataaacccaaacagtgccttgactatataaaaaagtcagcgaggcagctatataaagctttactgtttgacaccttttaagatgcattgtactaactcctaaaaagttgagtaactgcggtataaaatgattttaaggtattggacacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaatacatcttccgggtgatatagaccaagtgtagctcatatcaatagtttctgatctgagtgattatcccttatgggatactccaaaatagatataataattgaatcccgactggcgcaagtattcggttgataacccttatggggaataataaatagtccagtctttgagcatagaaaatagacccatgatcatgaattcatgttgcatgtattcggagcaagtccaaattgaaggtatgatacttgtgtttgagctagtaagccctaagcacgtagtcacaattgttcattgatggtagctgacgcagttggcatagagacaagacgaccaatatagagataatattgcccagcagaggtggcaaaaatattggtggtagtgaagatagtgataccaatcaaaagtgatgaagttgcatagccgtggaggcgaagaaaccagtcggcagcagtcaggtcagccatcaatgaagatgaaggcgcctagcgataaagttgtgtagccatggcagcgaaataatcagtcagtgacagacgaggcagatcaaaggcgatgacgaaatccaccaatca

SEQ ID NO: 20045 - DNA, 188 bp, Oryza sativa
acagctattgcttatattaccataaatgcaattgtattttgtatacaattatattgatcaatttccgttataatatggactcgtcgtgattactaacatagatatttctcttcccccccccctgaataatgtcgtaattttgaggcctcgaagcaaaaatgatggctacttttggccttctcttcaga

SEQ ID NO: 20046 - DNA, 892 bp, Oryza sativa
ctatactactcaatcaggaataattaactattttccacttttacgaatggtcataaaggatttgccattaaactcatatgttatagacacatgatggtacacatgtcataaatagtgagtgttaaatccgtaattgtcacatcttaaaaaaggcaaatagttaaatgtaacactcaatcatacttaccccatcccataaaaaataaatatagaattgaatgtgtcttattttaatataggacgtgactacatatctagtggtaattgttttgtctaaatcaactaccacatcatctatgagaaaccctatccatctatacttgaaataaaatcttctcttaaatacttatccgatttatgattcgattacaccgttgtgttcgtaacaattaaatctttataataaaatctcacatggttatattttgatgaaaaattataaattactttataatatatctaaattacttttagatttcactaaattacttcttagacatataaaagtaaattcaataaagcctaaaagtaatttacatatattatagaagtaacttataacaaagagaaagtaactttaatgcatacttttttcattgtggacgtgactacacagttagtgatagctggtttgtactccatctaatgtcacattttaacttgaaaaatgcaatagtatgtatctttttctaatccctttaataaattatatattttaaatcacatattgtttttaagatctatttgcatcattgtactccacccaaaatatgtgacaaaacgagattcatattgattaggaaaacgtacgaattaccccccctccgaactatcatggtcgtctgaattacccccctgaatcacaaaaccggacattcttcacccccaacta

SEQ ID NO: 20047 - DNA, 216 bp, Oryza sativa
cgccgccgtcttcctccgctccggtcgccgttcccgtcgtcgccgtcgacccggggtgagccgtagaccgccgtttcgcttcccccttccctcccctctctcgggcgccgctccgccgcgccggtggtcaccggcggcgaccatcggggtgcgggtgcgccgcctcccgtcggctgtgccggcgtggccgccttcgggcgcgtcccgcggctgcca

SEQ ID NO: 20048 - DNA, 1501 bp, Oryza sativa
aacagtaaaaaaatattcctttcaaatttgtttgcccaaaagacaacttttttctcatgattatgttgagtcattgcatcggttcaataaaaaactttatagtcttcaatagaaagttttctggaaaaaaatttatgttcaactattttagtaccccaaaaggtttttctatcacaggttaaaatttcttttactctttatgtgaaaattaaaagttttgcaactcactgtatttcggtaaatactgccatccagggtacaacccttctttttctgaatcttaagcgtaaaaataagaggaaaactcctttgttctgtcagaaatgtatagccaaataaaagatcaaaacgtttcttgatacctcatcccattttcttggtatattaccaagaagccggcttgctgccaaccgttggcctcgtcagctgatgtcttctccatgcgtctctgacgttgtgttcgtccgtaatgctgcatacttccttcagataattaaattgctaagtttttccccttctatcaactactccttccgtccagaatataaggatttttggggttaaacataagtattaagaaaataggtagaattaaatgggagaaggttgtaattggttaagaagtggaggtatgtgagaaaatttagtgatggaggattgtgattaattgagaaggagaatgctggtgacggaattattatatttttgggacaaaccttgagaactatatgttattattatgtctacgagtatcatctagccgcatcatgcatcacctttggattcagacatccagtccatctataaacaaaccatttgatgtgtacaagatgacgtttgacacttttttttacatcaagcacaaactcgtagacatcttaacctaatcggcgtcacttgacattaacataaagaatcctcgagcatatggctcattagttaattcgtatatttctccatataggccaagagcccaagacacaattgtaaactatactagaatagccttggttaatttaatctcagcatttttaactcttcagaaacagtgacagatcgatgatgaaatgaacaataaaacattacattgatgttgcaaggagcctgtagggtcaactcttgttacgacagattgatgtgcagatgaattatatatatgcacatatagtagcatcttcctcctcttcttctaccctctgtccattgtatctgcaattctgcattaagcttgaaagacagtaggtacagagctgtctctgtagctactagatagtcatcctcttgttgaacttcagtactgaaaacaagatctgaatttgtatttgtttcccaggttagattcttctgtgtttctgaagctgttttgtttttgcatgtggcttcactttttcttgtgttgatgccagcaatgcctttctccattttgttttaggttccatctatcactttatgcagtgaaagtttgtaactacaggaaattaagggcgtggtttgtataaaa

SEQ ID NO: 20049 - DNA, 1501 bp, Oryza sativa
aagaggagttcctagaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtggtttttcttttgttttgtttgtagatggccggcagcgtcagccgtcgtggtctggacatgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgactacgccatcttccgggatgctagctcggaggatgacgctaccatcatgcacctggcgcgcatggtggaggcgtacgacgcggctcgtatcgacttccatcagatggtgcgccgtgggatggtcgggaacaacatgaagatcctggagctgcgtcaagagaatctgcagctcaagaaggacctagacgcagtggaggcgcagctgcatcagctcaagatcgcccagggagaggtctgccaccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtgctggcccgtcgcagcggtagacgaggagttagtaggcttgcgcgtgtgttctttctcgtttgtcttcttgttgggttgtgtggggcatggttatgccggtgtgtggtataactgtgtcggagcctatctttattttatttgcctaagcaacttgaactttaatgaaccaatttaatagcagtaataaattcaagaattatggtagtcgtgggtggttagctttaattgttagctctctctgtttgctggttctgtgtggggttttc

SEQ ID NO: 20050 - DNA, 250 bp, Oryza sativa
aaatatctgaatgtgtgaactctctacatcatcctaaattttattacttctattttatgtttgtgtgttactgatttgacttacccttttgtagtatacatcgataaggatgatcttactaaaaaaaatacacaaaagcccaccaaagaacgccttacgtggtcaaaagaaaagaaagcgaataggccagacaccgataaaaaattctaaaggtaataaacattgtacttttgtataaatctattataga

SEQ ID NO: 20051 - DNA, 157 bp, Oryza sativa
gggagggggtgggaatgagtcctagggttaggttttgggtgtagttatttaggttaggattaatctgtaccgtccattcgatcggacggctctagctgctcccgcgttaggccgccgaatagaccgtgtggtcgatttcaggaggatgcaaaatgaa

SEQ ID NO: 20052 - DNA, 1501 bp, Oryza sativa
accttgggttaaggttcatgatcgaagttttatagaattaattattatagtgataccagatagggttcagagggatccaaaagtggtagcatgagtatggtagttggctcttggctgtgggggtggtaactgataagagggagacaattaaggaacaaaaattttacaaggcaatgagagcatgcacatcgacccatggggtataggagcctcctgaatcctgatacagatgaggatgttagatggggtgactcagctagactgatcctcaccggagacaggtcagtgaggcagcaccatgtgcgaaaggctatatacacataattcctacaaaagtacaattgtagttaatttcagaatcactatattgataaaatcgaaagtaaattaaaaaatatcaagacaggttctttctgcttcgtaatacaagacatgcatgtatatgtgtaattaactaacacatcttataaaattatttttttaaaccctccacactcaagatctctaattccataggatgcatatgcattgttttattaggattgttcaaacgaggaactgataataattctttcttatcattacattaatgatagttacgcattatatgttggaatagatggagtacaaatttcgaagctactttaaactaaatttatttattatgatcttaatttagaatcaaacatcagaaaatagaattcacttgtatatgaatatttactcagcagattatatacaaaatttaaaaagcattaaatgcattatttatataaatatatgtaatatcactagcatgtacaaatgcacagattaatatctatgttaccatggttttcctttcagctaataagtcgttgtcaatatttaaattttaaaacgtattttcgtagttgattttagtttttcatcataatttattttactgaattactaagtacacaggttttccgtcaaaattatattttcgaccccctttgattcaaagaaatttcatatgaattttaaaggatttcattcctataggaaattttttctatatagcactttgtatcaaaggaatgaatcctatggaatgcctcttcccatgtaagttttggaggaaatttaacatgaggtaaaacctcatagaaagaattctttgagtctttatctctcctcaaatttggtgctatcaaatggtcatttatatgtttttcctgtgctttgcaatcctctgttttacacttgtattcctgtcagaatcctatcattttcctattcctctatttttttccttcctgtgattcaaagaggcccttattttttaataagcctttttacgggttatcctcagctgtgagctagatggtcaagttccttatcttaaatagtatataatatcttcaaagaaagtgctatagttgttagcatgattacatacagaagttttgtctccatcctaaaatatatgagaccaagcatgcatctctaacatactacataaatcagactttccaaa

SEQ ID NO: 20053 - DNA, 1501 bp, Oryza sativa
caaaacatggagcgatcaatttacacttaaaccagtaaacttattattttcaattattagattatatctcctgaagtaaataatcccttcctcctaatctcctgtctaatttgtactattcgtccgaaaaaaatatgtacatatatacatctatatatggtagagagactattatttgccgggagactactaatcgcgaaaaaactatgaatccttccctcctaactttcagtccactcctatgtggatcctttaatttcgctcccctttgttttactaggtatttgactaggatatatcctagatgtatatcgttacatcccataataactatatattttaatttaaaaaatattatgtggaacaatattctatctttttttcaatctcattcaaatattcttaacaattactctatccttttcaaataattaatagcgggcattatattcatttacaaacggctccatcaaccctattagattttttaaagtagtgtcgaaggatcactcctgcttattttcaaaaggaaaaattatatttgtattttttaaagtagtgtcgaaggatcactcctgcttattttcaaaagggaaaattatatttgtaccgttgtctattctatatcacaatttgactcaactttttaaaagaatatctgcatcacatccatcttctcactgggcatgcccagtgagaagtcaccattggcaattagtgaatttgacattaaacttgtgctctacgttgatcttaagagacacaattatgtcagtatgagacccatattaattataagccataagaaaagaaagcatttgtggctacggtcggtttcacccgttagaggtgcattgatatatattttaatgattttaacctattagtttatcaaaggtattttaaaatattatatacagattctattgattagaaatgcagtggtatgaagtagaaatgaacgctttatagtatttacaacgtattaggtttacttttggtatggatgcaattccatctatcaaaaatgcattcaggtttccataccataataattagtggtgatagacatataaccatgataaaacaatttatgtttcaatatagaagacattattatcatttagtatatcaagtaaatggtttttgatatagttatttcattcttttattattataaggtagtactatatagttcttatagtgaataaggtaacaaacaactttctttagcttttttttataaacaataaataagttgcccgtgcatatattgagcgtgagcttccttcctaatttatataaaaaaaacaaagtaaacgaactgcatatattgagcggagagtccggccgggtcaagaaacaagattaattgatctaagccggatcgagatcgacgcagtcattgtttttctttctttcctgctatgatctccatcaatcacctgcacgccaaacgtccgataaagcttagctaggacacgacggcaatgtagagtat

SEQ ID NO: 20054 - DNA, 1501 bp, Oryza sativa
aattgctaaggtaattcgcactggtgttggaagtgggaactcgagtaggttctttattgcaattgttgattatttgtttgttttcggtgctaattatcccatttcagcagttacattgtcagaacgagctccttggcattacccattacttatggacgtattgtagtagccactactttgggccttttaaggtcaaaactttcattaatcagaagaaatattaccgacttgatcgcaggtagcaagaaaatcctggtattttttttgttcatgctaacgatggcagttgcgacccttttttatttatgaggtcatctgctaaattgccatcacgttgatcaaaggacgacatgagctatttcttttgggattagcattccgacaaaaatttggggatgaaatcaccagattttggactcgacacatcatcgtgctgggcatgacctgtaactatgtagccttggtgcttgtaaagtctcgtactttgtttgtcctaaaatatagtatttttgagattagtacggatattaagaaaatatgtggaaatgattgaaagaagattatgattagttgaaaaaaaaagtagttaaagaagaatggttataattggttgtgaggagaaggtaggtggagaaatagcttcattttagaacaagacatcatgctagaaatagctatattttaaaggaaaaattggttatatagcatcgaaagttcacgtttttggttttatagcgccgaaagttaccggttcactttaatagcatccaaagtttaccatgttcccatttttagcacttccgttatttttttcgtccgtcttgatcgttattgatccagccacacacatgatatgacatttctacccctcattgacatgcattatacttgtacttgtgaggggtagaaacgtcatatcgtgtgtgtggctggatcaagacggacggaaaatgatcgagaattgacggaagtattaaaaataggaacatggtgaactttgggtgctattaaagtgaaccggtaactttcggtgctataaaaccaaaaacgtgaactttcgatgctatataaccaattttgcctttaaagatcgaggtaatataaagctaagggtctgttcgttcatgcatttaggaatgagtattgagttgcttgcaaaacgataaatctcattagcgtatgatcaattgagtattaagtattataaattttaaaaattattttaaaaatatttgtatagaaattttttagaaattgtacattctggcgatttaagaaacgaattgacggtaaaggagagagttgcataaggaaaatttcatcagtagtgaaaggaaagaaaaaagaaaaagaaagaagaggccagcactgacatgtcggtcccctggtcttcttcagacccaaacccacgcctcccccccatctccgatccgccgcgccggcaaatcccccacaagcccaactcacgccgatccacctccgatggcctccgccccgccgg

SEQ ID NO: 20055 - DNA, 1501 bp, Oryza sativa
gttaattaattaaattgccaactaaaacttgataatggtgggttgtgagcacatggttttgagactcgtgctcatgacaattaaggaccggtttacgattttcggttgtgaaacattaaccgtgccaactacaagccagcgtgggcaacggctttaccttttgtatagcatggttcattgcggagcaccagactgagaagtggcggagataagcccacgggggtcgctggggagtccatgccttgttttataagggggtgattatgatccaggaacggtgcactgtggaggattgtgttgtgcgaggggtactgtcacagctcctttccgaggtaccgtggtggtattgaggcacatggtgacatgttgtggggctgtgtcttatgggtacagtggtacacctctggccagagtaaaactattcgaatagttgtgcccgcggttatgggcaggtctaacaatgtctttcgtgattagtctcacacttctcaccataataaatgatgttataactcgtaataatttgattagctcctggtttggagatagatctgtacagccgggtatggctgttcaggatggttggacctgtgcagcatgggtgtgttgttcagtgttgattaatattgatgattaattactctattgttttataattctcaaatgtttgctaaatgctgcttttacaaatgagccctatattatgccatcctttggtatccatgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttctgggcgtgacatgtggtcagtgtggctctggtacaagcatccgaagtgggccataagctagtgtattttgtgtccgaagcactacaaggggcgaagaccatgcttgagactagatgacggtggttgtcaaaggggccttcgccgttgtggctgttcaaaccgcggcatgtgaggtcgaagccactgccttggacggtactggtacggttggggccgcggcggggctgaaggctggacagcctgcatcgccctcggtggcggtacgccaccgtcttaggcggtcaaaagctctactccctcttcacccgccatctcctcttcgccttcgcccccctttcgcctaggcacaactctctctttcacggtcttttttggtggcatctgtggttttgctctgggttccccacggacggcgccaggtgttgtcgaatgacaactgcttcacgtcgaaggacgcggtaaact

SEQ ID NO: 20056 - DNA, 1501 bp, Oryza sativa
aattcataactaattctttgtaactcagtttaatgtggttcaatttgcaaaagttgtataaaataaagatctacatattaaaattatccataaattgaattaaatttatttaatcctttttaaataggctttaattagatttaatcttgtaaaattcgtaataaattcatatgaagtccgaataaggccgttcaagtctcataattcatctaaaattatgatctacatgtttgtttactttttatgtattgtctatttggtttttattagtctttttcctcgttttgcgtgatagcttgtcgtttccgtcgttgcgaaggttcgtgagtgcgccggaagtattaagaagattaattgaagaccgaatattgcaaggcaagtcacacagatcccaaacaaccctttgagcatgttgatcccgtttaaagctattgtttctattcaattattgcatttattttcgaatgtcattgggtggaattaacctattgtttgttatagccctttcgttcttgattactttattccttgataccttgggttattataacttgactagttgagctttatatattggttcagctagatagtagatatgattgcttagccatgcttagaaatattagcacactattgggataacttatgattcactattatttaatgatggcttaatgatagttcacgatggtcaatcgtgattggttaattaattaaattgccaactaaaacttgataatggtgggttgtgagcacatggttttgagactcgtgctcatgacaattaaggaccggtttacgattttcggttgtgaaacattaaccgtgccaactacaagccagcgtgggcaacggctttaccttttgtatagcatggttcattgcggagcaccagactgagaagtggcggagataagcccacgggggtcgctggggagtccatgccttgttttataagggggtgattatgatccaggaacggtgcactgtggaggattgtgttgtgcgaggggtactgtcacagctcctttccgaggtaccgtggtggtattgaggcacatggtgacatgttgtggggctgtgtcttatgggtacagtggtacacctctggccagagtaaaactattcgaatagttgtgcccgcggttatgggcaggtctaacaatgtctttcgtgattagtctcacacttctcaccataataaatgatgttataactcgtaataatttgattagctcctggtttggagatagatctgtacagccgggtatggctgttcaggatggttggacctgtgcagcatgggtgtgttgttcagtgttgattaatattgatgattaattactctattgttttataattctcaaatgtttgctaaatgctgcttttacaaatgagccctatattatgccatcctttggtatccatgtgcacttgcatatttgctgtgtggcttgctgagtatgtcatatgctcaccttgcaataatcaatcaaacctc

SEQ ID NO: 20057 - DNA, 1501 bp, Oryza sativa
tgataggtggggccctcatgccggggtcatcgtctacctcgcgccactgccggccgaaaccctagccaccgccgcttttcaaatccggtcgtccctttccgtttccggtgaaattgattgaggggaaaggatccctgtgatccactctaccttttcccttttggaaacatcgtctaaatcgctttggaaatcgccggatttgagttcgattcggatcgatttctctcctccgaaccctaaaccttcattcccgtcgccggtcgccgtgggccttcgccgccgctccctagctcctataaattgacccccaagctcccctctacccgcctccaccctcgtcttagtctctcgtagccggtagagctctagcgccgtgccgcctcgcgccgccgtcgtcgccaccgctccagccgtgcgccgccgtcgctccagacgtcgtcgtcgctcggggaggtcactgccgtggtcactgtcgcgtcgccgtcctcgtccgccctttcgccgtcgctgtcagctgccagagcatcgttgccgccgttgacccgatcgtcgccgccgctcttcctcgtcgccgtcgccgtccgttgatcttccgccgttgttttggtcaccggtgagttcgccgcgttgccctctacgtgttggttccctccgttcgcgctgtcgtgccgtcgttcgccggcgagcatgcacgcccgagcggccgccggtggtgacgtcaccgctgacgtcatcgtcgtcgttccccgtggcccggtcgtggaccgatggatcttggccgtccgttttggatagatgaatctcggccgttcgttttcgtgaactatcgccattaacccggtcctccgtgaaccctagccgatgatgcaataattcccttttccttttcaaaaataattcattattgcgtcataattcaattaaaatccataaaaatgctttaatccggtttaatctttaaaaattcataactaattctttgtaactcagtttaatgtggttcaatttgcaaaagttgtataaaataaagatctacatattaaaattatccataaattgaattaaatttatttaatcctttttaaataggctttaattagatttaatcttgtaaaattcgtaataaattcatatgaagtccgaataaggccgttcaagtctcataattcatctaaaattatgatctacatgtttgtttactttttatgtattgtctatttggtttttattagtctttttcctcgttttgcgtgatagcttgtcgtttccgtcgttgcgaaggttcgtgagtgcgccggaagtattaagaagattaattgaagaccgaatattgcaaggcaagtcacacagatcccaaacaaccctttgagcatgttgatcccgtttaaagctattgtttctattcaattattgcatttattttcgaatgtcattgggtggaattaacctattgtttgttatagccctttcgttcttgattactttattccttgataccttg

SEQ ID NO: 20058 - DNA, 1501 bp, Oryza sativa
catattatatcaggaattccatttacattagtttgttcacttgcatatccaactttgatcccatattagcttgttactgtcatattctgtcttaaactatcaagtcatttttcagtttttacaatgtccaatgttaggtataactatgggttcttaccatagcatactagtaaaaataaaactatgtaacggaagtatttgtgtgacaaacccaaatacattggtttcatacagttaatccatacaatttggcatgtctattaatggtgaatgttttgaaaggttgactgtatccttgattacctaatatagagatggagtaccatcttgtacatggtaaattgatgaagccaacagaagcttttgaacaatagactatgttttcatttgcaaatccattctaaataatttcagttttcaacatcacagggcagaattaaggcataaacttataagtaaatacagctgtgctgttgcttgagagtgaagcaatcatgccctttctgtgttgtagttaaatctttacaagcatatattgtaccttcggtttacttccataagacaatttagtttgacactcttcaaaattaaaatttaaccattgatgtctcataatatgtagttataaaagatgtaaaactagcgttgtgtgaaagcattttgaatatgatccttgcggtgtatttttcatactgaaagtacttataatctggctaattgtttgtcaaagtctaaaaggttgaccttttgaaatcaaaatacaacttataaaagtgaacaaaatgaatggaatgattaattaattatattttcttttttttgaacaaaacttaattatattttgtttagaggggtagaacatgttaccagtgttgacagaatcaacaactcctttggcttttgattcacaccagtttattagttgttagtagagcactgcccagtcatggtttaactagggactttaattgatgatatttagtaaaacccatagtcataagtctgttttggcttggccatatagtttaatctgccatttcttacatgtgttttctcttatttgttgcagatcttcctgctacaagcgtacgtgatctgcttttgccgtcaatacagaacttgttaaaagatctggatgctctagaccctgcacacaaggaagcactagaagttatagcccgcgaaaggtcgggaggtaaacttgagagccttggcaaggtaatgggagcacatcttgggattgcatcatcgatgagcagcttctttggtgagagcagcctccttgtgaagaaagagagcggggaacaacatgatactgctgccacgaccccctctcagcctaccccacaaactcagcaagagaacacaaggtttggtcgtataatgctgggtggttttggagatatgttacgaggcaaagcaaaaggcagcgatgagcccagttaaaatttaacaaatacatgcccagttgttaattcttcatatttttttccagctccat

SEQ ID NO: 20059 - DNA, 271 bp, Oryza sativa
ctcgctcccaagtggcttcttcttctgaatgattactccactgaaccttgcaaaaccgtataacgcgattcctggttttcctctcgcttacttccaagattctgactggcttctcaacataagttaaatcttcttgaagctctatacgatcaggatctgcttcctccgtaggtacacgtaaacatttcttcaactgagacactgaaacacgtcatgtattcccgccattgacggaggcaactctaactgataagctacttcacctcttcga

SEQ ID NO: 20060 - DNA, 171 bp, Oryza sativa
attcgtctcgcagttttcaggcagaatctgtaatttattttattatttatctatatttaatattttaaatatatacccgtatactaataaaatttggcatacgaagtaaccactgccgagatctaggaacaaaggggaaatggacatccggccggagattacgtgtgtgca

SEQ ID NO: 20061 - DNA, 1501 bp, Oryza sativa
catacccggctgtacagatctatctccaaaccaggagctaatcaaattattacgagttataacatcatttattatggtgagaagtgtgagactaatcacgaaagacattgttagacctgcccataaccgcgggcacaactattcgaatagttttactctggccagaggtgtaccactgtacccataagacacagccccacaacatgtcaccatgtgcctcaataccaccacggtacctcggaaaggagctgtgacagtacccctcgcacaacacaatcctccacagtgcaccgttcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtagttggcacggttaatgtttcacaaccgaaaatcgtaaaccggtccttaattgtcatgagcacgagtctcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatatttctaagcatggctaagcaatcatatctactatctagctgaaccaatatataaagctcaactagtcaagttataataacccaaggtatcaaggaataaagtaatcaagaacgaaagggctataacaaacaataggttaattccacccaatgacattcgaaaataaatgcaataattgaatagaaacaatagctttaaacgggatcaacatgctcaaagggttgtttgggatctgtgtgacttgccttgcaatattcggtcttcaattaatcttcttaatacttccggcgcactcacgaaccttcgcaacgacggaaacgacaagctatcacgcaaaacgaggaaaaagactaataaaaaccaaatagacaatacataaaaagtaaacaaacatgtagatcataattttagatgaattatgagacttgaacggccttattcggacttcatatgaatttattacgaattttacaagattaaatctaattaaagcctatttaaaaaggattaaataaatttaattcaatttatggataattttaatatgtagatctttattttatacaacttttgcaaattgaaccacattaaactgagttacaaagaattagttatgaatttttaaagattaaaccggattaaagcatttttatggattttaattgaattatgacgcaataatgaattatttttgaaaaggaaaagggaattattgcatcatcggctagggttcacggaggaccgggttaatggcgatagttcacgaaaacgaacggccgagattcatctatccaaaacggacggccaagatccatcggtccacgaccgggccacggggaacgacgacga

SEQ ID NO: 20062 - DNA, 1501 bp, Oryza sativa
atcacttccctaccatttttaactatacatattttcttttgtatttttaaaatttagtaagctatcaatcccaaacatatcataaactctctacaatatcttgccataacaatatttggtgatccagtctgtgtatttgtctaattacataacttggatcctctttactatatttatgaatggcgatataatagacaatacatattatatttttaaaataaaaatattaatgtgcaccatcgctagtcacatgctttaaagtaacgcttaggatatcgatatacctttcgatgaatatatttaatcattactcgcatagcatagccacatatattaggcgtgttcggaaggccaggccacatttgtggcagcagcagccacatgttagtctgatgcttgcagcactgttgccgttggttacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaaccgtaaaagagatcctaagtagaaacagtaaaacaattagaaatagaaagggtttaccacatcactcactgtaaagatgtttgtaaacaagtttcttattacgtgtatcgaaatctacaaataaacaagtttgactattgtgttgtgtgcattccatctctagaggctagacgggcatgaggtcatacccagaatccaaggaccgtagtactagaccgcagaagatccagatctgggaagaaaagcagtgggaaagcaagccgtttccgcgttgaaacagatttcctcctctcctcttctctttcctctctctcctctccgcccaacccttgacttcccattctattccatctctctctctctctctctctctctctctctctcgatcgtcttctccacttcctcctcgcatttcccactagtgaggcggaggccatagccatggatcccttccaccacc

SEQ ID NO: 20063 - DNA, 336 bp, Oryza sativa
ggtatgcgatatcttctcatatagttattttttaaaagatatctatcaaccatgttttatgaattgactcatatttgcaaattgatatgtttactagtatctttttatgtatgatgaattatgtatggtgcaaaattattactttattttaatatcatttttgttttttgtttgccttaatttattgattatactatatgtttatatgattacaacataaatatggtattttttccgtttagttgttcttattgagacgagcatcctcaccccatctttattttaatcctgcgtccgccactgctcgtgcgtcgccgattcccctgttgccaccgt

SEQ ID NO: 20064 - DNA, 1501 bp, Oryza sativa
ttacaaacgggactaaaaaacacttctccaccagtgcttattactatattatgatgcacctttgatcaatttatacttgtaactcttgttatatctatgagatatatatatatatatatacacacacacatacatacatatatacatatatatatacatacatatatatatatatatacatatatacatatatacatatatatacatatatatatatatatacatatatatatatatatatatatatatatatatatatatatatatcacctatatagaaatcttgcatatgccattggccagctttgctcattagaaaaatgaaattagccaaggaagcaaacgagccataagcttcaggtccatcctatgtcagagtcgtgcatgcaggcagatatgctagctggaatgtactaggttgcttaggtggattcgatcgaaggaagggattttttttcccattatatagataagatgcgcaccgtcaccacatgcacacacatcatactcacacactcatgactatgttcttttttaacatacggtaaaagagacggagacaaacaacaacaatttacttaaacttctgcaggctactatttctgcaaataatttgttatatatttatcgataaattttttaaaaaaatttgacatatgtaattgttatgtagtgtagttacattgtaacttgtatgtaattacaatgtaacttttacatcattttaaattgttagattcgtttcaagattcgtgcaagcgaaaaaattacagtgcatgcacatgtgagaggattcactcctatgatgtccattttatggaaatagcatgtttcgaagggatttttaaaagttacatacaagttatattgtagttacatgaaagttatgatggaaattacaccacgattgtattaaaattatatttattaaatcgttggaagaaaatttatcgataaatatatatgtgatcccttctgccaaatactagtaggcatgtatatgccgacaaatttaaacatcaaatgattcaagagccaaattaacccacacaatatatataagaaagaacaatagaatcttaatcatgcaatttggttgaagctgtcctatactattatccttttctataaaacagattagtagtactatgctctgcaggagtactactcgattaaagcataactttgcttgctaaacacacaccaccgatgggaaacaacagagcatcaagggtgaaacactgcatatgcaatgtgcacgttcacagtgcactactcttaaatcgatcaaatgtacggcgttaatgattttaaacctgcaaattgggcgcaaattgctgatcatgttgtaatataattagctttttctttcgagggaacgtaatatgattaactgacgcctatataaaccatgcatggcctctgctgcttcttccctcatcgacacagcagtaagatactccaaatatcaaggaggagtttgctaggattcattcagcaa

SEQ ID NO: 20065 - DNA, 1501 bp, Oryza sativa
tgttgcaaccatgtcagtcttctaacttcgacttcaatatatatctgatcagccctatcccccctgaataataagtagaactgggtcctgtgtatgattgatacatgacagagatcccacagttggataatgtgctgcatctgctccttaaataatctgtcccatgaatcaggaccatcctgtagagatcctgcattttcctctgaatcttcttccatgtcatttgtcttgccttcattcgattccaactccaagacctgtagtaagattacaagaaaacatattttagtggtgaaacaaagtaacctttgcatgaacaaaacttatgtgtgcaagataaacgatcataacctgacagacaagcagctgcttttggtattgaagttttgcaactctctccttcagttcagtgacataagcccggatatttctaacattctcctcagcagcattttggaacatcttctgcatctttttcatgttcactgagctggatcgcctatagcgtggggtttcatcacgcgatgatacatctccagtgtcttcactcttagtaggagtagccctttctgaaccttcatgagacacagtgtcaccctctggagccctattctcaacttctggctctaaaggcctactagaagagaggggagagcatggtgctcttatcagatttggtctgtttatgttgctcacgcccagtggaagaagcatcctcttcttcttctttgctctgttggactttggtgtagtctcgttacattgtgtgccaacatttggaagtgacatcaccaatctatcaatagacctctgtacattttctagtttagcctcaagttttgcaatatcattgtcttgcatatgaagtctactaatttcttctttcaaatcagatccatttccttcatctgtgatcatgtcaacatctctgtcagatctgacagattgcatccccctgatttcagcctgtagtttagcaatagtttctgctgcatcttgattgccatgtttatggcattcgacttctttgtgcagtacttcaatagctcggttagcctcaacctcaagctgctgttgtagctgctcaagcttgcgaatttcatgctttaacataaatggagcagtggctgattgtctaatcgagctccgtatcttcattttgttacttggctgtagtgatccagaatatgtgaggcatttccgtgtcctttgtggtgagtcaaaaggattccatccctaaaagaaaacatgggtttcggaaagattaggttgacagtaaatgaatgtggttctgactggctgatatcctttgaaagaaaagtaaatttgcaaggaaagggcaaatactcactggctgattatcacccatcttcttctgtaattcttcaagtttcaactgtgcattgtctctttgcttcttgagttcctccatttctttttccatctgcagtgttcacttaattaggtcagttacaaaatggaaatgattccagtgaacttc

SEQ ID NO: 20066 - DNA, 1501 bp, Oryza sativa
tattaagatttaaataaagatggggttttatgaaacatggagaccataaatcttgtggtgtgccacacatcataattaatacatatggtttccacaactttaatcatacaatatggagttttctgaaatttactctttagttttggacaagggaataaattaaacggtttcaaaagttgaggagtctgtaatacccgatattaaagttaaggggtatattttagactaatacaatcttggcggggttaaatggacttaaacctttttaatgtactctatgcattttaatcctttttgttgttttatcattttaggtttgttcaaagtctatgtaacttaaaatggaatggagggagtaatagttttatagatatatactactcagtactcgtaaaggaagtcgttttggacagcgatacggtctccaaaacataactttaactttttatttttataaaatatttattgaaaagtgatatatgtatacttttatgaaagtatttttcaagataaatctattcatataatttttacatcttcaaactcaacaacttaagggttattcatgatttatattcctaatgtttgacttaaatattgtccaaaacgacttcctttacgagtacggagggagtatatctcgttccaattccgtattataaacgattgatcacacgtggaatatatacccaaagataaaaaaagccagtagtaagttattttaagtttttatttgcaataggctaatatatgtagacaagtgcatatccaattatccatgcatatatatcagcgtatgcacgtacagtggatttgggttcaggttgatgtgatggattgcaagcatgcatgcgtgtagcgcacaagatgctggtgcatcttgcccacaggcccaggagacctacatgcatggcccatccatgtttcagcacgcgggcaggacaagacgtagcagtagcacttatagttggccgaaaggcccggggtccaatggctcggcccatagtatggggttttggcccagcctaaacatggcacggtccgactggcagtgtcgggcccttgcgtgggcctcttcctcggcacgatgggccagtttggcatggtccggtccaacaatcaaggagttaaatagatgagcgagccaaaataaacttattccggctatataaggtatatatggcacaaatagctgcggcgcaaaatagacttaatctagccaatggcccaaatagatgaggaacgcaaaatataatttttttccaaggttgagcacggtgggccttcatgcattcaggctggtccggcacagcacgagtcatattggatcgtgcctaggccgatggtacagcaagtgggaggggtacgacgtggcctgacgcacttctctactattataaaaattgaagatgtttttgccggtactttgatacgtcattcgtgttttagtcggtttttaagtttattcgcttttgagaatacaaaaggagttgtataagaa

SEQ ID NO: 20067 - DNA, 1501 bp, Oryza sativa
ccggccggagggctgggagccggcgccgcagctccgccaccgtttgccgcgccaccaccgttcgccggcgtcggcttggggccttggggtctgttgtagaaatagtcgaagaaggggcacaggaacgccgaggtgcactccgccgacgacgagtagtgcatcctcttgccggcgacggcgacgaaggtgttagccttattgccgccgttgtccgtcgttgatggcagcggcacgatcttggacggctcctgcccggggcacggcgcgctgctcgccgcgctgtgcagctgcgcgaagcagccggcggcgccgtggaggtcgtcggcggcgaggggcacgctgaaggcgccgtcgccgtcgaggtcgccgacggccttgctctcgtactcgccgtcgctgttcttgcacttgatcgccacctggagacctgaacatcaccaaacaattaatcaacgacggtgatatatcgatcgcaattaattatcgatgaacatattatcatcatcatgcatgatatatatacccttgaaagcatcctgcgccttgatgttcttcctggagcagccgccgcacttggccaagccgacgacgagcgccaccgccgcctcgccgtccgcagcggcggtgacagccatcacgagggcggcgcagacgacgacggcgccgaggactagtgctcgtgctacagctgccattgctgaatgaatcctagcaaactcctccttgatatttggagtatcttactgctgtgtcgatgagggaagaagcagcagaggccatgcatggtttatataggcgtcagttaatcatattacgttccctcgaaagaaaaagctaattatattacaacatgatcagcaatttgcgcccaatttgcaggtttaaaatcattaacgccgtacatttgatcgatttaagagtagtgcactgtgaacgtgcacattgcatatgcagtgtttcacccttgatgctctgttgtttcccatcggtggtgtgtgtttagcaagcaaagttatgctttaatcgagtagtactcctgcagagcatagtactactaatctgttttatagaaaaggataatagtataggacagcttcaaccaaattgcatgattaagattctattgttctttcttatatatattgtgtgggttaatttggctcttgaatcatttgatgtttaaatttgtcggcatatacatgcctactagtatttggcagaagggatcacatatatatttatcgataaattttcttccaacgatttaataaatataattttaatacaatcgtggtgtaatttccatcataactttcatgtaactacaatataacttgtatgtaacttttaaaaatcccttcgaaacatgctatttccataaaatggacatcataggagtgaatcctctcacatgtgcatgcactgtaattttttcgcttgcacgaatcttgaaacgaatctaacaatttaaaatgatgtaaaagttacattgtaattacat

SEQ ID NO: 20068 - DNA, 1501 bp, Oryza sativa
gatgctagccaattaaaggttagatagcgatattgccgaagattatgtaagatatatgataactcgatgaatcacataaacaagattagagtatcatgaagatggaagcactaatcccgagaacgcaagccgccataacaagttttaccttttgttgaagattgaaaccgatgcagctcaacccgaaagcaagaactcgtcgaaacaaaataaaagtaaaaagggcggcgatgcgccgagattgtattgaacgtgtgttagtttgattacatggggctcggggtctatttatacccgagattacaaaatatgtccatatcggacacgactcttatctctaacaaactctaagataccataagtctttgcggcagacttttgcccaaacatatctctaaggaaataaaatatcctaactaatagatacaattgccttctcaggattctatccatgcgtggccatcctcatgaagctcattaacttaacccgacaacatattccttgtcatattgtcgaattcggcttgatcggctaaccctgtccaactcggactctgccgatcctggtcgcagccgattcggacttcagccgatcccactctgtttccggaacgatctccatctcgaactccgctttgattccttcttcatctccgatacttagattaccaaatttggtcgttaacggaaacacatgagatcatatatatgtgcctaaggtataaaaatccacatccagctgccattaggatgtaggtgaaaaacatgaaatcctaagtgcttcctctagtcataaatattggatatttaggtcaaacttttaaaactttgaaaattaattatatatgacaataagtttataaaacctaataacttataataggatgattgtactttgtcaagacccaacggtgaaatttttaaaaatttgatcaaactatatcttaaacgtcccatagggagtacatatatgatttgaggtgaataatataatgtacactacattggtcctaaaataactgccattctaaaggcgaagggatgaattaagaaaaatataaaataacctatatgcccctcattctaggtgaatggagatgagatgggacaactaattctctaggattacacttattttcaagcggaggtagtgctttaccaacatgagtatctgatctatttctcaagagaaatagatgcatggttggaaaagaaatagatatatatccctctattttgtagtgttataatataagatcggtcgcgcaaacacaaactgaactcaaccaacgccatatccacaaatcggatcaaataaagaacatatatatatacatatgtacgtagcaatgttcgcatagatagaagagagtaacaaatttgaggggattaaattaaactacataattacacatgaaacgatcaccagcaacacacacatatgatccttccgcgaaactcatcgactgatcgaacaaaaagaaaaaaaaaggagatccaa

SEQ ID NO: 20069 - DNA, 727 bp, Oryza sativa
ctttattcgttcaaaaagaatagttacaagaagttgccgaatgaaggcagggggatcacccagggttggaaattttggaccgaaatttcggtcatttcggcgaccccccgatacgatattaattcggccgaaatttttgaatttttgaattttttcattaatttgggtaatatttgtttaaattcaattaaattttgttcaaaatttcgggttagagtgaaccctgggatcaccacagaatatgtttatgtttagggttttacttctgtgaaataaatccgtcagtccatcataaggtggtacgatgggaataagcgaaacaatgaaaagataagcgaaaccgcacgaatccatctccttcctcgcgccgccggcctgccgcattctcatctcttcgctcttttttcctcccttcgcatatgtgcccccacggcggtggaaccaccggcgcacagtctccttcaccggtggcggcgcatgcatcatcgagtagccatcccgcacccacgcccccgccgctaccgatttctttttctccatccccgcaaccagtccacatctatctgcccaggagcgacagtgccatcgctaccgaggtgcctggtacaatctatccacagccaccaacgtggcaacgccgcccctcgccggagggaggcggataagtcgggtgctagggaacacgatagagctgagtgctcgacgagacggaggcggcagctccgga

SEQ ID NO: 20070 - DNA, 1501 bp, Oryza sativa
attaacatgtttcgctagtattataattaccctttgttgatgcagcttctatgtgaaacaaattaagatttgtcaatgattttcatgatccaagcagatgattatatttcaaccgaccgctacagttccaattttcaaaacgaaaacatccaagtgatcaaatatggattaagaaaaaaaaagacaaagaaagctcgagactaacggcacgacggcacggtgccctatctcgtaatggttgatccaaccaattgcaaatggtaataagattttcttttccgacaacaaacaatcaattagacctaaacaagttgctacagctagtgatttctccaatgataagcagccattagtttgttatatttcgtttgacgttaagtccgatggaagaccactgcacacacatgtgggcttcttgattaaaattagaatttcatccattaccttctcatatttggaattagaagattgcatgtgcttagatgtgaaaatttcggccacgtctctccctatacatatatatactttcatgggtctatatttatatgtatgtatacatgtatatacacaaaagtatgtacatgcaaaattttacacctgtatagaaaaagctttcttctaatctataaaaactgtgtactaatgtatatacactttatactaatctatagaaactttgtactggtgtatatttgtttgttttatgataagtactgattaattctcgcgtttcattattttctttcttttttagtctagtttgattgtcgaaaaaatatattaaaaattacttagtaattttcatagcaatgcgcggggaatcacttcctactcaacctattatctactccttctagcatataattaaatgattaattaattagtaccgttttacttgcgatgcatatgattcttttttataggacgttgggtgactcaggactagctagtggtcaagaactcaagattcatgttgctctgtcaagctagctcctcgagattaaacgacagataaaaagttttaagcgctcgatctaaattcaatactatttcctcgcaaaaaaaaataccgaacacaatttcatgtaaatttattttttcccatttcttggaagattggccaataactagtaacatttttttttactttaaccaatataaaattcatattatgcttgttcacttgattctctgaagaaacctttccagctgtggcccagatgaatggtaaggatgagcccatgcggcccaaaataacttgattttcttatgggccgatggctcttgcattgacggcccggcccagttaagagcctcatccccacgaggtgaacgcgaaccacccaaaccgagtggagaaattcgccacgcccaaatgctgccgaccacctgccgcgcgccgccgtgcccgtggccgcggccgctcgccgccggtagagccaggggaggctatggcctcggccgcgctcgcggggtgaagaggagagcggcggcggcgcgc

SEQ ID NO: 20071 - DNA, 1501 bp, Oryza sativa
cagaggtcaggaaacatcagagctcagaaagtgccaaaatgagtttgcaattgatttcagctaatatatccaccatatgacattgtattgtaactgcacaatactaatcagaaacaatcgtatcccaattcacaaagcagcaagaactatctcatcctcaaatctcaaagcagcaagaggaaacactaacagaatctcaaatctcactttcgtaacccatcaacccatggcgttcaaaacctccatcaggtacgtacagctttggagaggaacaccacgatttgaagcaaactacaggctatggacagcatcaatatgaccaccaaaactcgcagcgctgagaaccaagtcgtgtgggtggggggggggggcgcatgtaccggtgagtggatctatgggattggtaggtagtaggactcgcggaagatcttgagatcatagacgatggcgtggaggcgatcacggcgaccggttggggtggagcgcgcggtgaggaagaggcgtacggccttgaggatgcggttggcgatggggtgcatcctgacgcggaagatgcctccggcgtccgcgtcgaccaacttgccgttgttccggatagaccaggccgcattcttcaggagaagcatcaggaccctgttctcgtcgtcctccaggaggctgggaaccaactcgtcgatgacgcggtccacctccgcggcgatgccggcgacgagggccagcttgttcagttgggggcacgcccaaccgcggaactgcacggcgtcgtccagcgtacggtacatggtgatggcctcctcgagggactcgaccccatgcagacgaacgcggtacgccacgccggagccgatgatggacttgagctcctcgagggtgtagatgtcctgcgccacaagcgccatgacttctcctcctcctcctcctccgccgccgccgcgctctctctctctctctctctctctctacgtggtggccgcggactggttggcgatggggaatgggagagcaggtgtggggatccccaccctcctttttgtactaggcaggatcagcgccacgtcatcgatccgcgcgttccttccgtgccaagcacagtttctgccgttggatctatcgacgatccaccgttggatctcaaaaagaagcccaccgcgtccagcctggactagtcttttctctctttttttcttttctttttctttttcttttttcttttgaggaggctggactaatctactcagcagacgcgagaggaggcctaacgggccccgggaggttgggccgaaaagagagggaggcggcctggttgagcagcggagtttgataattggaataagttcaccgggggtcccttaacttaacagcgagatttgttggcgtcccttaaccacaacaccagaaatcttcaccctctaaacatgaaaaaccgtccaatttatatcctatgatagtatagatgcctgatttcactaatgtggcatcttagtcaccaaaataaaaataa

SEQ ID NO: 20072 - DNA, 1294 bp, Oryza sativa
cctctgttgcaaaggactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtctgtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtactcaagttagtgttttaattcttaaaacctgcttaacaactaaaatgtggaatggttggcctgggttggcataggacgagctgggacccagggtcgggttgccagttcggtctgtatcatcatcggccttgggttaaggcaggttcgtgtgggtacacggccttgattaatacaattgtatagctctagaatcgtgtttacaaaatagctttgagcaactaaatgtctttaaatgctgattactgcaaaccctaatcccttatattataactcccttgtactcctttgcatttattctgcactcgtgggtgtgtcttgttgagtacggtggttgtactcagtcttgctcaatttttcccaaacccagaagaggtgttcctggatgatgaaggctttggtgtctagctcgtgcctgccatcaagcgcatgtggtcgtcgccctagtcttccgctgtttttcgtttgtcttcatgtgtgctgggccttcgccgcccatgtaataaattaactatttacgcttccgcttgttaaactctgaaatgtatcaacttttggtgtaccttgcctcctgggacaaggaataatacacgcacgtaaggaacgcccgttgggttaattccggtcgtgacacccggtcagaccggctgcacaccctcggtcagaccggcctcggaggaatttttctgaaaattctaaaattgattttgcacgtggatatatgcctattggatcttctggtcgtgtgtttcagtactggattactaaatttttattattatctaacccagtactgaagcttcgacttcttctggtcgtgtgtctcagtactggattactaaatttt

SEQ ID NO: 20073 - DNA, 1121 bp, Oryza sativa
agggaggcacggggagtgtttatatagggttgggagtgagaaagggcggccggaggagaaggaaaccggcgcggcgctctcgggctccatcaatggcgccggcgagatttgcgggggcaaatccgcctgtttgaacgggagagagagagggaaaagtggggggaaagggagagggaatcacggggagtgatttccccctctttattgcgcgcgggggcggcgggatgcggtgatcccggcggcggcggcgctagggcacgggcgaggcggcggttgcggcgcgaggtaggggatgacgggtgggccccacccgtcagcgagggtggcgggcgggcccgcccgtcagcggcgcgcgcgcggggaaaggccgaatgggccgcgggggagaggagagagagggagggagctgggccgagccggcccaagagggggaagggggaaaaagactttttagggtttttttctttttataaaacctttttaactttgtttatttcttcttaattattatttgtgctctgaaaattccactaaaatttatttacgcattttaggcttttaggaaatatacaaaaatcctccaagccttattcgacttttaactttgcacatttttattgttggaggctttcacatggattttacttattctatgcacaattttgaggatgtattttagagtcgttttgggacgcgacacccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagcatgattttaggtagatgcttcgctattttaattaggtaacactaggtggtttttcaactctagactttgggaatattcatatcacctggacactttggaatggtttggttattgtggaattggcttcacaccgctccttctattcaaaatccccaaaatggttttaggctgggctcggggtgcgtggttttgatagtagcacctcggccatataaggaccggt

SEQ ID NO: 20074 - DNA, 349 bp, Oryza sativa
tttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcaacaagacaccggccctgtgccatgacatctcgactaccgggccgcagctcgtgtagccttcatttgtcctaga

SEQ ID NO: 20075 - DNA, 1501 bp, Oryza sativa
ttccgagtggctttcattaagcagagatgttgacctgcagaacatcttagaaggaacacacctatatgagttcgactgctagtcacaatctatgagatttgggtgatctctagatactcatgaaaggcctggagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaatactggtatataaaagctgctatggaatagagagcattctcatgagccttgaaatttggtggggattgatagatttaattggataattgatccatttaaatcaattaaatcaaataaattccaaggctcattatgctaggaattcatgtgtattcatttttttatgggatatcaatgggatgaagagttttgagaattaatccatttgattagggaattggtaacttatatcaattagttctaattgatggatggttgatggttgtgtagtggaggatggttcatggctagttgatgacaattagttgctctattcctcttcctattccattggtaacttacatcaattactcttaattgattgttggttgatggttgtgtagtggaggatggtttatggctagttgatgataattagttgctctattcctcttcctattccatgactcttactcgtcatcttccattcctcttataaaatgagaatggatttgatctcccgcgagaatagtgagacacactttcatccattttccaacgttgttgctgctacggtaatcccatcccgacgagtgtgtgcacacgtgttgggagagtaggcctccgaaaccacgcgctgctgcgacgtttgcacggacgggcgggcgatcaggtttttggggagcgcaacacgcgactactcactgttcgtcaacatctacttcactttcaccaatatgtcgaacactggagacaacggcaacactggatacaaggagaaggaggctcccgtcaacaccaacggaggcaatactgcctcaaactccagcggaggaccatgcttggggtataaccttcttacattatttcaattagaagttttactgttaatgttcatcgcaatgtcaacattgtgttattatgtgattgttgatgcttattctacattaagcatgctcatgttgattacattcaccactgtcactggatcaaatcccattgtaaatatcatgtttattatcttgttattttggattaaaatataccaaattatgaccaaagttctaacatcgtcctattctaattcactgtattttagaacggatgtagtagtaattatgtaaagttttgaaaagtaagacaaatcgtcgaacgtgcgtgatatcaatcaacgatgttatctgttaaaaaacaaaacgtaggtagtacttt

SEQ ID NO: 20076 - DNA, 1501 bp, Oryza sativa
tatatcgattaacgtagcatgcatgggagactagtatattcttgcattagccttaattactttgctaattgacttgttaattaagcaggtacgtgctagtgcagctggtggagccggggcacttgcccgaggtggccaggccgcccctggtcccggggacgttgctcgaggacaagtagcaccgccacctcgaccagatctgggagcgtcccactgccacgacagcggaagtggctggaggaggagtggagcgcggcgggtggagtagaccggcagagcggcggcggcggcggcggcttgactagccagaagttgaggatgcggcggctagtgaggtcgaggcgggacaaggggagggggaagtggagagggggttggagaagagaaggggaggcgctcgccctaaatctcgacagtgccatcggcggtgagcacggagtccacgtaggaagtgtagtttgcctcggcctcgatgaaccacaccccttcgctggtgctgtcgatctcaggctccctgatgatcggcttcatgatgcggctgacgacagggtagtggtggacgaccgatgcggcctggtcctcgacggcttcggcggagacggaggggaatacctggatgaagtcaacgaagatgcagacggcgacgatcttgtcgttgttgtcgatggaggatagcgggagggagctgcctagggtaggctccgcagtgggcatcagcgccgcgtcccccccaacagccggtgccgagtcactgtctcctcctcgccgtccctagtcaacgtcttgtcattgccgccccaaactcgtcgttgcagcgggtcacgaccccactccacctcctcaccaccatggatgcaacagccgctaccaccacatagcctgtgccacctcctctccccctttctcgccggtgcgtccagatggctctctcgcctgtcctcctctaccaccggcgtgttgtcaaccccccctcctgccgctgcatgggaagaagatagagatgttgatggggctgatacatgggccccatatatctttttttatttttattttggtgactaagatgccacattagtgaaatcaggcatctatactatcataggatataaattggacggtttttcatgtttagagggtgaagatttctggtgttgtggttaagggacgccaacaaatctcgctgttaagttaagggacccccggtgaacttattccaattatcaaactccgctgctcaaccaggccgcctccctctcttttcggcccaacctcccggggcccgttaggcctcctctcgcgtctgctgagtagattagtccagcctcctcaaaagaaaaaagaaaaagaaaaagaaaagaaaaaaagagagaaaagactagtccaggctggacgcggtgggcttctttttgagatccaacggtggatcgtcgatagatccaacggcagaaactgtgcttggcacggaaggaacgcgcggatcgatgacgtggcgctgatcctg

SEQ ID NO: 20077 - DNA, 1501 bp, Oryza sativa
acccacgcctttaaactatacgccccgacccgccacccgccgcgatcttgatctcctactcgcgtgcgtattcctgtggccattagccgccgccccccccgattctcatttctacttctccccctcagcttgtgccgctacagctacagctactggtccaccacgacgacgacgatcgcccgtttccctttccgcttcctcggccgtttcgcagcggcgtacgtccgccacggggaaaccgacccggcgttgcgaagaaagggatggacgacgctgccattttttctacccatgctttgatgcggggcacgtcacagtgagggagccactccgcgttgttgtaaacaagctgctagctagcaataatggggcatgggtgaacacacgcacacgctcagcttgaattttcatttcgatcgatcgagcgagcgagcgagcacgcacgcactctcactcctagaagataaacatgtgacgacgtgagatcatgtgaacattctactgttggagccttaatatccgtggattatcaaaatgcagatgtcgtcatcgcctcgatctcgtttccagtgagccggccttccacagaagcaagttttttaacggatcacaccgttaattttgagcgtatgtttaaccattgtcttatttaaaaattttatataattgtgtaagatataaattatacttaaaatactataagtgataaaacaactcataacacaagtaaattatactacctccgtcccataataaatatcttacaacaacgtttgaccattcattttatttgaaaaattagtgtaaatatataaaaaaataagtcatacttaaagtaattttgataataaaacaagttacaaacaaaataaataagaattccaatttttttaataagacgaataatcaaacattgcaaacaaaatcttaaagcgacgaagtaatacgggacggaggactattcgtcccatcccaggactttagatatgggtctcgtctgatagatttaattgggtaattgatccatttaaatcaattaaatcaaataaattccaaggctcattatgctaggaattcatgtgtattcatttttttatgggatatcaatgggatgaagagttttgagaattaatccatttgattagggaattggtaacttatattaattagtcctaattgatgaatggttgatggttgtgtagtggagtatggttcatggctagttgatgacaattagttgctctatttctcttcctattccattggtaacttacatcaattactcttaattgattgttggttgatggttgtgtagtggaggatggttcatggctagttgatgacaattagttgatctattcctcttcctattctatgactcttactcttcatcttccattcctcttataaaatgagaatggatttgatctcccgcgagaatagtgagacacactttcatccattttccaacgctgttgctgctacggtaatcccatcccga

SEQ ID NO: 20078 - DNA, 1501 bp, Oryza sativa
gatctggaggactaggcttgttctcggttgagtagcctgtggagtggagtcgccatagctgttccgtagtttgttatagttttattttccgctgcgtagaatgttttattctttgagaggaactatctacctctgtaataatttttatttgcgaatatttgatagttatttgtactctattatcaatattgtcattgtgtgcctcgcttgattcctggacgagggtttaacacacatgtaagcgtttggaattttggatagaaattccgggcgtgacaggttaatacccccaaacagtgtcctcctggtacttctagagtttcttacgacaacctgtcatggccgtccaaccggggctaaatacggaggagtaccctccccagaaattgtcttaggaatatatactatcgtggaggaatactcgtactgagctgtcaccatcagcggcccacctctactgtcccgcggcatatatgcccaattaatgatatttaataatctaagcaccatgcttacattactacatactattctatacccatgcacccgacatagagcaattgataaatcaaacattaaatccgcaccattacacctctctggtaggctacccacacaatgaatataatgcataaataaagtaagaccggtacttagactaagcaaagtaccaaatatatataaagaagagtatttcattaatttggaaagtattacagaagagattataagagctgctagagccataccgaaaactcttccgaagattccgaggatttccgaacactattctatactacttgtcacgaccggaaataacccaacgggcgttcctgacgtgcgtgcatccatccttgtcccaggaggcaaggtacaccgaaagttgatacaattcagagtttaacaagcggaagcgtaaatagaattattacacgggcagcgaaggcccagcacacaaagacaaacgagaaacagcggaagactagggcgacgaccacaagcgcttgacggcaggcacgagctagacaccaaagccttcatcttcaaggagctcctcttctgggcttgggaaaaattgagcaagactgagtacaaccaccgtactcaacaagacacacccacaagtgcataataaatgcaagggagtacaagggacttataatataaagggttagggttgcagtaatcagcatttaaagaaatttagttgctcaaacctcttttgtaaacgcgatcctataactatacaaattgtattaatcaaggccgtgtacccacacgaacctgccttaacccaaggccgatgatgatacagaccgaactggcaacccgaccctgggtcccggctcgtcctatgccaacccaggccaaccattccacattttagttgttaagcaggttttaagaattaaaacactaacttgagtacattgctcggcttgcccataaccgagggcgcggctattcgaataggttatactctgatcagaggtgtacatct

SEQ ID NO: 20079 - DNA, 1501 bp, Oryza sativa
gaagagtatttcattaatttggaaagtattacagaagagattataagagctgctagagccataccgaaaactcttccgaagattccgaggatttccgaacactattctatactacttgtcacgaccggaaataacccaacgggcgttcctgacgtgcgtgcatccatccttgtcccaggaggcaaggtacaccgaaagttgatacaattcagagtttaacaagcggaagcgtaaatagaattattacacgggcagcgaaggcccagcacacaaagacaaacgagaaacagcggaagactagggcgacgaccacaagcgcttgacggcaggcacgagctagacaccaaagccttcatcttcaaggagctcctcttctgggcttgggaaaaattgagcaagactgagtacaaccaccgtactcaacaagacacacccacaagtgcataataaatgcaagggagtacaagggacttataatataaagggttagggttgcagtaatcagcatttaaagaaatttagttgctcaaacctcttttgtaaacgcgatcctataactatacaaattgtattaatcaaggccgtgtacccacacgaacctgccttaacccaaggccgatgatgatacagaccgaactggcaacccgaccctgggtcccggctcgtcctatgccaacccaggccaaccattccacattttagttgttaagcaggttttaagaattaaaacactaacttgagtacattgctcggcttgcccataaccgagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtacagactatagttgaaaaaccacctaatgttacctaattaaattgcgaagcatctacctaaaattaaaccactagttgaggttttgtttgttctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcactttcccaaacgtcggcttcaacttccacgaagagcgtatcctccgaagctgcagcgtctacacgaccaacggaaaagaaaaggcttttactctaaataactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtc

SEQ ID NO: 20080 - DNA, 1501 bp, Oryza sativa
gaatttaatacgttttggttgttacatctccacgtatctagactgcactatagccacgatactgacatattcaccatgatctgaatgtctaagagcaactggaccatgcaaagaccagatacaactttcatactgcaagtctctggcagagaattcaggcttgaaactagctagctttactatgtctcaacctacaagcatttctgacaacaattgctttcaatctctgaattgagagtgatattagctgctctagcctgtccaatagttccataacaacatctgaacatgcacaacagccacacacgccacatcatttcttgcattctagtttctgtaggcattaggtgtggttgagcctacttttgtttctttgagtcccttaaagccattgcttcatgacagaatcattgaccaggaacaaaatgtcagaactttacacgactcaaaattcagcattgttcgttggtagtattaggcagcacagggatataatattcggcaggtgcatgcattatgcataggccggttgctgaagattgacttggagcaataccaaacttcatagttcttacatattatcttccttgttttcttgagagaatcgtaccgaagtgtgcctaaccatgtgtttcatttcgttgtttgaatcacttctacgaaaagaacactaaatagacccatgtgtggacatgcatgataaaagggcattttctatgtggatatggctatagagccgcccatgttcatggtgtgcaaattcagccgtgtgacatcactgatgtgactgcgttgatagtgtatagtactccctccgtccaaaaaaaaaaaataataaacctgggtttccgtgtccaacttttgatcgttcgtcttatttaaaaaaattatgaaaaaaaaagataagtcacgcataaagtataagtcatattttatcattttaacaacaataaaaatactaattataaaaaaaatttatataagacggtcaaacgttggacacgtaaacccagggtttgtctttttttttttttacggagggagtagtgctgtagaaaaagtagacctcatgttctcgtatgtgtgattccactcaggaatatggaatcccagttttacatgtggtgatgtagactgacactgaattcccctctgttttcctcatatgcctatacaacatcatgtaggatcagatattccacaatggtgaattttctaacatcaattacacccgtggaagcatatgaaacaaaggtgtaatctagtagaccatgatgcatgaactgcaggagaagtagtgcttgctacatgagaaagcatttctcatttgttttcaccttaatcatgttcatgtttgcttttatattgtaattgacttttacttctgtttctaatgtattcaatagttcacggtgcactgaatattcttcagtagttgtgacatctaagttctctgctaatgggtagcaatgctttttggttttcagaaacaaggtgcaca

SEQ ID NO: 20081 - DNA, 784 bp, Oryza sativa
ctggttaacaactaaaatgtggaatggttggcctgggttggcatagaccgagttggacccaagggtcgggttgcaagttcggtctgtatcatcatcggcccttgggttaagccaggttcgtgtgggtacacggccttgattaatacaatttgtatagttataggatcgcgtttacaaaagagctttgagcaactaaatttctttaaatgctgattactgcaaccctaaccctttatattataactctcttgtactcccttgcatttattatgcacttgtgggtgtgtcttgttgagtacggtggttatactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgctgggccttcgctgcccgtgtaataattctatttacgcttccgcttgttaaactctgaattgtatcaactttcggtgtaccttgcctcctaggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgtcttgctgcttcatttatcgccaaaatctaacctttaaaatgttgtttttctttttgtttttgtttgtaga

SEQ ID NO: 20082 - DNA, 334 bp, Oryza sativa
caattcggtgcaatgcaccaagcgaatcagtcaagccagggggctccgacctggcaaccgataagtcaattcggcgcggcaatcaatcaaccaagtcaagggacaatagcctggtagcaagcactgagcttcgaacagaacaccatgacccaagcatcaacaactgatgtttatgggataatcaccggtttcggctccacacagcaagcgaaccagtcgaatcagggcgtggcctggatccaagcaccacagttcgacctaggcatggtgacacaggtagtttcagccaacatgcaaggagcactgttcagaaccggaccctagccgaaagcga

SEQ ID NO: 20083 - DNA, 1260 bp, Oryza sativa
ttgtgtcacatagttgtacagttcttgattggaaaagaagaattctccaacacatgtgtgggagattttgatgttactaatataattggttcaatacaatcttggcatatatttctcattgtgctactaacataattggtaaaatacagccatggtagcacctgtttggcccaattgcatgtgcatcttgtggagtactattttctcaaataggcatgattattttgcaatataaatgtgatcaaattgacgtcgtctaggtgtataatcatcgtctaggattcaggtgcatggtaagaccatctcaagtactgataaaaactatcctatatatttatatagttgatcccacctactgtagttattattgctaatttcatgtcctctcgtgcagccacatcatcacttttatcttcatcgttagatgaatctatatctttgatgtcagcagttggatagaattctctcccatgatacagtccggcaataaacaaccaattcatgagcagtcgagtgcgagccaccacagccgcaatacgcaagcgagcgcgaataccagtctccacaattccattaggcatggttgtggtgatagagcttctgcactggatgagaattgtaattggcagcgaagcccggccgtcaacctgtcctcctgcctcccctatcgaaactaccagacgaccactcgactttgataactacaagaggcatcgatcttttgttttaagagaagggtattttttttacctggcctctatatacaatcggatatatacggctttttaaattagaaacttagcctattaaataaggaacttagctctcaaataaccaaatttgaaattcgctactatggagatttgaactcaagaccttaggtgctactcatgtcactgcattgataggaacttagcctattaaacaaggcatcaatctgatccaacgagcattgctattacctcttaattttacttcctttcgattaatcttcctctcaccaccatactatattgctggagcctcccaagcacatcaacgacaagcgtgctcctcgctcataggacggcttcgcttttcctctcgctctgcatagcacaggatgcagagcagatccccacagcaaccctggtatacatgtttctctttgttctttgatcaaaataaaattgtcttttcctttttatttactctttgcagcaaacaatgttaacaacacccgctcatttcttttcagtttacactgtatgtttgttcgag

SEQ ID NO: 20084 - DNA, 1501 bp, Oryza sativa
aaaacggcttattagagaataaaaataaatttacatgtaaagcttttatatatgtgttctcggtgatttaaaagccaatgctaaaaaagaaactacgttgaaaatatctcaaaatcaatatcaaaattaagtttgaaaattcaaaatttggctttttctttggctgaataggccatccgatgagagcctttgtaatgtacatttgtacatcactgcaaataataccttggggaacattatacagtaattgaattattcaaaatgaaacctcagcaagtttttactgaaaagataattcaagcactctatggtggtttttaatgtcctgaagatgaagatgaagattaaatatttcacgcaaaacgaggttataataacatgtgattagttaagttttaattattctaaacttgaaaaatagattaatatgatattttagagcaactttcatatagaaagttttcacacgaaacccaccgtttagtagtttgaaaagcgtgccacgagtatccaaaatttaatccaaccttagttggagaaaagaatgcaattgtgaaatacaacctgcaaattgccatagcttgtaaatctacttatttagtagtagcaaatagtagcgtcagttatgctaagtaaaagtgacaagtctttctactgggactactgaagctaattagttatcagttatcaccaactatacatccttaattattgaggatataaaaaattgcacattgatcgattaacttaatataggtactgtcccaaccgaggaagagtgattcacagacaattgattgaatcggcaagttttgtcaacgagaacaataattaatttgaaattgagctaaacaatactgaaacttaatccgaaggaatttctatgaaattttgaggtctaactcaaactaaaaaagttggcgggcgaggagcatacatatacctgaacaaacatacatatactgaaaagagtgagcttgtttggttacacccagtcggtgcatatatatactcgaacaaacatacagtgtaaactgaaaagaaatgagcgggtgttgttaacattgtttgctgcaaagagtaaataaaaaggaaaagacaattttattttgatcaaagaacaaagagaaacatgtataccagggttgctgtggggatctgctctgcatcctgtgctatgcagagcgagaggaaaagcgaagccgtcctatgagcgaggagcacgcttgtcgttgatgtgcttgggaggctccagcaatatagtatggtggtgagaggaagattaatcgaaaggaagtaaaattaagaggtaatagcaatgctcgttggatcagattgatgccttgtttaataggctaagttcctatcaatgcagtgacatgagtagcacctaaggtcttgagttcaaatctccatagtagcgaatttcaaatttggttatttgagagctaagttccttatttaataggctaagtttctaatttaaaaagccgtatatatc

SEQ ID NO: 20085 - DNA, 155 bp, Oryza sativa
cctgcacccctttgctttacatgcattaagaatttgctgtagttgagtaaaatatgatctttcaatattgcacattactatcaaatttatgtaagcacatgcctgctgcccttcttctatgctcaggacaaagttttcatatgaaatattacaac

SEQ ID NO: 20086 - DNA, 1501 bp, Oryza sativa
agaagagtataaagttcatataggagtttagaattaactaaaattcggaataaaaataataaagttaaaagtagagtttagaatccatatacaaatacaatttacaaacaacaaaaattttaaattaaaaaaatgggaagaagaatctagagtccaaataggaatacaatttagaagtaactgtaattcgaaattaaaaataaagaatatcgaaagatctgtttaaagtccacgtataaatacaattagaaattttcaaaattcggaattaaatataaataatattggaagaagagtatagagtttatatagaaatacaatttacaaataacgaaaattcagaattaaaataatggaagacaagtctagtgtccatataggaatacaatttagaaataactaaaatttgatattaaaaataattataactatcatgtatgtacaatagtatgaatattacatattggtagtttggtaaagttagtacaaaatttaaaattatgttttcattttaatatattttaataataaattgagaaatatatatgctattataatgatgctagccgcgcaatctgcgtgggctgccatgctagttactaatagtgtagaagtatcgaattggagttctagctataatataatatagtttaaaagagcacttattttttaagaaacacagtacaaaagagcacttagactgagcgtcagatctaaacaactctcaggatataaaagcatagcattcaagcgccttagcccacccagtgaaaggtgttatttttcatgtttttagagtgtcacaaaactaataagacattaaacatgtatttggtttaagaatgaggtggctatttttttgatgggatggtcaaattatctgtttggtatgagatggagtggtcttattattttgagggataggaaaggcccgtatctcagtgaaagaaagtgggtgggattggtccagtaaaactgactctggtcttagggaatattctccttcagagttcaatccatctcatatatcctcaaaccgaacaccctaaataatgggtttgaaccaacccgaccaattccatacattgaaccaaacagatgtttaattgatgattgaaatagcacatgaaatttattgttttatttttaatattgcatacgcaatacatgcaagagaccaagctatattgaaaacatcgggcatatggtttcatcaagattaaacccatttcatctcttacttcattattaatttcttaccacatcatgaaaaatgttgacatgatacaatatttaatacggaataagaatgaaactcccattattgggagtggctttagcgttattgacttcagtcatgctgtctcacaagcttttggttcatacaaaatcgtgaagcacatctgctccctctatcctaaataaaacaaagtctcgctttgcataggaactttagtgataaaaaggactataggtacataagggcattgaataggtacaa

SEQ ID NO: 20087 - DNA, 1501 bp, Oryza sativa
agtcactgttaagagatgaaaaaatgttttgcaaaacttttacaactcatgcaaaattttagcatccacataatggagatatgaatcataaatgaggtagaataatctctcttgttggagattttgatgagctcccactgattttattatttatgcaatggaatcataatatatgattttccatcaacttgaatcacatgatttaaatttaattttacttagtaaattatcatctaagtaatgatcgatgtaaaaaatttctaggaatgaagtgtctctatcttaatgagacatctattatccactagaaatgtggctgaataacaaggccataatttcgagaacgtctcataatgattcaacctaaaaataatgccattaattttcttttgtaatactttgtcaaaccaggacattaagcatgtccctatttcttgcaaaaaaaacatacataagaaaaaaaatcaagatatgtatacgtaagatatagaggcaattttatttccccttataaggaatatatgagctttattatcattaaatttggagttgctactctctctctctctctctctctctccttagtaaagtttatctttgccatcaaatacatgatcttacttagcttgcttcttagtattttgtatttcttattgatatacaaagtgataaaacaagtcaattatgctccactttgtctcactgaatattacaattctgaaaaatgatcgtagtttagtaggagaaaggtcatatgaactgggcaagtggcgtatttaaaatgtgcgatgtctttctctaacctttttaatgacttatcattggtattgatgaactcctaaagtttgcaaaaacatttgctagatacagtttcgcattgtcaagcacaaaattatcctctaatattggcaaagatgataatcttaatatatattaatatatattagtgatatgcgaaacataactctatattggccttctcccaggataatttcatcaaaatgcctctggaatttaggaaaagcattgacattagccacgaaagcaacaagggatcctttgttaatgttaagtcatactaagaaggccttaggctcagctaaatcaatgagagaaataactcaatagacttaaattgataaataatattagctaaatttgtatcgtcttatatcctatttttaggcagttcacaaatggtgaaatttaacatggaaatgacctcaccttgtgttacggagaagaccacaattaattaccactgctaagctccatcctccatgctctcatcctcctcccatggcggatttgcaaaaacaccaaaccattgccattgcttccttcaaaaatggctcctccacacctccatttcctcctcgtctctcacccattaacgacatgggctctccacgttcagccatggccgccgtgaacatacactaatccggccgtcgcctccaccagctgccggtggcggcgccgccgggcgccggtgtcaaga

SEQ ID NO: 20088 - DNA, 1501 bp, Oryza sativa
ttttaaataagacgaacgatcaaaagttggacacggaaacccaggtttattattttttttttttggacggagggagtactatacactatcaacgcagtcacatcagtgatgtcacacggctgaatttgcacaccatgaacatgggcggctctatagccatatccacatagaaaatgcccttttatcatgcatgtccacacatgggtctatttagtgttcttttcgtagaagtgattcaaacaacgaaatgaaacacatggttaggcacacttcggtacgattctctcaagaaaacaaggaagataatatgtaagaactatgaagtttggtattgctccaagtcaatcttcagcaaccggcctatgcataatgcatgcacctgccgaatattatatccctgtgctgcctaatactaccaacgaacaatgctgaattttgagtcgtgtaaagttctgacattttgttcctggtcaatgattctgtcatgaagcaatggctttaagggactcaaagaaacaaaagtaggctcaaccacacctaatgcctacagaaactagaatgcaagaaatgatgtggcgtgtgtggctgttgtgcatgttcagatgttgttatggaactattggacaggctagagcagctaatatcactctcaattcagagattgaaagcaattgttgtcagaaatgcttgtaggttgagacatagtaaagctagctagtttcaagcctgaattctctgccagagacttgcagtatgaaagttgtatctggtctttgcatggtccagttgctcttagacattcagatcatggtgaatatgtcagtatcgtggctatagtgcagtctagatacgtggagatgtaacaaccaaaacgtattaaattctacttcttcaagaagagcgtacgggcagttgagtctcaagatcaactttgaacagcaggatcaaggctatgtgcagtaaactagtaaagttccatgctaattttctgctttagaaaaaggtttacatgttaattaacttgaacttgttggaacagcgtagatcatgacaagtttaaaaactaaccgaattctcagcatatacgtttccagagaaggaaagcaggataactcagccaaatgtgccaagttgatcaagaagatcagagcgcggcgtttccttttacagttctactcattgcaagaaccagtaactattcttcgctcatgtttggtccatgctttacttatgacaaaattacgcaaagcgtaattcccactcggatttaatttcagaacaagatcggtttcaacttcatttctctactgtatctctaccctgagaagttgcacttcatttctcagatcgattcacagaacgaaggtgatgctcaaaaaacaggttggcatccgaagcatgaactgaaagtctgaaactgaataacggatggctcaagcaaatcgcaaattcgcaacacacgggaagatatactactgacctgtgtgctcccctggcgagc

SEQ ID NO: 20089 - DNA, 187 bp, Oryza sativa
ccccattttatattggaatttaacaaattaaaattagatcttcttttctaggcttttaaaatcatttctaataattccttttagacaacaatttataatttaaggatttttaaacaagaaaagaacttaacaattattattagatcattaatgattaattactgaactgttctttgtatcatttagg

SEQ ID NO: 20090 - DNA, 1501 bp, Oryza sativa
tgacacacgtagcacttacaaggaatacagaagataaggcccatgccatcaacaattattttcagggaagtaaatgtaaggatgaacataagctttctgcctacagatatatctgataggtaaagctagctttgcacaatgcactaagtatctaccaactgtaaatttctgcagacatgcttctctctgattcacgcagtccttaggtaaaactggatgctacatgcacacctgagaatacatgaaaacaaaccaacaaagcttttaacagacttaacagttgaggcactgaataagttgcagttcatggtgtgatgaatttttttggttgaatcatctaatgggtccttcatttttgaatggtcccttattgcctaattcacttcattggtacctctccaaataccagttcaagaaattcccactttgacagcgggtacttaacctgctagcacaatggtagaatattctgttctatacaaatgccaaaaagaagggatggatattcagggtaacagaatcgtctgaagaacaagttctcgacgaacatggcatgagttaaatatttgcggctcacacttatcacccacagcaaatgtctgtcattccttcctttccacttataacttaaatctacaaaatgatccgtaaattgccctcatcgtaaatgataagcagatagccgcgtcaattcaacgcatttgtaccttccattgcttccacccgctttgttccattcttaaggcacagtcgcacagatactaaagtactggaagagtgagcaactgggcaaaggaattctccaaatgtgtgtgagaccataccgcatccggaattccggatagtccatttgaactgcctgcctgactacgctacccattttttccccaatatagtcgcaagttggttcgattgtccacatgaataaacgtcgcaacttgcaacgtacaagcaaactaggaaggaaaaaacatgaaagcacaagatggaaaggggataccgaccagtcggaggagaggaaatcgggcacgtccgaggcggaggcggagactcggaaccgggaagccgccgccgccgccggcggcatcagggccaggagcgtcgatctgagacctccgccgccgcagcggcagattggggctggcagtagagcgacgggtttcgcggccgtgggagcggacgacgccatggctgccattactccgatttccgtctctttccgctgcttcgtttctgtctccggtttattcaggcccggaaaatttcacgccgctgaactgaactgacgcgtagaaaatcctgaattttcctctcgcgtccaaaaaagagagttaactttccttgagccaaagttttatttcggattatttttttaatcattttactttgtactagatagcttttttatttgttacacaacggatcatctcaaaccacatctttaccacttatgtcggcgaactttcatatgtatatgcatgtcatatatttatgaaaggag

SEQ ID NO: 20091 - DNA, 548 bp, Oryza sativa
cgcatagattccggctctcccgacgctctggtgtacttcgaaatagtcgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccctctagctgacgcatccaggcaagggtgggcgtga

SEQ ID NO: 20092 - DNA, 1501 bp, Oryza sativa
gtacctcattctccagcatggtgagaaacaactccaaccctgcctcacactcatgattctcaaaatgcccagctatcatcgcattccatgatatgcagtctgtcacggccattccatcaaacaccttcctcgccgccacaatatccccacattttgcatacatggtcaccagagcattcaatacatcgacctcgtctccaaaaccaaatcgaagcacatgagcatgcacctccctccccatcctccagtcagggatgcccccgcaggtacgcagcacgcaggggaacgtgtagacatccggcctcatccctgcccacagcatcctgtagtacaggtccagcgcctcctcgaggaagcccaccttgccgtacccgcctaccatgacgttccaggagaagacgtccctctcaggcattttggcgaacaccctccacgcgtgccatatctccccgaacctgacgagcatgctgagcatagcgttcccgaggcggagcccgaagctcgggtgctcggcgtcggcgcgcgcgcacgcccgcatcccggcgtcgaccgcgcggcgccactcgcagagccggaacagcgcgacgtatgcgccctcgtcgggcggctccggggaggactcgaggagccagagcgcctgcgccagctggccatggctacaaagcgcccgcagcgcggcgctccggtcagagtaggtggcctccgcggaggcggcggcacgcggcggcggcggcgccgctgcggagccgactccgcggggacgcttccgcggcgggaggtggccgtgcgccggcgtgagcgggagcggctgcggcgcgcggtgggaggcgaggaggtggaggaggggagggttcgggtgggttctagctggcggtggcggcatcgcgggaggcggccacgagcatggcggtgagagacgcgggggtttaggagaggtttggcgcctcggtggccacctgatccgggagcgcgaatggatagagctcgcctcgcctcgacgcggttgggaagtgaggagagcaacgaaattaaccgtcctagtacgtaaatgggcctcaattgggctggagattaaggcccaggtagaatttttttagtgaattgcactttggacatttttattgataaagtttcagtttggacaatcttataccaaatatttttactttggaccacataattttatactccatccgtttctaaatatttgacacgattaaattttagcatatgtttgaccgttcgtcttattataaacttttgcaaaatatgtaaaactatattatacatataagtatatttaacaatgaatcaaatatttaacaataaatcaaatgatagaataaatattaataattacttaattttttgaataagacaaacggtcaaacatatttaaaaaaatcaacggcgtcaaatatttagaaacaggggaagcatttgttatgtaatggaccactttaactatattcgctagatatatttagcgtctcctttcata

SEQ ID NO: 20093 - DNA, 1501 bp, Oryza sativa
tcttaaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcatcttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgccatttctgtactgatagtttgaattacagattcttcacttgacatatcatctccagcttctctctaagctgaaaaataaaagcttctggatattctagcaatctggcaaagttgtcacctacacaaagagaacaatgactgatggaccttagatcaccacaaacctaatcccatgttaccttgcagagggtttatcagtctagaattcactacaggataaaaaaaatcaactccccataacattacaaagagtaactgcagaggttagcgaagatccacctattcagtgaaattcagacaagcacatatcgatagaggcacgatgaacaagaccagacgaacaaataacatatgcaacgaggaaacaaaccaagaacagacaaaggcaagc

SEQ ID NO: 20094 - DNA, 842 bp, Oryza sativa
ttttttagaaccctgtgatgtaattttttttaagagtttgtgatgtatttggagatgatttgtttgaggatttgaggatttggagatgttctgtgatatgtgatgatttcgatatgggaggggatggtgtgaaatcaatattcaatattaaaagcagaaaaaaaaaaagaaaaaaactttagtcccggttggtaacaccaaccgggattgatttttagtcccggttatttgaaccaggactaaagatagcgatctttagtcccggattcgtagtcccggttggaaaaccggaactaaggggggttacgaaccgggactaaaaagcatttctccaccagtgcgtcttattcaaaaaatttaagtaattattgattcttttcctatcatatgatttatttttaaatatacttttatgtatacatatagttttacatatttcacaaaagttttttcataagacgaacggtcaaacatgtttaaaaatgtcaacggcgtcaaatatttagggacggaggaagtatatgccattatgtcagcagaaatgcaatctgtcactgcgtgaaaattgaataaattgttgctgtacatgccactagctctaccagttgggcccattttttatagcatcccaattactagtcatttttatttatccagttaaaaatctgacaggtgagaattgaattgactgaagagtctcaattaatcaactgtagttcagattctcatatatagtttcactgtttaagtgtggtcactcctgtagctggacctttctgaataatgtataggccgagcagtatatggatcatctgagttaatctgtctgtcattgcaatagg

SEQ ID NO: 20095 - DNA, 1501 bp, Oryza sativa
ctctttgatgatctgaaacttttctcgtgatctgtgactccctgcagatagacaggcatgtcatcagcgattgagatgctgtgaatccttggacacggtacgaattgtttgttcacacaggtttcttgagttcctgtttcaatatcactgtcactgagcttggctgtcatcaagagatcgacaagttttcatgtgtgagctgcagcctgcagaagtgcaagcattgcactgcagaaggctttgcattcgtgctcgtcttcacttgtttgtgtccgaggcgagagagatagcagcagcaggtgcgtgtgatgtggagtcagctttttttccgcaggagcatcaaaagaatacgacatatggtgaacgccatcattttttgtccaaaaacaccaggattttgcatcgatcgtgtgggggcaggatgtgctgctgctcatttggtcagaatgccggaggacaaatgcaggcaggacagatacagttgcccttgatttgggagttctaatcatctcattaactaccattgttaagatcactgacggcgtatttattatactagtacctgcattttttaatggaaccatatgcgagtgtcattaagaagttggagaatggatagcactagcagtagcagcagagcaagtcagggtttgtggacctgatgatagcatcttgctccagtggacacgattattgagatgtacatatgtacaactgagaatatgattagcgcacaagatcggcgatgcaaatgaaatgatgttttagcgaaattcgtttggcgttcagctgctgcaaagtgcaaactgcttttccatctgaaccatcaaaaaaaaattcagatattcagatagccaccgttgctattcaatctgctcacaacgttctaacaatgtttcaatatacaatcgacaataatcgaaaggatcacgtgaaatcggcaccgagagagcgtgtcgaccgaccgctcaaaatctcaaaatcccaaacacaaactagacggtgaatgaacgggaggagccaacggttttctccctcgcattcatggaagtcccatttattactcctacgctgtatcgacgctgaaaatgcttactactgctctactcccggtccctcggttaaaaaaaaaaaacttaacttgtacaccctctatttagatctgttccgtatttttacgacagagggagttctagatttttaaaacaaaaatctgtataaaccgtcagacatttactagtgcttggagcagtaacccaagctaagttgttcttcaaagctgacactggtgtagcaaaagccatggcacccttgtctcaaaaaaaaaagccatggcacctgggtgcagagctccttggcccacaggcactgacatgtgggtccccatggggtgaaaggctaccttgtcctctgctggttgtcttgtactacagtactattctggtgctacgagcaatatacgggcatgtaaggcagtaccaatgtactacgactactccga

SEQ ID NO: 20096 - DNA, 1501 bp, Oryza sativa
attagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgtaattggaaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtg

SEQ ID NO: 20097 - DNA, 1501 bp, Oryza sativa
agaacaacaagaacttcagagttatgatgttttgtttgcatggtttcacaaatagaatcgtgtcgtctgcatattgcaggtgagtgatacccccttcaatcagattaggagataaacccacgagaaccccagctttcttggctgactcaagaatcagatctaatgcatcaccaactaagttaaagaggattggtgataacggatctccttgtctcagacctctatatgttctaaaaaactccccttgttctccattaatgttgattgccactttaccaccttcaacagcatttctcacccacccaataaatttttctccaaaatttttcttcctcatgacttcaaacaaaaaaggccattgcactctatcgtaggctttctcgaaatctatcttaaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcatcttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgcc

SEQ ID NO: 20098 - DNA, 422 bp, Oryza sativa
cggagatcgaagacgatgcagccccgcgtcgggtgccaagttccgccggaacgtaaaacaaaagttgaagtaaaaaaggtgccgatgcgcggcattgtattgatcgtgaggacagattacatagaccccaagtgtacatatttatatccatgggtggatataagtccttgtcggacaagaaagaacctttcctaaagataaaaggaaaagataaagtccttataggacactaaacacactttcctaaagataaaaggaaactaacaaactattcctaattaatagataacttaccatgccgtattctctttaaactcggtctcttctggataagcttcctttagtagatcaatttccttaaccgaatatagcaagaatccgacaactgacgacttgacaactctcatcggctaatctcaaga

SEQ ID NO: 20099 - DNA, 1501 bp, Oryza sativa
taaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcatcttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgccatttctgtactgatagtttgaattacagattcttcacttgacatatcatctccagcttctctctaagctgaaaaataaaagcttctggatattctagcaatctggcaaagttgtcacctacacaaagagaacaatgactgatggaccttagatcaccacaaacctaatcccatgttaccttgcagagggtttatcagtctagaattcactacaggataaaaaaaatcaactccccataacattacaaagagtaactgcagaggttagcgaagatccacctattcagtgaaattcagacaagcacatatcgatagaggcacgatgaacaagaccagacgaacaaataacatatgcaacgaggaaacaaaccaagaacagacaaaggcaagctga

SEQ ID NO: 20100 - DNA, 1501 bp, Oryza sativa
gtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccggcgccgctcacccagccgcgcccgcagccacctccgctcgctcagccgcgcccgccgccaccgctcgccccgccgatgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatat

SEQ ID NO: 20101 - DNA, 1501 bp, Oryza sativa
caagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaagaaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttgaacctgcaaattcggcgcaaatttctaatcatgatgtaatataattagctgatctcagctcactcccaggtagcctttatcgatctacatgatgctatgcatgctggcgcctatataaaccatgcatggcctctgcttcttcttcactcatccacacatagtaaggaggaggggcaatagagtttgctaattgctaggattgattcaagcaatggcatcagtagtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaat

SEQ ID NO: 20102 - DNA, 388 bp, Oryza sativa
cgccggcgacggggacgcagaggttggtgggctttttgggtttgagcctttcaggtggagatggagaggccgtggataacagggatttggactggaagttacgttgcttgatgggccttataaattgggcctaaataaaacatgggtctatttgtgcagcgcgtttcaatttgggaaaaagtacaccgaaggtctctcaacttatcatcgagttacaaaatcgtccttaatcgcaaaactagatacaacgcatccctcaacttacagaaccagtgtaaactcagcgtagacctacgcgggtcccacatgtcagcctcttttttccctcccctctccacctttcttcctctctcctctctcatcccctctcttctgtgtatctaccaga

SEQ ID NO: 20103 - DNA, 1501 bp, Oryza sativa
cacttctgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgtttacctctatgccaagaaagtagtgtaagtcacctagatcctttaaggcaaaatccttttgtaggtcctttagcagagctggaactgcatcctgtctcgagctagcaacaattatgtcatcaacataaacaagcacaaaaattattagaccccctttattataaaagaatagagaagtatctgccttggatccttggaatccaaggtgttgaagcttctgacttaacttagcataccatgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagagg

SEQ ID NO: 20104 - DNA, 1501 bp, Oryza sativa
agtcacctagatcctttaaggcaaaatccttttgtaggtcctttagcagagctggaactgcatcctgtctcgagctagcaacaattatgtcatcaacataaacaagcacaaaaattattagaccccctttattataaaagaatagagaagtatctgccttggatccttggaatccaaggtgttgaagcttctgacttaacttagcataccatgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgata

SEQ ID NO: 20105 - DNA, 223 bp, Oryza sativa
tctgtttgtatcttattaaaaaatagaattattacttattttatttgtgacttgctttattatcaaaagtaatttaaacgtgacttataattttttatatttgcattaatttttttaataaaatgagtggtgaaacattacatgaaaaaagtcaaagcgaccattaatttagaacggaggtagtactaggctatgtccaacggggcgcgcgtgtgtgtgacaa

SEQ ID NO: 20106 - DNA, 1501 bp, Oryza sativa
atgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttct

SEQ ID NO: 20107 - DNA, 1501 bp, Oryza sativa
aggcggagatcgagttcggaaacagagcaagaatcggctggagtccagatcggctacgattaggatcggctgggtctgagtcagactaggtaagccggtacagccgattccgacaatgcaacttgatgtatgatattgggttgaattgaggcgcttcaaggtgattgccgcacatggatagagtcctgagaaggcaattgtatctattaattaggatgttttatgtaatctccttagagatacgcttgggcaaaagtctgccgcaaagacatatggtatcttagagtttgttagagatagtagtcatgtccgttatggacatatcttgtaattctcgggtataaatagacccgagccctatgtaacttttaacacacatgttcaatacaatttcggcgcatcgccacccttttgctttagttttgtttcgacgagttcttactttcaggttgagctgcatcggtttcgatcttcaacaagaggtaaaacttgttatgacggcttgtattctcgggattagtgctttcatctttatgacactctaatcttgtttatgtaattcgtcgagttatcatatatcttacataatctctggcaatatcgctatctaacctacaatcggctaagatctatcgaagagggcagccgattaggttagattttgacgttgattcagattatataagatatctaccactctatgaaacttccagcggcttgattttctagatattgttcttcttttcatatttaatgctgcatcagttgagtttgatctattaagtcgtgcttagaatatcaatctctagcctgccttctggttgccgattagggtagcatcagagtttcagccgatcttatctgatttaactatatttgctctatatgcttcattgacatgttaaatatgccctttatgtcaagatattgttgtatctaagtacattaggcctttgtttgatatattatacctgttttaatatcctgatatagagtagtatcggagtattagccgatacatgctagatctatctaatcggctatgctataaacatacatagtcctattattaatatatatttcgatctaagtgatttatactgtctcggcatagtgaccgatctatcccaatcacttgatttaagtatatatcgatataagaactatatattggaaatatctacagccgatcgaatagatttagttctttattgtctatttacaactgccgatcgattcacatatgacatcggctcaaagataaatggtatgtcatcggcacctagtcgatcaactatcatttatagatttaaccgcggtttgtttgcttctatttcttgttgattacaggatcaaatcaactggcacgctcatacattcgaaggcgagctttggacctgcactggagttaagcagatctcccacgcttcgtgttttctgtcaacacgcttttggcacgcctggtgggacatttaagaagtcagccaacaattcttcttca

SEQ ID NO: 20108 - DNA, 1501 bp, Oryza sativa
tatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttcctt

SEQ ID NO: 20109 - DNA, 470 bp, Oryza sativa
gtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaat

SEQ ID NO: 20110 - DNA, 1501 bp, Oryza sativa
ttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcg

SEQ ID NO: 20111 - DNA, 1501 bp, Oryza sativa
tcgcacgagagagaggccggctgggctgacgacccaaaggaaggaggagaagaagagagcggccagtggagggggaaggagacttgggccgagcccaagggagggaggggagaagatttaattcgttttctttttatataaatgagtttaatgaactttgtgactttaaaattattttttgagctccaaaaattcatggaaattattttttgagctccaaaaattcatggaaaaatccggagggtattttagggcacaaagaatattacaaaatatcctcagccaatgatttttaaggaaaaattttaattctcccattatttcacttaattaaattgctttaactttaatttaatttctagaaaatgcattattaatgatttttaatcccgaacgaaaatcgggacgttacaccacgcaagccaggacacgactacacagttaccggtcgctagtttggttaaagcaacgaccactctatctcacatatgaatcctctttagctaaaaaaaacaatagtgcacatttttctaaacctctttgataacttttatcttttaaactgtatattattttaaaaatatatttgcaccattgtactccactcaaaatatatgacaaaacgagaccaacggttaatatattcaaacattttattaatttgaaagtaatttatatttacattgcagaagtaacttagctatataatagaagtaattctctttagcactaaaagtaattacattatgactgagttgaaataaaaaaaatatgtggaataaatttacaagcaaagtgtagaaaagattttcaagtaaatacatatattcgttatttaaagtaatcactgtgttatattttttaaaaaattaaaatatggcgtcatatagaaagtaactctttatgataatattaaaagtaactacactgctggaggaaagtaactttttaaaaatatggaagtaacacttctaacggtatgttgctacggatcttacaaataatatgcagtctaaaacatataagttatcaaagattttgtaccaaaaataaaatgtattagtgtaatggtattaacctcatagcatgcatgcgaatcgacatgacatgtagcaaatagcatatggtcctttttttcttgcaagtggtcttgtttttcaactaatcggacgacttacgaaagggcctcttgataaaaccaaatagagagcgcgtactgaatatattttaccatactttaaggatctaattaagtagtgccacttacaatactagtactcaagcattacaatactagtactcaagcattactagtactcaagggaatctgggacggaggaattataatatgaggaagagcatgacaacttgcagaacaggctggatgatggatgggatcggctgctatataagtacatgcccgggggacataggcgagtgtgctagctactccagctgattcaaaccaagctaggaaaaagaaagaaacgagttaatacta

SEQ ID NO: 20112 - DNA, 1501 bp, Oryza sativa
ctttttaggagttggtacaatgcatcttaaaaggtgtcaaacagtaaagctttatatagctgtcccgctgacttttttatataagtcaaggtgctgtttgggtttttaagcaattgattggatacaatatcattgcttttcgccacgtaagtgtgcctttttattgaccaatattatggcttaggctgattatatattgtggtcattttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttgggaatttatttattcacaacatacaagcttctttatagctgttttgctatgtgaattttcaataatgtagccaactttaggttacattcatcatattttacaaaacagtcggtatatcacttggatcatattattcagggattcacaccgcatatgctacatattaatattaagtcgcttggttgactataattatcaaaaccactcggttggttggattatttattctttgactatatgtttggtttgttcgattaaccacatagtcgggggttacacctattaggtgcatctagtcgatgcacttgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaatggcctaaagtcctgatttaggaaacagataccgtattggttaaggtttctatcttgtaatcctgccccccatcctatataaggtgggcaggaggccctctagggggcatatatgagacaacctgatcgtcagatctatactacacccggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacaggtattacgcttcatagcggcccgaacctgtataacttggctgtgtgcaagctagctaggggccttggatacggatacacgatttccagaggcgagcttcttcccccagccgaactcacaaaaggggggtctcacgatctcccgctagagaggatcactcctcgacagctggcgcgccaggtagggggaggtcgcgcgctttaaagagaagtcgtttccttccgccccaagtttccctcggccctcgacaatcatagtcgaggtcc

SEQ ID NO: 20113 - DNA, 1501 bp, Oryza sativa
tggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagcatctccttcatggcctg

SEQ ID NO: 20114 - DNA, 1501 bp, Oryza sativa
agcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaactgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctgatatgtctgcagcccatattttcaggtgtggcctgtcacgttcttttagggacttaggcactttttgcttaggccaaagtgcgcgtgatcaagtgcccaataccttaaaatccttttataccgcaattacttaactttttaggagttggtacaatgcatcttaaaaggtgtcaaacagtaaagctttatatagctgtcccgctgacttttttatataagtcaaggtgctgtttgggtttttaagcaattgattggatacaatatcattgcttttcgccacgtaagtgtgcctttttattgaccaatattatggcttaggctgattatatattgtggtcattttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttgggaatttatttattcacaacatacaagcttctttatagctgttttgctatgtgaattttcaataatgtagccaactttaggttacattcatcatattttacaaaacagtcggtatatcacttggatcatattattcagggattcacaccgcatatgctacatattaatattaagtcgcttggttgactataattatcaaaaccactcggttggttggattatttattctttgactatatgtttggtttgttcgattaaccacatagtcgggggttacacctattaggtgcatctagtcgatgcacttgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttcctt

SEQ ID NO: 20115 - DNA, 1501 bp, Oryza sativa
tcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcaggtagtttcccttgctcaacttctccgtgaccgtgattcctccgagggaacctgaggccgaagactgggacgaacttgccattgatagattggattgaaaggagtttgtggtgctctgataccatgaaaggaaacagaggtgcaagaagcggtgtcgtcaccgatcttggtgcgcccgcgtatatttatatggttgccaatagccggcaacatggctttacaggatcataacaaccttggctaatatctctctaactaatcctgattacaatcattatctatcagctaagataagatcgatacggccaggttgttatgcttacacatgattatatctaataggagtgattcttgagattaaacatgtagttttgagctgttttcattccttctctgttagctactcgccccgaagttgtaataaggtggcgcatgagcttgccgcgtatggctgtaatctccagaccgtgtcttcctgggcaggctgccctcctagtctgtaacggctagtatccagcgattctgctggtttggtaatataaatatctcggtttctcaaaaaaaaaagagacctggtcgttgagacccatttaatatgcacgtagatcggtcaagctagggcacttgcactagtgggaacacggaatagcgcatgtttgacgtggagcggcatgtgcgacttgggttcagacatgttagttgggagcgatggagcgctagatgcggggaaggtgacatcaacacttatcccgttgaaacggaatcccgttgtctagccgttctcttacactaatatgtactattccgtccaaaaaaaagataacttctagcaatgaaccaagacacacatgtgtccaggtggggggggggggggttaatcctgatcctgtccaacgttggatgtgtggtcgttttcagtggtcagaaacagttggaatgtgctactctctctgtcttttatccttgttacccgtactggaatcaataactcctcctgaataagtaaaacccctatgataatatcaacctctgttggatgcttgattccattgatatcaatatctgttggagcattgatttcgttgatttatttatgcccatgctgcacgtacgcttgagagcgatggataggtagtaagcgattttcattcgccattgagaggaaacggacatt

SEQ ID NO: 20116 - DNA, 1501 bp, Oryza sativa
tcgccggcggcggaagccaaaagcagcaggctggcaagtagccagcatgtggccatcgacgtgtatacgtttatatacgacgtagtagtattaactcgtttctttctttttcctagcttggtttgaatcagctggagtagctagcacactcgcctatgtcccccgggcatgtacttatatagcagccgatcccatccatcatccagcctgttctgcaagttgtcatgctcttcctcatattataattcctccgtcccagattcccttgagtactagtaatgcttgagtactagtattgtaatgcttgagtactagtattgtaagtggcactacttaattagatccttaaagtatggtaaaatatattcagtacgcgctctctatttggttttatcaagaggccctttcgtaagtcgtccgattagttgaaaaacaagaccacttgcaagaaaaaaaggaccatatgctatttgctacatgtcatgtcgattcgcatgcatgctatgaggttaataccattacactaatacattttatttttggtacaaaatctttgataacttatatgttttagactgcatattatttgtaagatccgtagcaacataccgttagaagtgttacttccatatttttaaaaagttactttcctccagcagtgtagttacttttaatattatcataaagagttactttctatatgacgccatattttaattttttaaaaaatataacacagtgattactttaaataacgaatatatgtatttacttgaaaatcttttctacactttgcttgtaaatttattccacatattttttttatttcaactcagtcataatgtaattacttttagtgctaaagagaattacttctattatatagctaagttacttctgcaatgtaaatataaattactttcaaattaataaaatgtttgaatatattaaccgttggtctcgttttgtcatatattttgagtggagtacaatggtgcaaatatatttttaaaataatatacagtttaaaagataaaagttatcaaagaggtttagaaaaatgtgcactattgttttttttagctaaagaggattcatatgtgagatagagtggtcgttgctttaaccaaactagcgaccggtaactgtgtagtcgtgtcctggcttgcgtggtgtaacgtcccgattttcgttcgggattaaaaatcattaataatgcattttctagaaattaaattaaagttaaagcaatttaattaagtgaaataatgggagaattaaaatttttccttaaaaatcattggctgaggatattttgtaatattctttgtgccctaaaataccctccggatttttccatgaatttttggagctcaaaaaataatttccatgaatttttggagctcaaaaaataattttaaagtcacaaagttcattaaactcatttatataaaaagaaaacgaattaaatcttctcccctccctcccttgggctcggccc

SEQ ID NO: 20117 - DNA, 1501 bp, Oryza sativa
ttgcccctcctatcacgccgcttagagcgggggacagactcgggggtagccgcagccaccgcgccggtgccgggggaattccaggcccatgcctcctccttccgagccaccttgtccgccagctggaagagctcggcggtggtcttggtctccttggagacaatcttctctagcatgcggttatgccgcacgccattctgaaacgcataaacgaccgcgtgggccggaatgcatggagtagtgttgccgacctggcagaagcgctatatgtacgagtggagggactcgtcgtccttccgctgcacagcgtgcaggtccgcctcttccccatgcgggcagctcggcgcttgtcccggcgtcgctcgatattgattcgagcgtcctgctccccgtagaggccatcatgacacctctgacttcccgaggcccccgacgatgttggagccgtggaccgccttgaggccgtggctgatcgacgggccctcctccttgccgacgaggagagggtaatggaagtacgcgacgtaccggtgatggcgggtcggccgcccgcggccagctgccgctgggcagtggtgaccaagttggccacatcatccaaccagcgctggacaggggtctccggctccaggttcacggggtgatgccgcagaagggcacccgccgcttgaagcgcgcctcggggtgagccgccgtcaccataagtgaggtggcgccgtgccccgacgcgttgtggcctccctccgcccgggggcggggagagggccgaaccatctgaccgagtggggtcctccctccgcgagggatcgtggcggggaggagttggagagttgtggcggcggtgacgagggccgcggctctcgctagcatcctcactcccagacggagtgggggtgtacaccaccgcctcctcctccaggacctcgactatgattgtcgagggccgagggaaacttggggcggaaggaaacgacttctctttaaagcgcgcgacctccccctacctggcgcgccagctgtcgaggagtgatcctctctagcgggagatcgtgagaccccccttttgtgagttcggctgggggaagaagctcgcctctggaaatcgtgtatccgtatccaaggcccctagctagcttgcacacagccaagttatacaggttcgggccgctatgaagcgtaatacctgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatatatgccccctagagggcctcctgcccaccttatataggatggggggcaggattacaagatagaaaccttaaccaatacggtatctgtttcctaaatcaggactttaggccattccgtaatatacaaggaaacgt

SEQ ID NO: 20118 - DNA, 1501 bp, Oryza sativa
atagggtttcatttgcaaaagcagcatttagcaaacatttgagtatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggtcggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgagaactatcaataagccatcatgaaataatagtgagtcattagttatcccataagtgtactaatgtttctaagcagggctaagcaattgtatctaatatctagttgaaccaatataaataaagctcaactagtcaaattataataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagatatgaatttttaaagattaaaccggattaaaacacttaaatcggtttaaaattgaattatgacgcaataatgaattatttttgaaaaggaaaaggggatttattgcgtcagcgggctagggtttgggtggaccggcgcacgggcggcggttcacacgaacggacggccgagatttaaccgatccaagatggacggccgagatcgatcgggtccacggcggctcacgggagaggactcgga

SEQ ID NO: 20119 - DNA, 1501 bp, Oryza sativa
agcaatttcagtgcttgtcctacttgttcttgcttgttcttcgattgcttgcaggacgagtgccctcgtggccgggttgacgcgcaccacaagttcgtggcgaccattggagacagtgtatcggttgctaaggcgcagcgtctttggacagttgtagtcgggccgtgaacgtcgacttcatctaatcgagttatcccttacctctcatcgaaagatcgggccacaaaccctagcgggtttgcatcaggtggtatcagagcgtggttcatcggtgagagaatttacccttcccttcgtcattaattttttttcctatagtccagaaaagaccaacaaaaaaaaatagtagattagtttttccgtgatcctatagaccattgtgcctttttactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccactgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcagcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctagttgtgaaaaaaatatcaaaaaaataataaaaaaaataaaaaaaaagttgtgcctctctcctcagcactagagagagcaagcaaaaaaaaaaaagaggatccagcgagcacaccacaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtc

SEQ ID NO: 20120 - DNA, 636 bp, Oryza sativa
aaagggttagtggatgagggggagaaagaaataaggacgacgacgcgcgctgctctctccctccccatgtggctcgactgtttttttaatttttcgtcctggttggtttagacaaccgggactaaagatagtgggaggcttgacaatttttgaaccgggacataaaaaatgatctctagtcctgtttgatgttaccaactggaactaaatatcaaaaaattctgttgggcttttgaaccgggactaaacatattctttagtctcggttcctattcgaatcggggctaatgtgatttttgtcatccggacaaatatcaattctccggtagtgtatattgatgtattaaaatggaaggggttggatattggctaccagaaattatttttctagctaggagaaaaagagctgcgatatctaatccattttttcgaccactaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctaga

SEQ ID NO: 20121 - DNA, 1501 bp, Oryza sativa
tctatatgtactctagtctcctattctaatattccttattttttaattccgaatttcagctatttctaaattgtatttgtatatggactctgctttttatttttctccgattaatatgagaatttctaggccatgagagcggccgtgaaggctctattttctattcctttaataataactagcatagtggccctcgcagattgcgcggctagcatcattatattttctctcatgtaatagcatatatgttttctcattatattattcaaatatattaaaatgacaacataattttaaattttgcaataactttacaaaactactaatgtgtaatattcatattatattttatatacatgttagttattaattatttttaatatcaaattttagttatttgtaaattatatatattcctatatggactttagactcgtcttttaaaaaaatttaattccgatttttttgtaaattgtatttctatatagactttatgctcttcttccaatattatttatttttatttctgaatttttatattatatttatatatgtgttagttattaattatttttaatatcaaattttagttatttgtaaattatatatattcctatatggactctagccttgtcttttaatatttcatatttttaactccgaattttctgtaaattgtatttctatatagaatctatgctcttcttccaatattatttatttttatttctgaatttttattatttctaattgtatttctatgtggactctaaactcatctttcaatattctttaatttttaatttcgaatttcagttacttctaaattgtattcctatatttgtattcctatattgaccttaaactcttcttcccatgtttttcttaatttcaaattttagttatttgtaaattgtacttttatacggactctaaattctacttttaattttattatgtttattccaaattttagttagttttaaattcctatatggactctatacactacttctaatattccttattttttaattccgaatttctatttttttttcttaattgtatttctatatggactctatactctacttctaatattccttatttttaattccaaatttatattatttcctaattgtatttctatatagactctatactctatttctaatatttcttatttttaattccgaatttcagttatttcctaactatatttttatatggactctgttttttctttttctccgattaatgtgagaatttctaggccataagagcgaacatgcaggcttctttttctattcctttaattaataatataatagatataatagatagatagatcccacggtagaggggacaataataccgcctatccaagagagggtgacatttgagaggcttgaggctgatttctgcaagaatgagagaaagatccataggtttccacaaggcctaagaagatggatcgggggtgaaggcgaccgctacatcg

SEQ ID NO: 20122 - DNA, 1501 bp, Oryza sativa
tattattattattatctttatcgggtatgggtgaatgctactgtaatcttattatttttatacgttttagtttaggtaaaatttactgtggaaattcgcttggattttttttaagaaaatcatgagttgcaattaggagtccgactttcatctcaagttagcatgcagagttttttaaacaagattttttatatgactctttttgtatttttaaaagcaaattagcttaaaatccaacttaaacacttatctgtatttcgaaaagcgaatgaacttataaactgactcaaacacgaatgacgtaccaaaataccgacgaaaacatttaaaactggctcaaacacaaatgacgtaccaaaataccggtaaaattatttttaatttttataataatagagatagagaaaatatatgatttttccatctaatcaaaccttctgaaaaaaaccatatatatgtatatatatatatatatttatatatatttggcgaacgctttacatatatatatttattcgtcactttttctatttttatgcgcttaaattacttcaaaccgaatatacccaagaaggaagtcattaggtgatgcctagctagcttgcttcttgcccagcgaagattgcgcgcgagtgcatagtcacgtgttcgatcagcgtggctggcggatcggagtacagtacagataactaacctcgagaccttgaagacatgtacccaaaacatattttgctagtcattcaataaggaaatggactcactgcttttagtcaaattggtagctgtgccatctccctcaattcacaataaaaacaaaaaaacgcgacccgaggttatgatgcaattagtaaatctcggctcttcagcgtgtttaattaattgaagcccccataattaagcatccacgttgtccgctggttcagtcaaataaattttagaatgacctactgatataaggttggtcagtcaaaaataaaacgacaagcttagctgaaatttgtatgttttggcagttgacgaaagcgatgtgagaattaattactcacaaaaaatgtaaatttaacactacgcatcgatctgtctaccagctgttgtcagccctgttccgtggttcaatgatctggcagctgatcagcgcatgcgacaagactaatcgaaggcatgcatgccgtggagtgttcgaccctccttcttcctcctcttcttgttgttgttgaaacgggatcaattaatcatatataattaattaaccgttattcaattaaacgcattaaaattaaaaaatcgtaaaaataagtgcaatacattaaaagtggctaaaaatataatagaattttaaaaatcatatataattaaccgtggcctgattaagagcataaaaataaaaatcagaaaaatatgtaaaatacattctgtcgatgtttgagatcccgactacggtattttgtatagtaagaggatcgttggtaccagggtatatgcaagattgaagtaaaagata

SEQ ID NO: 20123 - DNA, 1501 bp, Oryza sativa
agatttaactccaaaccaggagctaagcaaattattaccaggtataacatccataattattgtgagagatgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactagaaagtacccgaatagaggctgtgataataccctttgcacaacacaactcaccacagtgcaccattcctagatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccattgtgaactatcattaaatcatcattaaataatgagtcataaattatcccaatagtgtgctaatgtttctaagcatggctaagcaattatatctaatatctagttgaaccaatatatataaagctcaactagtccaattataataacccaaggtatcaaggaataaagtaatcaagaacaaaagggccataacaaagaataggttaattccacccaatgacattcgaaaataaatgcacagttgaaataaatagagaatttaaatataggatcaacatgttcaaaggattgtgtttaggatcagtgtgacttgccttgcaataatcggtcttcaattaatcttcttgaatacttccggcgcactcacgaacctttgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataatttttgcaacttgaaccacattaaaccgagctaagatgaattagttatgaatttttaaagattaaatcggattaaaacctttatatggattttaattgaattatgacgcaataatgaattattttcaaaaaggaaaaggaggattattgcgtcagtggctagggtttgcggtggaccgggtgcacagcggcggttcacgggaacggacggccgagatcaaccctatccaaaacggacgggcgagaacatccggtccacggccggctcacggcggacgatcccgatgacgtcagcga

SEQ ID NO: 20124 - DNA, 1501 bp, Oryza sativa
attttcattccatcgatatgcaaaatatttgtctaagaggatattttccaagacaaagaaaagctattttgagatatggtaagtataattcttccaagtgattcagattcaacgaagttcacagcccactatttccttttgacttctaaagacaaaagtgaacagggtatcacatgctaatatggatgtgccaaaacattttgtccaagtagggccttgatggtcctaacctaagcaaacattttggtgaccaccaacttcaacgcgtggaagatttcatcgttcaaacgctattagccaaccaaatatttgattgattatcgtttttccttttaagaaaaaagacaatgaaaatgataggtaaagttgatgcaataagaaagtaaaataatttccagaaaaaaaaatcatcaccagtaatttatgatctatctatgtccaagtttgtaggattagtgatgtgtttaaaatatttaaacaagtaatataacacaaaggctttgaaaccctccttttccagtgaaacaatgtgtattcatttcccattgttctcctcattagtcattaatctgtcattttctatgaaaagaaaagaaagaaagatggaaatggaaagaacacctgttacttaagagaaataccccctacattattccctaaataaaattccctaatcttcaataggcagaattggataccttgccccatgtgcaccccaataattgctgttccaagccccaaaaaaaaacactttccaccaacatcccacctcaccccaaccaactgacgcaacggccccacctccctgtccccacatgtcattgtcacacacacgcgcgccccattggacatagcctagtactaccttcgtcctaaattaatggtcgctttgactttttttatgtaatgtttgaccactcatcttattagaaaaaataatgcaaatataaaaaattataagtcacgtttaaagtacttttgataataaagcaagtcacaaataaaataagtaataattctattttttaataagatacaaacagaaactcagagcgacaagtctcactgacaggttgtccccgtgggacccacctgtcattggcacccaccgcgccgcgtggagcgcctgccatttgggtcaccgacatgtggggacaggtgtggaccggcgtgcgcgcgggtataaacggcaaccaccgccgcttcggattcggagcctccgcctcctcgccatttacggcagcaaccgcggcggagagagacgaccgaggagagagagagagagagagagagagagagggagagctccagtggtcgccgccggcgaggaggagcagtgaatggtgcggcgcgtggggttagccggcgctcgtggatcgatctgagcgagaggggagctgctggagacagtggtgcgtgcgtccgcggcatggcgttggcggcgaaggagaggaagctgagtaggcttgggagtaagggcagtggcggaggagggggaggt

SEQ ID NO: 20125 - DNA, 273 bp, Oryza sativa
gtcaggttcgtcttcctcgcgccgccgccgccggccgaaaccctagcgcaagccgccgccgttcctttccaaattcggccgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaaggcttgactcctgcagc

SEQ ID NO: 20126 - DNA, 1501 bp, Oryza sativa
tgcatcattagtttattttgttttatatggcatgcttatatattcaattagttcaaatcagaaatttcttctcataagttctcatttgtcacggacctttatttagcccttctttcttaagggtacacgtaaagcgtactcagaggaaagacagttcaccaagaagagtttcagttctaaaagcatacggtttatattctaaagtgaaataagaatatttccttttgcattattgtgccatcaacaaaacgacagcttcataaatcatgatgtatgtatctttgatataggggtaagtaaagtgttagcgtgagaaaaaaaaagggtatgttaccgaatcctatgtttttcttttcttgggggtagttatgttcttaggtaatctttatcaataggaaaaaagttcagatatctgctaaatagtacagaaacagttattagaccatcttaactaacatgaaattgatttttgagacaaccatcacatgcccctgatgacatggcaatctagtttcattgaatctaggagaatgtcgctatgaatggtagaacaatcaatcttcataaatctactcttctgtttcaaaatataaaaactagtatcgaattagtcgcatcttaatcaacgaatctggacaagggtatgtcccgttatactaggatatgtccaatccgatcataaattactatatattttagaatggagggattatcatacataagtactaaaacacatgtaaaaacggaaaaaagaaaaagaaaagcatccccatgaaaaaataaaaatgtttttgtgctgccactgaaagttacagtccacacaagactgaaattgcacttcactgggtgcaacacaaaatgtgcaccagaatatttaggaccaaaacgaagctatccattttggattaggtccaaaaacaaaaaacaaaaagattatattttcctctctctctctctctctctctctctctctatccatcatctcctcctctgctttttagttttctctcccattttggcttcgccccacccactgcctctctccccactgtgctcgcatcgcaggaagaacccgaccggcgacgcctcctccacggcgaaatccccatagttttctccacgaatcgatccaattcgcggcctttcccttccccctggggccaattcgcgtggaaattcgggaaaaaaaaggcgggatttttctgcctttttctttacccccctttccctttttgactctccgcacggttcttctttttattggtgtcactgattgtgtttctcgtggaaaaggcgcggttttaggggtcgtctcgatcgcggatttggctccggaggcgtcgatttgatcctagcaaggtgcggttttttttttgttttgtgctatatatgaggtgaattcgtttccctgcttcttacggcgttttaattaatttgatgatcagattgaggaatgatggattcgtgaattttgatcgagttgcttgtttggacgatccgt

SEQ ID NO: 20127 - DNA, 1501 bp, Oryza sativa
actgtttatcaatacctatcagaagatcgggacctaacatcctcatcagttggtatcaaagcgccagattgatcattaggtaatttatctacccataaccagacaattgccacacaaaaatattgcatccattacctagccaatttgagttgttgcgttgttctattagtttttgtgttgttgaattttagattgcatcgtcgtgttgagtgctggtttagttttagatttaatttttcgttttgagtattgcatctgttcctcacttaggtttagggttcatcactcaaatctgtgtgagttttacgttttgggtccagcttttttatctcgtcggttgttgccgagaccttaaaaaatgggatctaatcatcatcgggtttccgttttttagtttggagaagtattcatcgagtggttttgaagtttctcgatttctagggttgcggtgtgcccgtgcttctgtgtgctgtgagaatgaaaagaagaaaagtatgagattggttgtttactgtggattggttttgttggagataatatagatcgattttagttggtttccaaatttttagggagatctgtttatcttcaacgcccacccatctctctctcccacttgaccaagcccgtccccaccgtccacctcatcgagaaccgggtaccgacctctccacctacgtgtaccaggtattgagtacgtagttttccttatatcatatatttatggtatcggatttgagaggtattccatttttgaggtgatccaattttagttttgcactttgcatttgagtccatgtaatatttatatttatatttgagtccttggttgaggttaatgatcggttcctgttgaaaaaaatgaaaaggcagaaatgtgcagagaaaaagaaataaaaagccgaacctacaataaaaagaaaaaacggcataaaggtagttaaaaaaagccgcacaaaaaaaggaacataaagaaatttgtttaaaaaataaatcatcctttcagtatgttttgagagtgtagagttgtgcattgattcatatctagtccttagtgttgttgggtgtttgcttgagctagaattgagtgtaagctaggccaacacattgactagtacattgaactattattcatatttgcattttctgattagcataattgcgttcctttgctactatatattgggcctcccaagctccacatatatacttttggtcagcaccgctttgatccttgcaatcgccacatcacgtcattagaggtgtcaagaaccagccaccggttgtctgtccttagcattgctggtaagacacttgtaagagcttggtaagacgctgccatttactagcctccactacaatccgtgttctgtagttaatagggataatactattctgttgttctctgttttctactaacgatggcaggttacatctcttgtggacatgagataaagttggatgggagacaaaccatagttgctacatcaccttccacaga

SEQ ID NO: 20128 - DNA, 1501 bp, Oryza sativa
gaggagagaggcacaactttttttttattttttttattatttttttgatatttttttcacaactaggagcacactagaaccaaccacagaaaatcttatctcaaacggacaaagtatgaagcttgtagaattttttcaaagttctatgcgaataggtcccgaagcttctcgccacaaaaacagaattttgcaagaggaatttggcgattttaaatttgctgaacccggatgtaactttttttgtagatgtccgtggatatattataagcctaatttcgagtccgtatgaaaaagatatgactgttttaaggaaggtcactcgaatcagggttctatttcctttctagtggcggcaggatacaaggcaactcacaaaagctatcggcaacagatcaaacacaaatagaaagtgatttggtgggtgactgcgacagtggtgacggtggtgatgacggcaaaattgatgaaggtggcgatgtgcggtggtggcaagaactcgaaactctaatcgcctaacactaagaccagcaaattaacacaaccgatgcaatcgaaaactcaacaagccttaactaagcagtactagtaaaaaggcacaatggtctataggatcacggaaaaactaatctactatttttttttgttggtcttttctggactataggaaaaaaaattaatgacgaagggaagggtaaattctctcaccgatgaaccacgctctgataccacctgatgcaaacccgctagggtttgtggcccgatctttcgatgagaggtaagggataactcgattagatgaagtcgacgttcacggcccgactacaactgtccaaagacgctgcgccttagcaaccgatacactgtctccaatggtcgccacgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctacctctatcatcaaaacccgcctgttcttagcggcgactagaggtataaaaagaggggaagaacgaccatagggtcgtgctccaaccctaggacgcgcccctaatgggcccaacatggatacacagcccattgggccaaaagaggtgacgcagcaccatggacagaaaatagtcgggagtaaaatgataattgcggccgctccagaacagatatggacatgtagctggatccattcgaaagtagacttgataagctttccatgaagtacttgcacgcccaaatcggagttcgcatgaagtcgtggcggccgtcagaagttagcgctgccctgcagtccgaatccaccccgcgcgaatcctcttccctttggatcctctccatcgttcctgagtaaaacacgagtgcacgcgtctccga

SEQ ID NO: 20129 - DNA, 885 bp, Oryza sativa
gtgcgcgcggtccacggcaaaccgtgcggctgcacgtgggcccgccgccatccatccacccggtgcaccgctcttaagccacgcgcacccgaaaccctagcgcccgcccccgcgtgcgccgtttccaccgtgcaccgcctcaccgacaagcgggcccgctcgggaccccgcgaggtgagcccggtccacccggctccccttcccccccctctctccccgcgcccctctcttgggccgcctccccgtagcccgcgccggcctaataagctcggccgaaccgcgcaaatcttctcgggccgcgccaagccgctcgggaaagtctgattcctatccctccttccttttcttatccaaagggattactaaatccttttccctttttcataaatcaattccttattccaaaaattccatgaatcatttcctttggtcccgcacatcagtgaccatcaataatattcttgagaatattattccataaaccatttctcgtgttctagaaaaatccaataaatcatttccttgtccagaaattccagttaagattccaaaattcatatctctcgatccgttcattcgattgacttcgttccacttccagtatttccgtaaaattgagatctatttaatggcactattatttagtctaaataggatctttcttttggtcttttgtttaggtttttgattgtttgcgtatagttgcggttaccggattttcgtcgatcgcgggttttctcgaagattcgtgaagctccgtgaagaccttgagctaggcaagtcaccctttgaccaattgctcctataattggaaaatcattattattttgtttgcaacttgcattgttagaatcacacacttaacttgcttggcctcggtttgcg

SEQ ID NO: 20130 - DNA, 1501 bp, Oryza sativa
accggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgttgttggtgcactttgtaaacatagagagaattaataaagtcgtcattcactttaagagttcttcgatttgtgtttcaccgggtttcggcggtctaaccgacaactcaccggtggtcagaccagcggcattgcggcggtcagaccggcgggagcacggcggtcagaccgacggcggcgacagtaggcggcaggcgatcacggcggttagaccggtagatcaacaccggtcagaccgggggctacgcttcggtcagaccggctaatctacttcggtcagaccgatctccatcgatttcgagggtaacttttatttccgctaaaagttttcggtttttgggtataccaaccattcaccccctctggttggcttagttcttgtgattcgatcctacacgatcgatcgatctcacacagtcacactcctctcacatctcacaacttatatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgtt

SEQ ID NO: 20131 - DNA, 1501 bp, Oryza sativa
gcgtgaaatccacaaaagttagcatcaacgaaacaaaagcgtcttcagcaaatttaaacaggctgtatagtgttctttctttcaaaaaaggaaaaaaagaaaataaaagaaaaggttctgcaagagtaaagcaacaaagttaaaggaaaacgtacaccgaagatctctcaacttgtcatcaagttacaaaatcgttcttgaaccgcaaaaccaaatacagcggataacccaacttacgaaaccaggacaaactaagtcccttggcggttttgactctggttttgcctaatgtggcagctcagcatggtacccacgtgaccccacacgtcagcctcttctttccctcccctctccatgtttcttcctcgctcctcttcgctctcctcccctcttctctgtatctatccgcgtcacaaagccggcgggatggagcggggcggcggcggcgggcggagtggggcgacggcgaggcgtagcagtggcgcacgaagccggcgaggcggtggtgggctggggaaggcaggtggaatggggtgacggcaggtagggcggagcggagtagcggtgagcggagcagccaagcggagtgggacgacggcgcgcgaagccgacggtgggcggaccaggtaggtgaagaggggcgacggtgggcagagcggcagcgctcgaagccgacgacgtggagcgaggcggtggtgggcggagtagataggcctgcaaggcggtggcacgcgaagctggcggcgcggagcggggcagtggtggacaacgacgatgatggcgacgggttcgaggagaaggaggaggacgcgcgccacatcttgctcttccgcgtctcctccatctttgcgccgcccttcgaccttgatggcgtccttgccatgggcggcggctctccacgctatcccctcgccatgggcagaagaagtgcgacccacccccgcgcgcagctactcccccaccacttgcgtgccgctccttcaccggcagaggctcgcgcacagctcctctctcgccgcctacccggtgttgtacctcatgacgtcggacacccatctacccatcaatgacatgctgcgcacaagccacctcttaggcatcgacaccttggggctcttggcgacgacgctgccccggcgcgcctcctcggcgcgggcgtcgcgccactgcctggccatgtactccttgacggcgctgacgccgccagccaccacctccttgggcggcacgcgagcgggttctggtagatacacagaagagaggggatgagagaggagagaggaagaaaggtggagaggggagggaaaaaagaggctgacatgtgggacccgcgtaggtctacgctgagtttacactggttctgtaagttggaggatgcgttgtatctagttttgcgattaaggacgattttgtaactcgatgataagttgagagaccttcgatgtactttttcccaaattgaaacgcgctgcacaaatagacccatgttttatttaggccc

SEQ ID NO: 20132 - DNA, 818 bp, Oryza sativa
tatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctc

SEQ ID NO: 20133 - DNA, 1501 bp, Oryza sativa
attagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgttatttggaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtg

SEQ ID NO: 20134 - DNA, 378 bp, Oryza sativa
caagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaacactttctgataagg

SEQ ID NO: 20135 - DNA, 1501 bp, Oryza sativa
actatattatgatgcacctttgatcaatttatacttgtaactcttgttatatctatgagatatatatatatatatatacacacacacatacatacatatatacatatatatatacatacatatatatatatatatacatatatacatatatacatatatatacatatatatatatatatacatatatatatatatatatatatatatacatatatatatatatatatatatatatatatatatatatatatatatatatatatcacctatatagaaatcttgcatatgccattggccagctttgctcattagaaaaatgaaattagccaaggaagcaaacgagccataagcttcaggtccatcctatgtcagagtcgtgcatgcaggcagatatgctagctggaatgtactaggttgcttaggtggattcgatcgaaggaagggattttttttcccattatatagataagatgcgcaccgtcaccacatgcacacacatcatactcacacactcatgactatgttcttttttaacatacggtaaaagagacggagacaaacaacaacaatttacttaaacttctgcaggctactatttctgcaaataatttgttatatatttatcgataaattttttaaaaaaatttgacatatgtaattgttatgtagtgtagttacattgtaacttgtatgtaattacaatgtaacttttacatcattttaaattgttagattcgtttcaagattcgtgcaagcgaaaaaattacagtgcatgcacatgtgagaggattcactcctatgatgtccattttatggaaatagcatgtttcgaagggatttttaaaagttacatacaagttatattgtagttacatgaaagttatgatggaaattacaccacgattgtattaaaattatatttattaaatcgttggaagaaaatttatcgataaatatatatgtgatcccttctgccaaatactagtaggcatgtatatgccgacaaatttaaacatcaaatgattcaagagccaaattaacccacacaatatatataagaaagaacaatagaatcttaatcatgcaatttggttgaagctgtcctatactattatccttttctataaaacagattagtagtactatgctctgcaggagtactactcgattaaagcataactttgcttgctaaacacacaccaccgatgggaaacaacagagcatcaagggtgaaacactgcatatgcaatgtgcacgttcacagtgcactactcttaaatcgatcaaatgtacggcgttaatgattttaaacctgcaaattgggcgcaaattgctgatcatgttgtaatataattagctttttctttcgagggaacgtaatatgattaactgacgcctatataaaccaagcatggcctttgctgcttcttccctcatcgacacagcagtaagaaactcccaatattaaggaggagtttgcttagattcattcaacaatggc

SEQ ID NO: 20136 - DNA, 1501 bp, Oryza sativa
aactttacctatcattttcattgtcttttttcttaaaaggaaaaacgataatcaatcaaatatttggttggctaatagcgtttgaacgatgaaatcttccacgcgttgaagttggtggtcaccaaaatgtttgcttaggttaggaccatcaaggccctacttggacaaaatgttttggcacatccatattagcatgtgataccctgttcacttttgtctttagaagtcaaaaggaaatagtgggctgtgaacttcgttgaatctgaatcacttggaagaattatacttaccatatctcaaaatagcttttctttgtcttggaaaatatcctcttagacaaatattttgcatatcgatggaatgaaaattgacttgttgcaattcctcagtgatcaacggtgcaattatacccagtaattgcagtcaccttagttgaagctgggatataggtttcagggttgtcatggatcatctaacagtagcttatgtaaccaactttcagcacaaattttaccatactactgtatttcacacttgacagagtagttaacttgatggtttgcagtaatatttgtccttagggttgatcaagaaatccaaagttaaaagaacccttacctcaaagcaaagtcaaatgtggtcctttaaagggtcctcacattaaaccctgcattaacccttgttggaggttggttaagggtaagtattaagtaattacaacttgcattgtattgtattatctttgtatgagtgatgatgcctcaaaaccctgcagaattccaatgtggagcccttgccaaaaggttaataaaaaaaaggcaattgtcctggtaatactttattaactgtactgttgctcctgcaactagtttaccttttgtactcttacaacacacatggggtgtgggacttaccgacttagtaatctactacttctcagctaatctgaactctgaagaagcatataaattttacagatccggataatctgatgctatgccagtactaggtgtttgtcagtgtgttggtgtccgtattaattaaatggcattgaaatctcaaggaagaacctactggttttaatatagatgcagatactagcagcttaggacatgtgagaagtcgaaatgcagcataccttattcatgaaccattaaaagtgtgatttataggaagcagaagtatatcaaatgcaaatgcataccatggtatgtttctggtctggtcagagtttgttagaaagtggaaccactttctgcacttctttttctgaacatgcacagctcatgctagagaacattgcatggagtagaggaagaacttcagattgaaatggtctataaaatggcagctccataaggctgaaacattgcaacagacagcatatggttttagctctgaaggtaagagttgtaggaaactgaactctttcttgtcagtgacagtttcaggagctcagttttctccaacatcttatcttcggcgccttaatctttgtagt

SEQ ID NO: 20137 - DNA, 1501 bp, Oryza sativa
aagggtgagtacaagagtactcagcaagccatgggaattaagtgtttaatgcaggcttcaaagggaaggctgttgtttttgcaattgattttatttaaactcctttttgaaacaactaagtgagtgcttctcaaacgacacggatgagacagtgcgtctcgtccggtcggagtatgtgcaatgtatcagtctttgaattgattcaaggttgacacccggccaacagctttcaaacggccacctgggcctggctgatcccatcagccgcggattttccaaacatcgaacccattccacaacaacaatttcacaaagcagtagtcaaacaaaactacgctaggaatcacctaacatccgcccatgaccgtgggcacggctgttcgaacagtttaataacctctgtagagggggtacactttacccacacgacattactaacccggatcacccagcctgtgcaagacggccacgtctggagaccttgaggctttcatgacaaggcatttcgaaagccgacacaggttcaccatatgccaacgagaggggtcccagactgatatcaggttaggtcccagaccatactgtgtcaggaagcccgggggttctcctcggcaccaccccgttgaatccacatgtctcttggcatcatggctcccccgattagctaattactcagccaggggcgtcccatttcacccatgtggtcgcacttgtcttatgttcggatgaaattccaagggaaacggtccttaagtgcaagaactagaaaccgtactcccagtacgtcccccggtctgcggttttggaaattcatttagttcgcaagcaccaacccaggtgtcgggttttccaagtcttttgtaaaaccccaagttttacccatcgttggatattttaaatttgaggggaggtgttccgatgcccgtgcccgaaggcccgtgcatcgaagcacaacagttgacaaaggaggttttaagtgttcaataattcaaggagggtaattgcagcaattaggattggggccggcaggctatctcacaagccgcggccgaattacttgtgttaaactattcatgcaatatttgcggaaaagaaatacttagatttaaattatagggcaagatgatcaaaggtgacttgccttgctcgagatcttgagctcgatcctcgaaatcctcgcactgcgggtcttcgggctccgaaactacatgcgaaacgggacaactcaacaaacagagaaaacaaagccctattattgacctctaagcgtgccattagatagatctcgagatttgaggaattttggaagttgaacggagtcaatcggatgtacgattgagaagatattgaatttctaagattattggattttttatctaaaggaaaaaggatttatttaaacccttttgaaaagaaaagaaagagggaggaggagtagacttccctcgggcggctagggcgcggcccgagagaagaagcgcggctcggccgagctaatggg

SEQ ID NO: 20138 - DNA, 1501 bp, Oryza sativa
ctaataaacaatgtacaagagaatcctatatatttataaagttcattcccactaagtgttgttaatgttatttctcttttctatcattaagttacatcacatttattatttttagctcttggatggttgatctacgctacaaattatctctcttttttcttattttatgaagtcatatcattttagttttgtcttcggatgattaatctatatatcttccttccttttcttctcaccttaattttgctttggaatgattaatctatgtataatttgaattataaaccacatcatcttaattgttcgaacattttttttcaatagtcggtcaaagatgaaaattatataaagtattacaaaattatattgtctagctattttacatgttatttctactatatattatcatacaaaacatgggttttatccagttaggattaaaagtaatttattatcttaaatagatagaagatataaaaagcatccttacatataggaacaaataggagagagacaatcacatagggataaaatgactgaaattaagcgaaaaatgtgacgctataattctagcaattccggcatagaaattagaaaagttgtttggtctgcatcacataaaaagcacagaaatttgggataccctgaattgcttggtttcagcaaatcaaaatatttccataaggtatttacgcaacatgtttctgaagaagaagatctcacgagggtcaactttcctgtcaggagaagagaacaagttggaacttggaagcttagaaacaagagagcctatttctttggacggagaattcaactgggagaagtcatgatcgatgagctcaaagggaggaaaaataacaaccaatcaatctagaattccacgcatattcattagtttctccttccgattagttggagaaagactaatttccaacgctaataaaatactgcaaggacaaaagcaacacagttttctccatggccccatggcgccaataattctcaagagaaaaaaacgaaaaacaatgtgcagagaaagccaaaaccatgtctgcttcctctgaccacccaacattccgacacctccagcttcagagctccgagctgtttaaataggccacaacgccacaagaattttctccatcccattcccgccatctctgcatcttcttcttcttcctcttccttctgatcacctctcctccaagaagctttcgtttctctcatctgtcaatcatgtcggcctactgcggcaagtacaagggtacagtaagcttcgtttatgattttgtgttcgctttatgtttggaaaagtttttttttaagttctctttgagttgcactcgttttgagcgatttggtgtaataattggttgtagctcgtttcagcgaaggcggagatggatttatattccattatccaaaaaaaacacttgtgcaacacatgcatttcttgattcgatgagtaagccatgcgtttctgcttcttgatcaatgattt

SEQ ID NO: 20139 - DNA, 1501 bp, Oryza sativa
gagccatgatgccaagagacatgtggattcaacggggtggtgccgaggagaacccccgggcttcctgacacagtatggtctgggacctaacctgatatcagtctgggacccctctcgttggcatatggtgaacctgtgtcggctttcgaaatgccttgtcatgaaagcctcaaggtctccagacgtggccgtcttgcacaggctgggtgatccgggttagtaatgtcgtgtgggtaaagtgtaccccctctacagaggttattaaactgttcgaacagccgtgcccacggtcatgggcggatgttaggtgattcctagcgtagttttgtttgactactgctttgtgaaattgttgttgtggaatgggttcgatgtttggaaaatccgcggctgatgggatcagccaggcccaggtggccgtttgaaagctgttggccgggtgtcaaccttgaatcaattcaaagactgatacattgcacatactccgaccggacgagacgcactgtctcatccgtgtcgtttgagaagcactcacttagttgtttcaaaaaggagtttaaataaaatcaattgcaaaaacaacagccttccctttgaagcctgcattaaacacttaattcccatggcttgctgagtactcttgtactcacccttgctctatataaatattcccccccccagttgctgaagaagatgaagtggatcccgctggcgaggagttcttccaggagcaagtcggctacgatgagttttagggtttcggtccagttcccaagtcgcgcctgtgatgattggtccaagtcttggcttccgctttcccttttgtaatgcagttgtgagctcgggatctgtccgcagcccaacatgactgtagtcctactctgtaataaagagacctctgttgctgtgatattctgtcttcctgtgataccagcactgtttcctgggactggtatcgattaacaggttaatttggagcgtcacgggctagttccgttcggggctagttcggggcgtgataatatgttagggtgtgacagttagttatggaactgctgtgagaaagtgagctacccatggaatcataagcacgataaatcttgaattgcttggtgatttaatttattagactattatccttttagaccttttgtttgtagctaattggaggtatgtatgaattacacacttctaaaaatacgatttctccagaaactttctatgttagtattgattagataacctttttataagctacttgtaattttatatctttaatatttaactaatccatgtatatattaatttatcggctaaccagctagctgtttcgaaccggtaggtgacaacaggtatcctgccctttcatcgtttttttgcatcggtaggtaacagctggttttatgtattactcgactttgtataaataggagagcatgcatgtttcatcaatcagttatcttgtagctagctacctgatcgaactcgggaaaattattta

SEQ ID NO: 20140 - DNA, 836 bp, Oryza sativa
cgaacctcaataaatgcggttaggtgagccccgctgcgctcacctaacccatacacgcggcacaaaactcccaaggggtcggggcgcctcaaccctcggggccgaaacgggagcggtccgacccctcggggagactaagaggggggcggccacatcaccctcgggcccgaccctccagagggggtcaggcctcatgggtgattgctcctgcccaagcctctagtcatgatactcccggtcccatgtcaccgacagtagcccccggcgttatgctagggcgatcgccctcctcgagggaagcggtcgggcgtgacgccactccctaaggcctggtgacaggtgggaccggtctccatagttgggcagaaacccaacggtcgccaatcacgcacatcggcaatggtaactcgactgtcaataatgagcggtctcttcaagactgccacattactcgagtagcacgcgaatcgggacgagccggttcgttttgcctggagatatggtgatggcgcttcgattggcgagcgtaattaacgcgcgcacgatatgttccatctcgactgccacagccgcatatccacctcatgcgccgcaagcgggcgaatgggattagtggaagcgtgggcgcgagaaacgagggagcgatatagtgggcgcgagaagcgaggagccgggcacaacgttggcaagggtataaagactccgaggaagagatttgcttccttcctctcaccattattccccttgtcttcgccgcttgcaccctaactccttgtttcctgtgccctaccttcgccacacgcgctcgctttcaaacatctcttcctccggcgtca

SEQ ID NO: 20141 - DNA, 158 bp, Oryza sativa
ttttctctttcatgctgagctgatctattgctaatcaattaactaaccctctcatatgcaattcgatctctctctctctttctctctctcttgctattttatttccttacacatcaattaaatcgtctgatttggtatcaacatgcactcctatgttt

SEQ ID NO: 20142 - DNA, 1501 bp, Oryza sativa
gtttaatgcaggcttcaaggaaaggctgttgttttcgtaattgattttgtttgaactcttttctgaaatcaactaagtgagtgcttctcaaacgacacggatgagacagtgcgtctcgtccggtcggagtatgtgcaatgtatcagtcttttgaattgattcaaggttggcacccggccaacaactttcaaacggccacccgggccaacaacttttaaacggccacccgggccaacaaccttcaaacggccacccgggcctagctgatcccatcagctgcagattttccaaacatcgatcccctttccacaacagcaaatttcacaaggcagtagtcaaacaaaactacgctaggaatcacctcacatccgcccatgaccgtgggcacggctgttcgaacagtttgttaacctctgcagaggtggtacactttacccacacgacattactaacccggatcacctagcttatggggatcagccacgtcgggagacctccaagctttcatgacaaggcatttcgaaagccgacacaggtttaccatatgccgacgagaggggtcccagaccaacaacaggttaggtcccagaccatactgtgccaggaagcccgggggtcctccccgacaccaccccggcgaatccacatgtctctcggcatcaaggctcccctgataagctagttactcagccaggggtgtcccattccacccatgtggtcgtacttgtcctatgttcggatgaaattccaaggaaacggtccttaagtgcgagagcgggaaaccgtacacccggtacgttccccggtccgcggttttggaaattcatttagttcacaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaataaagccctattaaagacctctaagcgtgccactagatagatctcgagatttgagaaattttagaagttgaacggagtcaaacggaattacggttgggaagatattgaatttctaagattattggatttttggtctaaaggaaaaaggatttatttaaatccttttgggaaaagaaaaagaaaagaagggagggagggaatatagacttttctaggacggctagggcgcggcccaagagaaa

SEQ ID NO: 20143 - DNA, 1501 bp, Oryza sativa
acgggtggacattcacccgagtgtttaaaacagtttcccccatacttaggcattttgtcatttactttcactgttccatacagtaccgtcgagaaaacatctcttcaggtgacaacccttttagatgggtatttcttgacctgcctctacccgagcacctgcaaaaatcaggtgtataagaaaacggcacgtaaaaaaaaactttacacgaccgaatatctagagcttccttcaaaaaagaatgtttttataggctatttcttaaggcagccacatgtgaaaataatttttgcatgcgctgttggaatattggaaaagaaaattcagttactatgcaacaatgcacccccatacacaaaaattagtagatttcttatccgcacacatacatatcatcacattacaaatttacaaccacattcacgtttactaaacattaacatacatagttttaataaaatcatacacattatccacatcaacattcacacttagatacaatatatatattgacatacaaagagttttaaaccatacaaattcaatctccacgactggctcgcatgagatatatagtataatttctatctttgctcgtagtaataaggttttcaccttacggcagcgcattaaacatactatcaatgattaattttacaagtaatattgagatgatataggataaggcaggataaagtcatattgatatatatgtttttttaagcaactttcgcatagaaactttttttaaaaaaacacattgttgagcaatttgaaacactagtaaagaacattccatctatgacagcctctaacatgcctgaaattagtgggctgtcacgaatgagtcatctgtgacgggccaaaatatcgtccgattgagatatgaccgcacagacatgttagacgggcataaaactcagacccgtcacggatgacacctatcagtgacgggccataatttagacccaattgagataacattacatatcttaattgagccccaagttggcgcccatcacagaattcaaatctatctattatattattaaaacagccttgaaaggaggcaccacgttcgctgtgagggctagaaattctcacattaatcggagaaaaagaaaaggagagtccaaatagaaatacagtttaaaaacagctgaaattcgaaattaaaaaaaaaagcaatatggaaagaagagtccgtataagaacctaatacgagattaatcaaaatatagaataaaaataaaataaaatctgaaattagaaaagaaaaggagagtacaagtaggaatacaatttaaaataactgaaattcggaattaaaaataaggaatattgagagaagagtccatataagaacccaatacaagattaattaatattcgaaataaaaataaaatctgaaattagcaaaaagaaaagaagagttcaagtaggaatacaatttaaaattaactaaaattcggaattaaaaataagcaatattgagagaaga

SEQ ID NO: 20144 - DNA, 374 bp, Oryza sativa
aaagttttggtggcaaagttttgatattgtaaaagtactagttggtgtttagatgcatcctaaacttttgctattctagcactaaagtgagagagagaaagagagagtgagtggtcccaaagcactttttggcacaatttactactatggactagcaaatgctaaatgccaaattgtcaagttttgctactagtgtttagatccaaaatggcaaaaagtgcttcagatctgatttacaattcgttggtgtgcattcaatgtagtaatattgtcaccaaaggcgctcaattagcattctcgtaattggccacataaaactttttttatctgtgataaagaaattatataaaacaaacatgtggtagcaacttgca

SEQ ID NO: 20145 - DNA, 1501 bp, Oryza sativa
tcgccgtcacgacggctgcttcctcctgcactacttgagccggggcagcgcggtcgcgtccgaccacaccatcctcaaggacgtgatgctgctcgagaaccagatcccatggctggtgctcgacaccctcatggagatggagttcctcaatgtggacgtgcgcaatttcgtcgccggattgggagacaaattcttccccaagaacggagacaaagctggcaggtggtggtccgtcgtctgggcgacaggccagcgtggaaacatcacgaagcttaaaagagacatcaatggcgggcagagttatgaaagctaccggccagctcatctcctcgttctcctccggttcagccagatatggcggatgcccgaacgagagatcaactacgtggcggccaacacatcgttgctgtccagcagcgccgtcgagctggcccagatcggcgtcaacctgacggccagcacggcggtgtggttcgcggacatgagatgatgagatgagactagtcagggagaagcgcatcttcggcgagttcctgctgtcgccggtgttcctgaacgacgtgaccgcctgctggctggtgaacatggcggcgctggaggcgacgagcagcggagcagcggcgtcgtacgtctacggcgactttgtggtgagctcgtacctgtcggcgctggcgatgctgatggacagggaggaggacgtgcagcagctgcgggggcatcgcgtggtgctcagcaccttcagcaacacgcagacgctggacttgttcaagcgcatcggccagcatctcagcttgggcagccgctacttcgtcgtcttggagcagatcgaggcgtaccggcggaaccggccggcaaggaccatggtctacaagttcctctacaagcacatcaaggccatcagcgtcatcttgtccatcgtcagcgtgttcgtcggcatcttcaaggcacttaggggacgctagccaatgccaaccaggcgagtttttttttttgaaaaataaataaaggaataataatctagcctctctacacccagattggtagtagatattaattggtagtactggatatatagacaagaacaattaacatatcctgcagtcgaattatattaactactttgattagtattttggctttaatactccctccgtttgttaagagcaaagataatagtagagctcacttcctactattagcccatatatataatagattagggagaggattctagtccctcgaggggtcctcgtatacctttttctttcaaattcgatgtaaatagttgtgaaaaattctgaaacaaataataatgtaaagtataatgatacctactagttcaccaaaatttaagttcaaattcgatctatacacatcgagaaacaaaaaaggcaaatttagatataacagtatgctactattcatacgctgaatttgtcttttttatatctcgacgtgtgagttgagtttggacttaagattttgtggagttgtatatatg

SEQ ID NO: 20146 - DNA, 1501 bp, Oryza sativa
gtgttgatgtcctcatcatcctccccttcttgcatttgagtcgtcctcgactcaagctcatcttcttctcccaaatacggcttcaaatctgcaacgttaaatgtgggactaaccctgaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttgggaatgacaagtagtagaaaacaaaagtttagtccccaatttagcccacaaagttctccaaaaatggctaagaaagtttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcaacgagcaacgaacctgccaacatctcttcgcatctgtggccaaaagaaatgactagcaaggatgtcatgtgtcggtgacatgggaccgggagtatcatgactagaggcttgggcaggagcaatcacccatgaggcctgaccccctcgggggggtcgggcccgagggtgatgtggccgcccccctcttagtctccccgaggggtcggaccgctcccgtttcggccccgagggttgaggcgccccaaccccttgggggttttgtgccgcgtgtatgggttaggtgagcgcagcggggctcacctaaccgcatttattgcggtttggacgagcgcgtcatgccgcatgtaacgcagtgcagcacgctcgtttatccggtctgtgaccagtcacagaccgaacagatcgtgggttaggtggcaacaggcggtctgacgcacgcctcgccccatcccgtcaggatgagagcctctaagcactcgtccctagccggtgccggcgtgttagctcctggagat

SEQ ID NO: 20147 - DNA, 1501 bp, Oryza sativa
tgcaatcattttgcgtgtttgtaaaataaaaatattcaggatctctttatctgctaatgacagcagcctgctgtgactatatattggtaccatcttgtgccaaacaaatggcacataaacgtactgatggacgcaaacattttcggcttaccagttccagaacagaggacacagatcatgaacagagaagactgcttcaccagctcgattttggccactcaagctgctctggcttgcggcactaatggactggaattccctttgttatagcaactaaagaatttgcacatttgtttctgcaattaatggactggaattcgtcagacattgtttttagatcagttgtgctatgcttgtttttttttgctccatgttgaccgatgaattaatatatttcagatccatgcgctcatatttagtgaagaaaaaaaaacttactgtttgacctggcattggcaatgtgctagttcacataacaaatcctgatttatacaaatataattcacatctagtcaggatatagtatagtccatgtttgatcataattctccaaatattctaatcacagagaacatccgtcttaataaaaacagagaacatgagctgtggataaaaaaggctcagaattggaattccaccaaaccagccaatagtaccatatgcatatattcggtaatatgcctgtcacgccccggactagtcccgaccggaactagcccgtgacgctccaaattaacctgttaatcgataccagtcccaggaaacagtgctggtatcacaggaagacagaatatcacagtaacagaggtctctttattatagagtaggagtacagtcatgttgggctgcggacagatccctagctcacaactgcattacaaaagggaaacggaagccgagacttggaccaaacacacaggcgcgacttgggaactaggccgaaaccctaaaactcatcgtaaccggcttgctcctgtaagaactccttatcagcaggatccgcttcatcttcatcagcaactggggggaatatttatatagagcaagggtgagtacgggagtactcagcaagccaggggaaataagtgtttaatgcaggtttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacggctgttcgaacagtttgttaacctctgcagagggggtacactttacccaca

SEQ ID NO: 20148 - DNA, 1478 bp, Oryza sativa
gcctgcaggtcgactctagaggatccccagcgcatattaatttgtagcttcagttgctttggaatttggtaggaggtttctgcattttatatagagctcggatggtggggattaatttgtgatgccccttacgttcgagaggcccttttaaaattttctatttcctcgtttttcatgcgcccattaagactcatagtactaaatagtaagtgtgctttctcaaaataattataaaaaatattctgaaaaattatagtattaatttattttaaagttattttaactaataattaattaacctcagtccctggcagcttgggacatggtatgcaaacccaagaataaaggaggagttctgggagtcattgaccttgaataccaaaacattactcttctaatgaaacatcttgacaaattcttcaacaagcacgagctcctatgggtaaagcttatctggaccaaatattatctcaacgctgacctgccccctcatgcttgcaaagaaacagggtccttttgatggaaagatattttcagactaattcctatgttcagagcaatcacgacaataacaattcaaagtggagacacggctcttttctagaaagataactggaattggacaggcaactccttggaacaacaatttgccactcttttctcctttgttgcaaaagaagatatctcagtctttggttttctatcagaacaaaatttagaaaacctgctacacacacctttatctacccaagcaatgcaggaggggcaaacaatccagtccaatctcaattgggtttcccttaatagctcagaagacacttggacatacaaatggaacagtcccctttatcggacgaaagtggtttactccctgttctttgctcatatcacacctgatctgcctctctctctcattaggaagagcaagtgtaccctgaagctaaaggtgtttttaggctacttcttgtggatcgtctcaacacaaaggaacttctttacaggaaaaatctatttgtcagcactgggcccaactgtgttctatgccctctatcaatcattgaagatttcaaacatctcttcttcacttgcccctttgccatcaattgctagaactatcttggaatcaactggctcacaaaccaggacttcatgatcatgataatctctgcatgaagaagtttcggccacccctttttttatagaaaccattgttgtggatctttggaatatttggaaaagaagcaatgatttcatttacagcagctgtcagccttctttccacacttggaaatctctttttagagaagattttactctacttttgcatagagtaaaagctcaggaccgacccttctgactgttttcccgtaaaaaaaaagaaaaagagttaaaaccttgtgttagaacacaacctaaagttgtaatgttgtggcatctccgtaagtttataagcgaaagcccagcctatttaggcacca

SEQ ID NO: 20149 - DNA, 1501 bp, Oryza sativa
tttctagaaagataactggaattggacaggcaactccttggaacaacaatttgccactcttttctcctttgttgcaaaagaagatatctcagtctttggttttctatcagaacaaaatttagaaaacctgctacacacacctttatctacccaagcaatgcaggaggggcaaacaatccagtccaatctcaattgggtttcccttaatagctcagaagacacttggacatacaaatggaacagtcccctttatcggacgaaagtggtttactccctgttctttgctcatatcacacctgatctgcctctctctctcattaggaagagcaagtgtaccctgaagctaaaggtgtttttaggctacttcttgtggatcgtctcaacacaaaggaacttctttacaggaaaaatctatttgtcagcactgggcccaactgtgttctatgccctctatcaatcattgaagatttcaaacatctcttcttcacttgcccctttgccatcaattgctagaactatcttggaatcaactggctcacaaaccaggacttcatgatcatgataatctctgcatgaagaagtttcggccacccctttttttatagaaaccattgttgtggatctttggaatatttggaaaagaagcaatgatttcatttacagcagctgtcagccttctttccacacttggaaatctctttttagagaagattttactctacttttgcatagagtaaaagctcaggaccgacccttctgactgttttcccgtaaaaaaaaagaaaaagagttaaaaccttgtgttagaacacaacctaaagttgtaatgttgtggcatctccgtaagtttataagcgaaagcccagcctatttaggcaccatggagttcaagttcgccgagatcgtcaatgcagtggaggcaaccatccaggttcgagtcaccgaaggatcaagggacttcagagcacggttcttcgttcgcacagcggagcatcgatgaagatttcgtgctacttaattgattctaaggacgagaagaatgtcatcgttgacgatgatgatgatggcctcatcttgtttcagcgatctgttgcagtggtggagaatagggggaattgaggctgttcatgatgaggttgaagaaggtggtggtgctactgctagctagtccggtgaccatggagtacccgttcaatcctaggacagctttgaggagcaagctagggtgggtttgaccttggtttttgcaagatggatatcacggttgctacttgattggtctatgcttccatagcttaatttaccatgcatgcagtgacgaaccctgaataaaaattaccgagggttcaatacatattaattatttaattattgattaatatattaattaatataatgtaatttagataggatttgaataatctatccagggtcctgtgactccgccgggtagtataacgtagacacgcccctgcgtgcatggctgatgctcgatgcaaag

SEQ ID NO: 20150 - DNA, 1136 bp, Oryza sativa
ccccctagccacctcagcatcgccccgccacgtcggcggtgggacggcgccaaagaggctggcgccatcctgttgaacgatggcgccagccactctggcgccccaaaaaggactatttttaggataagtttttctagagatctacttgcgaaataagtttttcaaaaggaccaaaatgtgaaaaatccaggagatcgaattgcatatgagaggcagagagggttagttaattaattgattagcaatagatcagctcagcatgaaagagaaaaggaagggaaaaataagttctgaatatacctcccatttgatcaaatagctatgataactcgagctctgatctgcttgatcagtatctggagatggaattatgaatggcgcctcgatgctcgcgctcgctagctcgtgatcgtagctaggaaagaatgtccccccttatatactgcaagatggcgtgacttcttcctcttgtcaatgagacacttcaatcggttaaccagtaatcacgagatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacag

SEQ ID NO: 20151 - DNA, 1501 bp, Oryza sativa
gatggcataatagggtttcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaacgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatcccataaatgtgctaaggtttctaagcagggctaagcaattatatctaatatttagttgaaccaatataaataaagctcaactagtcaaattataacccaaggtatcaaggaataaagtaatcaagaacaaaagggctataacaaacaataggttaattccacctaatgacattcgaaaataaatgcaatagttgaaaagaaacaatagctttaaatatgatcaacatgctcaaagggttgtttgggatctgtgtgacttgccttgctggccttggaactcttcaagctcttctccggcgaaaacggactctccgaaaacgatggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttgaagattaaatcggattaaaacacttaaatcggttaaaattgaattatgacgcaataatgaattatttttgaaaaggaaaagagggattattgcgtcagcggctagggtttcggtggaccgggcgcatgggcggcggttcacgcgaacggacggccgagatcgatccaatccaaaacggacggccgagatcgaacggtccacgaccggctcacggcggacgaccccga

SEQ ID NO: 20152 - DNA, 1501 bp, Oryza sativa
cttatgttttttaatgttttcaaaaaaaaataaatatgacgaacaatcaaagttgaacatagaaactcatggttgtgtttaaaatgggacgaatggagtatttagttactgcccttcatatggttgtgtttaaaatgggacgaatggagtatttagttactgcccttcatgtgcaactgaatttaccagtaaaggttattttactagtactgtttagaacatgatgacaattagttcatttgaagacttatttaccttaatttgaggatcatttgttggaactacgcgtggctctgtttattactctatttcgcattataaaacgcgttgggctctcatctcgtttagatttattaacatccaatataaattagatagatatatgaaatatgaatctattcaaaacctaaaatgtcttatactgtgaaacacaacaacgaaacaaaggaagtagattttcttcatgttttatctttaggcgtgtaatgctaacattttaccttttctttttaatttaaacaatgcagataaatggggcgtacccagtgaactctctctttcctagtcagtgagcttatgtgttctccccttctttcattcatgtcatgattctgtgtaaatggatttcagcttgtagcagaattttacaggtatttcactcaaacaagtttacacgcaacgctagtacttggaatttgtttttctttaatggtagctaggatagtaatccgtttgtaatactccctctgtaccatatttctagctatgaatatggattcatagctaaaagttgttgtattttaggacagaatagtaatattcagaaattgcaaaaaccgcacaaggtatgaatgtttcttatattgtttaatctttagtaggtatgcaggctctctgtggagtgaatatgttggatatatttgaattcccttccatgttctaattgcactttggtttttctttgtttggcaggtgttcaatctcactactgctcactaaactgcatggaaaatgattaagccaccaactaaattacattctctatagtctaacaatgggaagaactattagcttttgttcgtgggtttaccatggatatatatatttggatgagttttggctgcacaaatggcaacattctacctgattgttattgtttattgtgaaataaaagataaataagcaataaagatagtgatttattgtttttcaatgggccttgaaaactgtgagggtctcacagtggggcagccatttcagccttgaccattctgtctactttgggcctttttggcaaatgggttagacaaatgattttcctagccatccattatccatcctcatttcattgtaaacctttacccattttcctatcccgatcttactcttcttatcccatatctaaacaaacccttcaagtcaagggttccttaagcatgacacatagggcatgaacgctttccccttagcttgtcggcccatgtgctttctccccccacac

SEQ ID NO: 20153 - DNA, 1501 bp, Oryza sativa
ctcggtcttttcggttcggtctttttctgcccacctctactagtcggttggttttgtgtaacatcccgggttatatctatagtcttagttgtcctaatgacttggtcacactagctgatagcggtgttgatcgaaccatgatgctaactaggacttattaatgtattgaattgtagtttctgttttggatttcttggcttatttatgttggtatttcttatgttcacagataaatccgcaaattcacggataccactatagtacttccccttagagtattccaatggtatcgaacaaaattcaatccaaggacaacaactgatgatagattgggtagagataattcctctatcttttaattagctacttaaattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcacttttcgtggagcacacaacaaacaaagaaaatttctaacctagacaccacacctatgttattaattactactctaaccttgcgcaataacttcccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcactcctccataaaattctcggaggtactccaacagccaacatactaaagtaatgtctaaaagtgagttgcactctattttgttgtgcaagttgaagtgtgtatgaactccttttatagtgtgccaatgacaatcggaactattggaagggcggttattgtgaacaacggaattttgcatcaagatcgaagaataataaaacctagatttatcaaatatataatttccagatgtaggtcaatttacttaaatatttaattgaaacttattattactcgcaaagtagataaactaatattggctatgatagtttaaatcgtaatcattagcaatctaaatttattaatcacaatctagatagatcggacctaactaagacattgtagggaaagtaatgaaggcagcagcttgacctattctgacaaaatctatgtattagccgatacagtagattaaattatgataagcaaataacttatcagctaaaactccgataaaactatattgaatacctatcagtttgagtaaatatagttaatatgttataacctagaagattggactcaaccaagatggttctagattaataacaagtttagtatatttaaacgggtcgatcgatacttttgatagtgt

SEQ ID NO: 20154 - DNA, 1501 bp, Oryza sativa
  unsure (1)..(1501): unsure at all n locations
tgcacataaccaaaacatacaccaaccaatttcgaagaaaacaagtacaagaagcattaaggaccatcaattctagaactagatcgtcacccatgtccctaggtaaaacacacccttatcacatgctccaagcgtagacacgccacaataaccatatcctgtgatgacctgcataggcgaaggaataacttttttgtagaaaccatatgacgtgtttaattgcctccttaatgtgacgaaaacaaaaaatttgattgccttgccaattacgtttagatatattgttcttagttaacacaactccacaacaaagataccgaaggaaaatctttaccttcagaggcacttttagtttccagatgcgtctatttatacctgggatgtcattatggagtagtgcaagggaatgatacttcacaatgaactgtctataagaagtcaagttctatcgaaactcatcttgctcatgaattagatgaatatcggtaatacggtaataagttagtccatgctactaatttgatctaattagatcccttcttcaagaaaaaaaatggaatatccattcgatatgacatctgcaacagtcgcctatttatgcctagcattatttgtagggacactgatactattttcatttatagatatgttccaaccatttatcgtcctgtaaccaaatataagggccatccttaattacaaaggattcgaactgaaaggacatgccttgccaccttcactagggtaaccaaaaaatgtgagtcccctgcttttcattgaactcgcaagcgggttgtgaacataaatacctatgtccatagttaattatgcgcattactcaaaacaacngctatatttttaaatttgggccctaaccgttttgaaccacccccctgaatagctactgttttagtaggttatgtttttaatatccagatcatgaatccctaaaccctctagtcaataggcccgcacaatatgtcccatttgacaagaagatatttctttttatgaccgtcacttcgccaataagacatagatcgaaaatagtcaggctttttttaatccagacaagagaacgtactggttatgaagtcccataaagccttttatccataggcatgggcttgctctacacaatctgatacaacctaaaaggaaatgcattgtaggaagggtgaatagctaatttaatccctcaagtttcaccgaaggctcaatttggtccttcaggtttcattttgtccacatagttcctctaaatatttgttttggcctaaaatcatccttgggcccacttaatatgccatatggctatttttagtcaacaattatgttagaaaatgtcccttttgcccttaattgtatacagctatagactagaaaaaaaaaaccaaaatgaacaaacaacattacatatgtacttcccattatttcaacatgtgcacatgaaaattaagcctaatggctattgtatacacttggaagtacataatttatt

SEQ ID NO: 20155 - DNA, 1501 bp, Oryza sativa
ctcggtcttttcggttcggtctttttctgcccacctctactagtcggtttggttttgtgtaacatcccgggttttatctatagtcttagttgtcctaatgacttggtcacactagctgatagcggtgttgatcgaaccatgatgctaactaggacttattaatgtattgaattgtagtttctgttttggatttcttggcttatttatgttggtatttcttatgttcacagataaatccgcaaattcacggataccactatagtacttccccttagagtattccaatggtatcgaacaaaattcaatccaaggacaacaactgatgatagattgggtagagataattcctctatcttttaattagctacttaaattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcactttccgtggagcacacaacaaacaaagaaaatttctaacctagacaccacacctatgttattaattactactctaaccttgcgcaataacttccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcactcctccataaaattctcggaggtactccaacagccaacatactaaagtaatgtctaaaagtgagttgcactctattttgttgtgcaagttgaagtgtgtatgaactccttttatagtgtgccaatgacaatcggaactattggaagggcggttattgtgaacaacggaattttgcatcaagatcgaagaataataaaacctagatttatcaaatatataatttccagatgtaggtcaatttacttaaatatttaattgaaacttattattactcgcaaagtagataaactaatattggctatgatagtttaaatcgtaatcattagcaatctaaatttattaatcacaatctagatagatcggacctaactaagacattgtagggaaagtaatgaaggcagcagcttgacctattctgacaaaatctatgtattagccgatacagtagattaaattatgataagcaaataacttatcagctaaaactccgataaaactatattgaatacctatcagtttgagtaaatatagttaatatgttataacctagaagattggactcaaccaagatggttctagattaataacaagtttagtatatttaaacgggtcgatcgatacttttgatagtgt

SEQ ID NO: 20156 - DNA, 1501 bp, Oryza sativa; identical to SEQ ID NO: 20152

SEQ ID NO: 20157 - DNA, 1501 bp, Oryza sativa; identical to SEQ ID NO: 19895

SEQ ID NO: 20158 - DNA, 1501 bp, Oryza sativa
tagagatttggtgaatggcggtgacctcgtgctgcacggcgctggttgatcatgtcgcgaaggtcgacaggacgctggtgaagtggagagcgaggccgttcgactcggcgctccctgtgacgttcgggaggcgagtgaacagatcgttcgtcgtgacccctgctcctgcggctagatcctgtgccgatgatgctgaggcttggctgatgataatcatgagatcggagatgagggactcggctaccagtcggagtgcgggtgcttgcggagttggctggaaccgaggcagcgatcatggtcttcatctggttcaagatgttgacaacatgatcagcttggttgagtgcgtcttccttgaggagggtgtcgaggagagtgattgctgcaaccgcgttctgctggggggtgtgaaagaccgctgttccatcgacgtcttgttgcccaatgagctctctcgctcgccgcccagattccaaggcgcgttgtcgtcgatcttcagcctcctttgcaatctgttcgtgatcttgttgctcacgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagattggatcggggccgaagccggagctcgcctagatcttcgagtgggagatgtcttggcagtgaagacggcggccaaatcatcaggaagtttcatcaagattgagggataggacccgtcgtcttgatctggacgaggccgagcggattggatctcgtccaagtggtttgaagccgactcgggagagatgatcttagagtaggccgagttcggaataccgaatggcacggggacctggtctctccccgactggtttgaatccgagtcaaggagagagatcttgccgaagtcgttggtgatgaagttgaggctgccgaaccggaacgcctgcccgagagggaaggcgaagtcgtcgatgccagaaacaaagcccatcgcacttagtcggcgagaacttgacgctacccctacctggcacgccaactgttgaaacaagatttcggcaataataaaaggggtggctatcaagctaggaaagtggatgggtttggagacaagggattttatacaggttcaggccttcttattcaagaagtaataccctactcctgtccggggatgattccgccgagtgtgttattgattgtataaactggaaaaagaatcgcgccccaagaggcacacggacc

SEQ ID NO: 20159 - DNA, 1501 bp, Oryza sativa
tatgtaaattataggtgttctgtatagaaaaattttcccatcagaaatctttatgtttgttcatatgttaaatattttgttttgcttaagctccccgcggcaacgcgtggggttctgactagtataataaggtagttctgccactgatgaagcgctgcctgctcctgggccgtcgtcaccgggcttgcgaaccacaattgttaaggatgatgaaggtttggcattcttgcctgtgcctaacttgcagtgactgatcaacaccaaaacaatattcagattgtctacccatcaacgaaccatcctttcacctctggctctgtggaagccggatgaaattgagagagcaacatcgccggggctttgacaccattgcaacgctggtggcctggtcgatttggaaggagcgaaataaacggatcttcaatcagcagtccaagtcttggatcgaagtagcgaaagtaatggtggaagaagccgtactttggaagtcggcaaatgcaggggtcccttccatattatctctgcgaggtcgtggtagccaaatctagcgcgagatatcccgttagatcgctagtctccagtatcagtcccgtgcttgtttttcatttttcattgtaaataacttttatttctcttaatgaaaaaaaatgcgctccttgcgtattcctaaaaaaacaatattcagaaattgttcgacaggcaggtacagcatttcgtggttcagaaattcagagaaatgggctataccgttttggcgccagaagctttcctgtcatgtttcataggctacctcagcctgtactacgggttcgtatcatctgccattccaactggaatggcatagggctacagtgatccatgccattagccacttacatccgtcggatcaagcgtggacgtacgagatcaatcgatacagtaattccaataaaataaccgaacagtgatttttactgttcggtactgtagcaatggcaaaacactgtagcgctactcacgttttactgttcccctctgccatttacctcctaatggcagaggatgcgaacccctgtactaccgtcttctgcaaaaacaattaaacaaaacgaataagggctcaggtggttagggcctgtttggtagagtttaactcctaaatttaactacaggagttaggtatagagtggagttatggaatagtttgggtctatttggtacaactccaattagcccagccaaaaaatttcagttccacatgaaacacgagcggagttaggttgctactctactccagtccaagctcctgaagcgagttggagatttaccgaacatgccctaaagcgtataagcacagctcgcaagcagtaggcccactggaatcacggcccaacgaaccagccaccagaaaacgaccggcccacacaaaagggcccaaacacagacggcccacaagaagcagagccgaacaggcggcggctggcaaccgcaaatcgctcgccgcccatgtctcttcgcctcc

SEQ ID NO: 20160 - DNA, 329 bp, Oryza sativa
  unsure (1)..(329): unsure at all n locations
catgggaattantgctgtactngcngccngcatgncgactctagagggtccccatctgccaggggcttatattaattaattattactttaaataactttaaaataaattaatactatgatttttcagaatatttttaataattatttgaacaaagcacacttactatttagtactatgagtcttaatgggcgcatgaaaaacgaggaaatagaaaattttaaaagggcctctcgaacgtaaggggcatcacaaattaatccccaccatccgagctctatataaactgcagaaacctcctaccaaattccaaagcaactgaagctacaaa

SEQ ID NO: 20161 - DNA, 1501 bp, Oryza sativa
gaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttaga

SEQ ID NO: 20162 - DNA, 1501 bp, Oryza sativa
gtaccgaacagtaaaaatcactgttcggttattttattggaattactgtatcgattgatctcgtacgtccacgcttgatccgacggatgtaagtggctaatggcatggatcactgtagccctatgccattccagttggaatggcagatgatacgaacccgtagtacaggctgaggtagcctatgaaacatgacaggaaagcttctggcgccaaaacggtatagcccatttctctgaatttctgaaccacgaaatgctgtacctgcctgtcgaacaatttctgaatattgtttttttaggaatacgcaaggagcgcattttttttcattaagagaaataaaagttatttacaatgaaaaatgaaaaacaagcacgggactgatactggagactagcgatctaacgggatatctcgcgctagatttggctaccacgacctcgcagagataatatggaagggacccctgcatttgccgacttccaaagtacggcttcttccaccattactttcgctacttcgatccaagacttggactgctgattgaagatccgtttatttcgctccttccaaatcgaccaggccaccagcgttgcaatggtgtcaaagccccggcgatgttgctctctcaatttcatccggcttccacagagccagaggtgaaaggatggttcgttgatgggtagacaatctgaatattgttttggtgttgatcagtcactgcaagttaggcacaggcaagaatgccaaaccttcatcatccttaacaattgtggttcgcaagcccggtgacgacggcccaggagcaggcagcgcttcatcagtggcagaactaccttattatactagtcagaaccccacgcgttgccgcggggagcttaagcaaaacaaaatatttaacatatgaacaaacataaagatttctgatgggaaaatttttctatacagaacacctataatttacatagacaaaagtgtattcgagaaatattccatcctataaacctagaagataaatacctaagtagaaaaaacatggaggtgacatgattttaattggaagtacaaacatgacaaagtatgacaaatacaggtgattggctgcaagtctatgatgaacaatggactatctatgctcaattggctgttaacctaggtagcttgattccatctatgattttattaccagtattgactctcttactatgtgacgttgagttaaaagacagatcagatttcttgcaaactcatcatcactgacatcaatttgtagccagcacactctgaataatcgacaaatataagaattaatcttaatgatttgtttttgatatggtgtataatacaaataaagagcatcttcacatgattcttcgtgaactaaagcatcagatgaatttagaataagaaatgtcatatatgaagggcaatatgtacttttatgaatgataatttcatccttgaatagagcaatagatcatttacaaacaaatagaatgtcaac

SEQ ID NO: 20163 - DNA, 1501 bp, Oryza sativa
gtcgtttgcgagattcgtcaacacacaaccaggtctccgacgccaatctgttgcttttttttttgcgccgccgatcgtccgtgactctcaagctcgttcctcgccatgaaaattttttaaggtaccttatgtatgtatcgatgatttttcgttttcaaaggtattttactgatctgggagcgtaacatatgttctgtcgcgcttccgtgttgtacgtagcttcgtcgccacgcgcggctcgccgccgccggtcgtctttgagattcgtcgtcaccgccgccggcatcggtcatccacgatcgcgcagccttgtcatcgtgtgcttcgtcgccatgcaccgccatcaccagtcgtcggcgaggttcgtcaccactgtcggcgccggtcgtccacgatatgatgttcgtcgttaaccccgttactttcaatttgaattatttgattcatatgtatgtatgtatatatatgtatatgtatatatatgtatatatgtatatgtatatgtatgtatatgtatatatatatatgtatatatatatacatatatatgtatatatatatatatacatatatatgtatatatatatatagtagtactcattttccaaaaatacagctagccaccgcgtgatgtgtacttacgagacttttgaatttgaccaacactatatcttagcctctttgtttcaacttaaaaactattatagtttagattatttagtcaaattactataagttgtattataataagatatcgtataataagtatgaggtatttgtttctctggattattggagacatggattattgggttttgaaaagctaatgtctataatgacctcagctattttggatgccttgatcatccttttgtcaccatatacaacaaatacataatttgaaatagctaaaaaatattaccatatattaataaataaaacattcatgcatattttttttacaataggctgaacacaaaattattatctcttagccaagagagtatagggttggagcttggggaaggattcacgcgtggggtggggtggggtggggggcttggggaaggattcgcacgtgactggggagagaggaagcagatgtgcgtgcgcttgagggagagaggaagcggatgtgctcgacctgttgggtttgatggcgctagttggtaatttgtataaaatttttaggggtggtgggtctttaaccacccaataatctgaaaaaagcatgtttagaggagattgccagattatactaatctggcttatagattataataatctatcataataatctacatgtttatttctgattacggataataatatagactataataatccaagctaaaacaaatcaggctgacggttcataattaacaaataaaggatatactctagcataaaattataaaattagatttacttttcgtaaatatatgtttgctacaaataattatcattgggtcggtatctttaccacaagttgcaatctact

SEQ ID NO: 20164 - DNA, 1501 bp, Oryza sativa
ctgttgtttttgcaattgattttatttgaactcttttctgaaatcaactaagtgagtgcttctcaaacgacacggatgagacagtgcgtctcgtccggtcggagtatgtgcaatgtatcagtcttttgaattgattcaaggttggcacccggccaacaactttcaaacggccacccgggccaacaacttttaaacggccacccgggccaacaaccttcaaacggccacccgggcctagctgatcccatcagctgcagattttccaaacatcgatcccctttccacaacagcaaatttcacaaggcagtagtcaaacaaaactacgctaggaatcacctcacatccgcccatgaccgtgggcacggctgttcgaacagtttgttaacctctgcagaggtggtacactttacccacacgacattactaacccggatcacctagcttatggggatcagccacgtcgggagacctccaagctttcatgacaaggcatttcgaaagccgacacaggtttaccatatgccgacgagaggggtcccagaccaacaacaggttaggtcccagaccatactgtgccaggaagcccgggggtcctccccgacaccaccccggcgaatccacatgtctctcggcatcaaggctcccctgataagctagttactcagccaggggtgtcccattccacccatgtggtcgtacttgtcctatgttcggatgaaattccaaggaaacggtccttaagtgcaagagcgggaaaccgtacacccggtacgttccccggtccgcggttttggaaattcatttagttcacaagcaccgacccaggtgtcgggttttccaagtcttttgtaaaacccaagttttacccaagaagttactcagattttaagtttgaaggcgaccgtcgatactcgtgcagagtgcacgattttcgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatattttttcaagcaacataattaagttcaaatataggctcaagatgttcaagggtggcttgcctcgctcgagatcttgagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaagttgaacggagtcaaacggatttacggttggaagatattgaatttctaagattattagatttttggtctaaaggaaaaatgatttatttaaatcctttttgaaaaagaaaaagaaaagaaaagaaggagggagggaaatcagactttcctcgggcggctagggcgcggcccgagaggaaggggcggctcggccgagctaaa

SEQ ID NO: 20165 - DNA, 1501 bp, Oryza sativa
tcatgtttaggcgggagtcatgaatatagttgtaatgtaaataaatacatcgtttttatattaaccgataacccaaatgtaatatatcctacaataatagattacaatatataagcttctttaaaatctagggaacattaaaaaaaacacttaggaacattcatgcattataaaatcatgtacttccttcatttcatattataagatttcttatatatatatctagattcattaacatatatataaatgtgagcaatgctaggaagtcttataatatgaaatagaggaagtagatttcaaaacgctagagtactatagttgatatgtctatatggttcaaagcaaataaatataaacaattctctactctaattgcgattatggatttggtttattacttatattttctcggatgagtgtgacattgcctttgactatttttctagctatggtatgccatgttcaatatctataattgcatatattgcataaatggaaaacccacgggtactcaaacggcatgtgcatgtgttctatttacagttgataagtgtattgtgtataggccaaacaagtaattttaggtctcaaattaagcatattcttgctccgcagaggttgatccaattcatcgccaacatcagatatggttcaaatcatagctaccaacacccaacagataccccatttccatattaagtgcatcaatattacttatagccattggatagttatcataaggtagcaactgtttaagttagatttattatttatttaagttattttcactttggaacactttcaatcccgttttggacaactctttaattaatattttcattctagaccaaacaattttacatgatgacactttgaccaccctcaacacttttatctatctatatgttcttttaatacatcaaagaaatattctagatatagttatgggagtttagagacgaataactgacgtaatcaaaatcatttatatgcttgataagagcattggtgtggttaaaagaaaagcaagattagccggctaaaaacttaagttagaccaaaataaaattacgagttgtcagtgctgtgcctatatgtgcacgcgtgctattatcttaaaaagaaatgtgcacgcgtgtgggagccattttaatcattttaataaggaaaaaaaaaggagagaagaaagtaacaatcccgctattattacgtcatatttccgcccaaccatgagcccatttcattttcctcctcctcgcctcggtctcctctcctctcctctcccaaatcgaagccgcctcctcctccgcctccgccgccctcctcgccgccgcgtggatccatctcatcccctcgccgccgaaaccctagacccgcgcttccatggtggtatgaccggttggcctcgcgattggggggtgggaagccggtgcggtggtggtggtggttagggtagcagaggcattcggcgggcgatcgccgtgaagcgggtgtgtgtggg

SEQ ID NO: 20166 - DNA, 1501 bp, Oryza sativa
tatagtttccaagtgcaagattgaaacaatgcttttcttcctcaaagaataacaccatactaagtcaattcaacacaaatgtttcaccacaacaattttttaccttttgatagtgggcccaacgaaaataatgtatcatgttttaacaaattaagctaaacttttttgtgtcgcaagtatattccgatttttcgcataggcgtgttttataacttaatatatcattgtcgtgcgatgacgagttaggccatgagattttttttttgggatttaaaattatttagttaatcatttctataacttaaattaatgtgcaaatcatttctaggttgctgtcgacctggtggcctagcccaactgcgagactaagtttatgacaaggtttgtagagcttgtaaaaggacacatatgtgttgacagtccttaaatcttaatatctaaccgtcaatacctgcatataataaaattaaatatggtatccaacttagtggtaggtattattactaatcattttcactagtatttgtgaaatatgtgtatgcaggtattttgagaagaaaacacatccgtcaagcgacaaactgcacccccgcgctttcaggacacatttacacgaattggaggtcccataagtcaattaaacaactccaaatgggcccaagtatcatgccaatgggccgagggcctcaaaaatagtgtccatgacgaaaaaagggccgaacggagccgtcccgggttcggtcgaacctccagttcggacgaaccgttttgctggccgttgatcgtcaaattttgcatggacggccctgatcacatcctaatggcggttccagggtagtttggtcatttcgcataggctgtaaccgtcatacctgcctataaaaggaggagctcactctcatttccaacacacaactttgagctgaattacaagaggctctattgtatcttttgtacattagaataaggtagagagtgaggggaagctctggaggagtgcccggaagtttggcgctcatccgactttgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcaga

SEQ ID NO: 20167 - DNA, 1501 bp, Oryza sativa
ggagtatatgcgagcgcgagagtaacgttcaaggccgaaggaggaatgtcgaaacaagatttcggcaataataaaagggagtggctatcaagctaggaaagtggatgggtttggagacaagggattttatacaggttcaggccttcttattcaagaagtaataccctactcctgtccggggatgattccgccgagtgtgttattgattgtataaactggaaaaagaatcgcgccccaagaggcacacggaccctccttatataggggaaggagtccgctttacaaaatacagtccatatcctaacagaatatgggattatagataaaatacaatcgtaaccgactaggatcccgggtatttccttgatatacaagttaaaaaccaacccgagtcctcataaagatattccatctatatttggtaccgtatattcgactaaagtataactgtcatgcagatatggggtatccataatctccacagtagcccccgagaccttcgcagttgacgaaataaccttctcgaaacaaaaaacagtagtccgagtgcttcaattcaacttgctccagcttgccgagtactagaaatcaaaaactgtgaagggcgaaaataaaacatggtgcatcgagtagatgcacctaattaggtgtagcccccgactatgtgattagttgaaaaactaaacatatagtcaagaaccgagtagttttatagcgaagcatgcatggtacttagtacgatacccagctgactgctgctcaacttgaacatatcaaggacaaaaaatacaagaagggccgagcgataaacactcaaaggtccaaaaatagacatgtttgataggaatccgagtaaaaatctcatagaatgacccaccaaacatgatagaaaatcatggtaattaatgagtctaatagcctaggctgtgacccttaccataaccaaaataagcatataacatgctaaaagaatgactattaataaaccagtcatctcaaatcaacccaatcagcttttccagcctaataaagcttacaaaaaatggtataacacctttctgtcgggcacctttttatgtgcatcataataattccaaagaattattaaatcgcgttaaaaaggattttaacagcattaggccacaccattgtgaacataaattaccaaagcaaaaagtgcctaagtccctagggatcacaacaggccacgctgattatagtattgggctgaaatactatacaggcccaggcccattagtactcccgataccctaataataccgaagtgaaaaacgtctcttcgtcttccccgccgagactctcgccattttccccatttcctgctacagtgcaaaactgcgccgggcaaactagggttcatcaatccgctcaaatccaccctcaaaaacttcacgaaatttctccccgcatccatcgctccgattccccatccctttccagccgtatctcaaactaaatcaaaccatccagttcacattca

SEQ ID NO: 20168 - DNA, 444 bp, Oryza sativa
tttttataattcctgtttcatctaacacattacaaatgtcggtcttatgagcgagatctttaatttttagcattttctttgggttccctgtgccttcaagagaataggttcgtttgtctctccattcctgacgtggcaagccttcgttggctggaagtaggatcttcacagcgccagccccacaaatgaaagagcccaccaccacacgccggggaaggagtggcacctgggcgtgccacgtcgacgtccagctcagcatcaccatagccccaagccaccaatgggaggccacgccttatccaatcctcttatcctcctctgccccccttgctctgcgatagataacactgtcccgccctcacaaaacgcccttcacgatacaacccacacggacacggccacaccacccaccaactgagagctgagcaggcgagcgagcggaca

SEQ ID NO: 20169 - DNA, 1501 bp, Oryza sativa
cacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcga

SEQ ID NO: 20170 - DNA, 1501 bp, Oryza sativa
gtatcgggagtactaatgggcctgggcctgtatagtatttcagcccaatactataatcagcgtggcctgttgtgatccctagggacttaggcactttttgctttggtaatttatgttcacaatggtgtggcctaatgctgttaaaatcctttttaacgcgatttaataattctttggaattattatgatgcacataaaaaggtgcccgacagaaaggtgttataccattttttgtaagctttattaggctggaaaagctgattgggttgatttgagatgactggtttattaatagtcattcttttagcatgttatatgcttattttggttatggtaagggtcacagcctaggctattagactcattaattaccatgattttctatcatgtttggtgggtcattctatgagatttttactcggattcctatcaaacatgtctatttttggacctttgagtgtttatcgctcggcccttcttgtattttttgtccttgatatgttcaagttgagcagcagtcagctgggtatcgtactaagtaccatgcatgcttcgctataaaactactcggttcttgactatatgtttagtttttcaactaatcacatagtcgggggctacacctaattaggtgcatctactcgatgcaccatgttttattttcgcccttcacagtttttgatttctagtactcggcaagctggagcaagttgaattgaagcactcggactactgttttttgtttcgagaaggttatttcgtcaactgcgaaggtctcgggggctactgtggagattatggataccccatatctgcatgacagttatactttagtcgaatatacggtaccaaatatagatggaatatctttatgaggactcgggttggtttttaacttgtatatcaaggaaatacccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccactcccttttattattgccgaaatcttgtttcgacattcctccttcggccttgaacgttactctcgcgctcgcatatactccgtcaaaggagcgaacaaaagtacgacaagttcttcagttcttcccgtctcttgcacttctgtgcatatactccgccaaaggagcaaacagaagtacaataagttcttcagttcttcctgtctcttgcacttctgttccacctccggcctctgttcctacgctgcaagattcttcctcggttccgttcacctgtgtgcacaggtgtacgggattcttccccgtttccattca

SEQ ID NO: 20171 - DNA, 1501 bp, Oryza sativa
taaatctttagtttttgtgacccactaccaacagtgaatcgacgattctcagcttcgacgattctcagcccagaaagcctgctacagtactacaggacctcacccttcatgcaccgtccgggacgatgtccacgggttcatcgatccatccgtctacgcctcatagccgcatcaccccgatcccctccgtcatcgctcctaaccaatcagcgcacccatcgtcccaaaatccccaaatcttcatcgcctcctcgtgaggttcgtcggcgccgacaccgccttcttgcggagcctgcggccagcgtcgccgctttcttgtcgagtttctagagagaccgaagacatcgacggcatttgtaaatttttggcgtttacaatttgtcctcaactggttgtcgcgatccctatctatattctatccacagcagagcaagaagctgatccggactgcctgccgtacgtcgcccggccggctgtcgcggccttgtccagctgtgagagacgcacaccgcgcacccaccggcgcccccaatggaccccgcggatccggtcgctgtcagcctcctccgcaatccaaatgtccaattgacgcaccacctcgatccgtaccgtcgattgcaccagtaatccgcaattccgcatcatgccgtacaaggggagctgtacgtcggaagcgagaggccatcggcgggcattaaacaatgggcatttgtttgggttggagggggttttgagagagggaatgggttaggtgagtgctgttcctgcccccaagccgacgactttcgtcctcgatgcttgcgtcgcatctcgaatacaccgagtgtacgttgggagaagtacagatatgcagagggatcgcggagttgacccgtattgcatgcaggcagctgctgcttttcttgcggcaaccggagctggtgctggcctcgccaggttcaggttaatggtcaaccaccaccaccactagttgcgctactgagacagagcaatggaggagggggcgaagatcgggagggagcacgagcagcagcagcagcagcacgggagggtgaacggtagcgggagggtcgcggccgtcggtggcggcagcggcggtggcggggacgagattgagattgaggtcgccgcagccgcaggggcttcgccgtcgcggcaacacggcggtctgcacggcgatgtccaggttagtttgttcttcttcctttcttcctcctctgctaggctgcctgctgtcaatttcttcttctctcctgctgtccgcacaagtaggaagcaaaccatgtgtagcacgattgcctcagccaattcagacatctgaggaatatccgtttgattgatttctgaaatgaatatgtacggttgatgatctctatgtactctgctttgtaaaattagcacagacttttcctcaaacggggatagaaacaggcactaatcaaaatttctgataacaatgaggacttttggctttgctagaatattttgtataggaaatctg

SEQ ID NO: 20172 - DNA, 1501 bp, Oryza sativa
atggtcacaacataaaaaaataaatgtggtatggtaacataataaattaatcatgtcatactgccataggaaaaataaaaaccggttcgatactttaaaacctgccaccggttcaccggttcaagcaaaaaccggccggttcacggttttttacttgttcgattgcaggggcggtcttttagcagaactgagccgtcaaggtggtcggctctggtttattcctggttcaaccgccggtccggtccggttttttgtactatgactgacggtctagtaccagataagactctgagtgaaacttgcttgtataagccttgcttcaaggcgtaatccattgttcaagttgtgagtaagtgtagcttggagttttaggtggatattcaaccttaattggtctccatcgaaccgctggtatataaacaatacattgaaaaaggcaaatttcagtgggttttttagatttggtggggggttgttggaattaatagatgggccttagcccattcgaagattaattcattggaaaatcagaaaagcccacctcataggatggcatgcatggggagtttagtaccaccttgctcattctaggagaggaagatctccttataaggaaggatactcttctagctacttgaggcatgtgaggtggagagaacaaggggaacacacgcgcgcactcgctcgcctggcctgtcctagcgaggcggtgcgcgtgcacaacgtacggtgtcagatggtttgtcaaaattggttccttacccttacgtagatgtggtctcctttttgcagttttgttttgctgcagtaaattctgttttgttttttgtaaacacttcgaatatccggtgcgtgaaatggcgtggagtccagataagttatacatgacttaaccggtttggttacacgaagtggagatcgggcatgcgccttgatcaagcgtcctaacatgaatgggtacgataagcaattttttggtggtggaggcgttggtggggaggagacactagacaccggatgctcggcatcggtggcggatgcgacggctgattgaggggaagtgctaagtttagtcaactttaaaggatgattttacccctccgtaactttttttaacaattatgcccctaaatatttctactacagttaagtgggatggtggtagaaaaaaaaatctgaacgcttcagataatgattcagattgttttcaactattatcaatatagggcaccgagatcatattaaatctttagtttttgtgacccactaccaacagtgaatcgacgattctcagcttcgacgattctcagcccagaaagcctgctacagtactacaggacctcacccttcatgcaccgtccgggacgatgtccacgggttcatcgatccatccgtctacgcctcatagccgcatcaccccgatcccctccgtcatcgctcctaaccaatcagcgcacccatcgtcccaaaatccccaaatcttcatcgcctcctcgtgagg

SEQ ID NO: 20173 - DNA, 1501 bp, Oryza sativa
gaataattactccctctatcccataatataagacgtgctcacattctaaggtttaactttgaccactaattattgtaatataaattaaattttatttgctaaattaataccattggattgacatttaaatttactttaagatagttataattttgttacaataaaccttatagtatatgagaattataagtcaaaaattagttttgaagattgtgccaaatttgaccatgtcttatattatgggatggagggaatatattttaccatttaaattttatctaaaaatattgtatttgtaataaggtgaaacttatccaattagtttgacggagatatcatgtcttctgccctcccttttttatatccccatgtgtcttacctttagttctatgtatgtagagttattatgatcatttgtgtgtactgataatatgtctgaattttcaaaaaaaaattattattttttgggacaaagggattatggtcttatgcttatatgacgtggttgaagtttgatgtttaaattaatcaaactaaaacaattatgatgaaattaatcagtagttctgctctttttttccctaataatttaccactacacctcataaaaattacttaactcaaatcatacaattttttttctattcaaactttattaagtttgaccaaatttatagaacaatttagcaacgtctaaaacatcaaattcattttattaaatctagcatggaatatatttaatttaataatatatttgttttgtgttgaaaatgctaatatatttttctataaacttgatcaaagttaaataagtttgacacgacttataatattaaaaggatggagtagtataaatggagtggaatagctagtgagtacttcctccgtcccaaagaaaagcaatataggaggggtcacacctcttagtacaatgattctggataaaccccctcctgctacaacgaaacccctcacatctcctcttagattgcctagtcaactagtggtattcatttttccaacgaaacccctcacatcccctcttagattgtctagtcaactagtggtattcatttttccaaaaatataggtagctatcacgtgaagtatacgtatgggcagacttttgaatttgaccaacattatcttttagacacaaattaatgaaaacaatataaattatataattagatttatctccataaatacgtgttttcatgtcccatctcgtcatctctatcgatgtgttcgatgactggactgatttagagcattattattacataaattactgtagcagaaagtagtagactgagtgattattaatcattttattaatttattgaagctaactaattaattaatgaattaatcaagcacgccattatgataatacgcaccgtcatcctgatctccgtccttgggttggttccgctctgcggcttgaagggcttgtcgtcggagaagacccacagccgcctcaccgtgccgtcgaagctgt

SEQ ID NO: 20174 - DNA, 1501 bp, Oryza sativa
ggtattgtcacagcctctattcgggtactttccagtatcgcgacgcatggtagacatgatgttgaggctgtgtcttatgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcaatgttgattaaaatttctgattaattactccactgttttacttctcctaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttctgggcgtgacattattgcactttctagccataatagaagccatgtcttcaattaagcttagcggcttaaatcttttacctcatttgccgcacacgtatatgttggtatttcttaacgtcattactagaaatatgaattccttgcaatggcgccgaaatacttatggtatactatggttacagatttcatccgcaagcgcacggatataccattgtagtatttcacccgagagtattccaaagtgttgacggaaaacacgaggcctgggagatctgcttaactccagtgcaggtccaaaactcgccttcgggtatgctagcgtgccagttgatttgatcctgcaatcaacaagaaataacgacaaggaaaccgcggttaaacctataaacgatagccgatcggctaagtaccgatgacatatcatttatctttgagccgatgtcatatatatatatatcgatcgacagtcataaataaataagaaagaactaaatctactcgatcagctgtagatattaacgatatatactcctcatatcgatatatatttaaatcaagtgattgggatagatcggtcgccatgccgagacagtataaatcacttagatcgaaatatatattaataataggactatatatgttcatagcatagccaatcagatagatctagcatgtatcggctaatactccgataccgctctatactaagatgttaaagcaagtagaatatatcaaacaaaggcctaatatacttaaatgcaacaaga

SEQ ID NO: 20175 - DNA, 1501 bp, Oryza sativa
tgaaaaaattagcacaacacctcttcacaaggtaaatgttcccctactctgtttcaagcttaagatgtattttcgttacctatttaggtattcaccctcttgagatgagttctaaaatttgtttgtatattttttccttcgatgttacacatgatgccaatatagtatatatatgtaatcaataaaattatacatgatccaattttttatcttcctaggcatataaaatgattaaggctacatcttgaagatatggcagctttaatgtatatacttctccaaaacaagttttcagccttttgtacttagaatgaagtagcaccattaattttgatgttttgcaaagtaaattatgccttttggtaagcattttttatatggtcaagcaatctttgaaatgtaaagtgcaggtaatgctgcatacctaggacttgaaataaattcagattcaaagtattcacttttaggtccaagattagatttatccagattcaaattatccagtttcttttaatagtcacaggaaacggggtcggtggcagcgatcctcgacccgggaacgccgtccccgtcccgaaaacatggggtcattttcgtccccaccttgtaaaaaactctctcaagtagcgtatcacgttcctcgaccccgtttctcgatcccatcgacccaggaactttgttactatactgctgccataacaattaaaagaaaagagaaaattcaaatgtgttttcatcagttgacctagtgcttgaagaaaacttgttaaaaaagtaaggaaatcttcgggacagtcatctcatttagaaaattgtagtacatgagaaaactaatgttcaagaaacttgaaaaaagttctggagaaaaaagaacttacatacttttagaaaaatgttgtttgtgctgccataacaactaaaagaacagagaaaattcaaatgtattttcatcagttgaccagaagctggtaactttaattagcctaagatttgcaagccacatttcagtagattgggaacgtgaagggcgctctttatttttttttttcaaaaggggatgcctttacttaaaagctttaatacatgattgattaaatattgatgaattgttcgatatgatttattatagtgattcatgttattatgagtaatagttagttttgttctcatttttataggtttattgatttttctttttctttttacttaaatttcttcagttttcttttgaaaaaccgtgatagttgaagtaatttacttatggttgctataaacactaccgtagtacctagaccatagtggtcgacaccgtcaagtggacaagcgctggaaggaaggcctgatgagaagattgtaacgtcccgcctcccccagaccaggcccacttacatctgataatttttataggtcatagactgccctcacagggccaacatatgtcttttctgcacacttttgtcctcactcgtgaacatgtcttttctgcacacttttgtcctca

SEQ ID NO: 20176 - DNA, 1501 bp, Oryza sativa
cgggcatgggtatgggtacagagttttgcccgctaactctagtgggtagggtttgggcaggcaatgtcgggtatcgggtcgggcatggttttactctacccgcgcccgacccgacccattgccatcatccctaatgatagatgtaattcatggctctttgatatgtagctctagcactctttaaaccgaaagtcattacaacccactcgaacaagccgattgcaccaggacacctaaaagctgtcttatggatatcttcttcggccataaagatttgattgtatcctgcattaccatccataaaactcaaaattttatgccccgaggcagcatcaaccagctgatcggctaccggcattaggtattcgtctttcggggtagctttatttaagtttcggaaatcaatgcacaccctgaccttgccgttcttcttgataataggaactatactagaaacccactcagcatatcggcaagaacaaataaaaccagcatcatataatcgtttaatttcagtcttgacaggttcaagcatatcggctttacatctcctcggaggttgctggtgtggcctaacccctggtttgataggtagccgatgttcaacaatcgatcggctgagtccaggcatctcataatactcctaagcgaagcaatatctgaattctttcaacagctctatcaacttggttctaaattctgcagataaattcttactaataaatgtcggccttggtcgatcacctagacctatatcaatttcttccaaatcatcggccgacgtaaaaccctgtccttgcttgtcattgagatcatctattgtgtccttgttgtagacatctgaaccctccaagacgccctcaaaataatagcttgggttctctatcttcaattggctatatatcagaatcggacacttttagaaaatctccatctcaaactattccagataaataatcaagaccatccatctcccaaagagctaaatcggcactggcaacattgactgacctgtcagctggcacgatttcaatcttgtcgccttgccactgaatcaagcattgatgcatggttgaaggaatacaacaattagcatgaatccaatcccttccaagcaacaattatgccgcgcagaaggggcgtgcgaggagcgacgccacgtcggattttgctatagtgctcgggtgtgtttttgaaaaaaagccctccggttttctttaattacgtataggcccctcacaaacagtgtttgtataggaaaaatcgtggacatgaatgtaaaaagtgaaaagaataggggctttttcgcaaaaaaacgcccacactacgtaaaagcatctccagcagtcttgctatctcactctccgagcaaaaatttagcaagtttggttcaaaattagacagactccaacagacttgctatttggatggccaagctatcagctggccaaaccggctccctgcctagccaaatttggccagtcaaaaccagcttgccatc

SEQ ID NO: 20177 - DNA, 274 bp, Oryza sativa
caaacaggccctacgtgcagaaggggaatcgcgatttctcagaaaactgatgctttcatttcgtcttagcaattaatagtcagaaagttctaacaatgcaaccctagaaatcaagcaccccaagctcaactgggacacagcagatattattttcagaaagtaaatactggttcctttttgaggttttcccagtggcccacagaatctaacctcaaccttcccctgacgacaatcgccatggagctgtcaaatctgttcgacttcaacctgcagg

SEQ ID NO: 20178 - DNA, 1501 bp, Oryza sativa
aattaggccccttattacagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccga

SEQ ID NO: 20179 - DNA, 1501 bp, Oryza sativa
ggtttggctgcaaggcaacgctgtaccttgcagccgaatatgcccagtttatggttttttattgttaattattgatactagatcgtatataatatattactggtcggagcttgataactccgagtaaaaaaactataacatagaataaatccgaggttctttttctcacgtaatttcggagataacaaagcagtctattactcgaacaaggaggtgtttgtgtttgtttcttatggggttgttagttgctcgttacagagttgcccgcataatgtgactggttcattcgttgcaacaaacaagtagcaactggttaaagcagtgactatattatcgtaatttggtttctagttgttactagcggttcgagatagacaaaaatatgcatatatggttttaaaaagctcatgtaaggattacttcaagggcaaattcaagaaaacggcgatatggtattaaagtacactgatcttgttggtatatcacgtcaccttcatggtataaaagagttagatgaccgaaatctacaagcttagagaaaatgtacttctgaatgaccgaaaatctactccacgttacctgcaaaatagtgatacaaactcttactatctttgtcccacaaaaataaacttagaattagatctgccatattccagtacaatgaatatagacaaaggtatgcatatattcatactagaatactccatccgccccaaaatatagcaatctggacacatatgtgtccagattctatatgcttacattttgggacggaggtaggatgttacatatagttataggtttttttttttgagagtagctatatttatggcgccatatttttcatgaaaaaatagtcggtatgtgtttacattataagtccctaaaattgcatatgaaattttagtgtatttacaatgtaagtctcaaaattacatatgtaagtcctaaaattacatatgtaaattctaaaattatatatgtaagtggtgtgtaagtgggatgtaactactatgtaaatttgtataaatatatgagaagtgtctctttttttttcaagaaaagatgtttgctatgctggactcccggccttagcatactattattttagcactaatcttaacgtcaattcaatgcaccacaaaccgatatatttttaagggaaaactgtcgtaacttttttagcgtgtctgtttttttatagagacggagggagtacatctctctctaaaatcgactgaacaatccccttttacgagaagaatatgtactaagcgttaagcagacgctgacaggccggctcccacctcccaagtctccagtcttcacctcttctcagtgagcgccgcgccgggttccagcctttcagcccaacccaaggccccaaagccatccgccgcaatataaaccaaaaccctaaaaacccacctcccctcttcggcctctcctttcccccgctccccttccccgaggagccacgccgccgccgccgccgccgcca

SEQ ID NO: 20180 - DNA, 277 bp, Oryza sativa
gaagatctgcacgccctgttgacgtgccgcctaatttagcctgtaatatggttcatctgcaaaatatatattaaatttgcctatctctcattttatattatttgtcattgtagcaaaatttcacatcaaactaggagatgtgcaaattacactgctatgcttattaactacattatagttttcaaaagcaatattaactttgattaacagttatacatggcattgataaaatgtgaagatagaataccgcgatctaaaataataatttcaaatgtga

SEQ ID NO: 20181 - DNA, 367 bp, Oryza sativa
ccagccctcattcctcccccctcaaatccagtgaaaagaaaaagaagaaaggggaggagaagagaagaaggggcgaagccctgccggattcagacgccgatttcaggtaatattcatagatcctatatgtgactattgagttaaatagtgtgtattttttaaaattttgtttgaataaatgcattatatttttagggttttagttttactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcgttgacagata

SEQ ID NO: 20182 - DNA, 1216 bp, Oryza sativa
aaaaaactaaaatgcaacaacaaaatggaaacacatttcaaatgaatgtattacctgtgatgaagtcagcaaaccagcagggcttcgccgctccccttctcctccccctcacccctccctcattctcttttttttttggattttgagtgaatataatgaaaattctcagagggggaagaggttttatactcgggaggggaaaaatcgccctccctaagggcggcaaggggggcgcctgcaaaaaaactaggccggcggctcccgaacagtgtaaaaccgcgctccgtaaggacggcaagggggccgcctgcaaaatggcaggccccctataaccggccgtaaggacttagctaacggccgtgtgccacgccacaaaaatcgccctctccaagggcggcgggcgactagttttgtaaaattttcaaacacaaaattagttttataaatattttaataaaaaaattcaaaataaaaaaaatcaaaattagttctgttccacaccatgcagttatgccaagattacaaacatgcaatgcaacacattgtatcttgaaattaggtacatcagttctgcaggcaaattgtccttttcattcaggccttgtttagttcgcgaaataaaattttttaggtgttacatcgaacgttcgaccggatgtctgaaggggtttttggacacgaatgaaaaaactaatttcataacttgcctgaaaaccgcgagacgaatcttttgagcctaattaatccgtcattagtacatgagggttactgtaacacttatggctaattatggactaattaggctcaaaagattcgtctcgcaatttctcctctaaccatgcaattagtttttcattttatctatatttaatgctccatatatgtgttcaatgattcgatgcgatgttttttggaaaaaaattttgggactaaacagggcctaaggcctaagtactccagctaatgcagttgtttgtaaagagtctaatcagcagagagatcagttcatccccccaacgatccgaccgtccatctcccctcccacggatcgacgggcccaccaccctccccttcccccaaccgtttaaatacgccaccccaccggcctcgtctccatcgcgcactcgcattcgacgacccaagaaaaggaaaaaaaaagaaaaacaatcctccacgccttcgagcgcagcaggaaccagcttagctagactagcca

SEQ ID NO: 20183 - DNA, 1501 bp, Oryza sativa
tataggctgtaattccctaactcgctagaaagcatcctctgatcgatcctttgttgcaatcaaaaggaatcatattctgaaagcaccaagcctcaacaacttctggcatgccatatctatcatattcagaaaaaaagaagggctaaaggacacaccatttagtgctcatttcatccaccatatcatattcagaaaaaaagaagggctaaaggacacaccatttagtgctcatttcatccaccacaccccccagaatcacaccagatcatcactcatgaagttctgacggacagatcatgacaagcgaaactgtgaagcagcaggacatcacatcacaggctcacacagatccaaacattttgcagcaaaccacaagattacgtaggcggcgaaaaattaattacttactgctcacaaatatctccgtgctgaaaggcttggctccaaccatccgagaggccaagccagccagccgcccacctcgcagcatcatctccagaagtacagagccccccgcctcaaaccctagatccccaaattgcaatcgcataagagagaaaaaaacacgagatgcgaatcagccaccgacagtaaataacactccacgtctattacatcaaatccaagctgtccattatgatcaagcacaatttacaaagcaaacacaagcttgcaactactgccacctagcaaacgagaggggaaagggaaggagagaagcatatggcggcgaaaccctagagagataaggctagttgctggtgaacttggtgacggccttggtgccctcggagacggcgtgcttggcgagctcgccggggaggacgaggcggacggaggtctagatctcgcgggaggtggcgatgggcttcttgttgtagcgggcgaggtgggcggcctcctgcgcgagcttctcgaagatgtcgttgatgaaggagttcatgatcgacatggccttggaggagatgccgatgtccgggtgcacctgcttcaggaccttgaagatgtagatctcgacgctcttcttcgccttcttcctccccttcttgtcgccggcgccgccctccttggacgacgccttcgactccgacagccgcttctccgccttgggcttcttctccaccggcttcttctctgccttgggcgccatcggagctgcctctcgagggatcggcgcaaatggagattgaggtgggattcgtgaggaggaagactttttcccttcgcgtggagttgaggcaaagggaaagaagacctcaattatatataggcgcgtggtggaaccccattggtcgacatgggttcatggatatatctgtccggtgctagcatatgaatcttttactagaaaacctgtcgaactccatacacatttatcttctattaggagtcattcaaaaatgtttaatacgacaggttttgtatttctcacattgactagagcagatataattgaactccatagctcccatacaagtaagatatatttcagcacaggacg

SEQ ID NO: 20184 - DNA, 1501 bp, Oryza sativa
atccattttcattgcactcaggcgtgcacaaatgtatagagatatggctgcaagtgaagggagagatcaatttgttgtagtttaggcttcaagtacaacaaagcactgccttataatctattttggtgttcacatttcaggaatcatataaaagtattttaaattatgtataaaaagatcagattgtatgacggtagccactgtgctattattaaagatgtcaattcaaatataatttctctggaatttttcctatgctaaatgaattatctggaattagatccaaagtcttggagcaagaaacacaaggtttgcttctccagcagtgcactgcatcttatattggcactctagaaatacactgtgctgttttttttatagacctatacaaattgtcatcctaccatggtctatgaaactctatttttatctgtataatttgtatggagtgcagtgcatagaaaataccttatttattgttctattttcatatgtatatatattgcgaaaacgtgtcttgcacgtgcacgataactagttccgtataaacaactcagcgcagttacctttattttttggcccaaaactacctagtttgaatagtggaaggcataagaatgcttaagctccatatgcagcatgtcatgtagtttctgttttgttattaatgttaccgtttaccgacgactatagtcacaaatggatattcatcttgcctgtaccagcatatagagaatgttcgattggtagaagtaatgaattgtctgctttgtttactccaataaaagtgtcttccaattccaaagaatctatgctgtcagtgctcgtcatgacaagaacaaggcacaaagtcgatgcatgactgcggcatcagaatgtaacattattactattattatttattactaagaggagcccacctctcttgtccagattttggcttccaatttcgctctccgtaaggtccaagttaggctattttcgtttgcattgtttgtagcgatggcaagcgattgagtccaaggatgtttgctttctttgttccttgtccgttggaacgagtgacaaacgaggctctgttggcggatccgccctcgtgctcgtgcgcgcaatcgtgttagtcctataagaacgtacggcgcgccattgagcatataattaatctaaactgctactaattcttctccgttaatcgccgaaagcaagcaaaagttttgaacgatatatcactgcatctgcatggcgaacactacattattgtactactcgaaattgctcgtgaggtgctcggcctacgagaaagatggtagcggcggcggccgggtgagggtgaacggcgcggctcaccgcgtgccgctccaggtcggggctgcgctggagacgaaaatcaacaggtcgctggccgggctgatgaggccgccggtgctgtcacagccgccgacggaggaggaggccgagggcaggaggagccagcggcagaacatcccgagtgagaagcaga

SEQ ID NO: 20185 - DNA, 682 bp, Oryza sativa
cccatgtaagctgtagtagttctcctgttaattgatataggccataattgtcctggcccaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatataccttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagg

SEQ ID NO: 20186 - DNA, 1501 bp, Oryza sativa
caggccggtagtgcttcggcatggcggcggcggcggcggcggcgtggctcctcggggaaggggagcgggggaaaggagaggccgaagaggggaggtgggtttttagggttttggtttatattgcggcggatggctttggggccttgggttgggctgaaaggctggaacccggcgcggcgctcactgagaagaggtgaagactggagacttgggaggtgggagccggcctgtcagcgtctgcttaacgcttagtacatattcttctcgtaaaaggggattgttcagtcgattttagagagagatgtactccctccgtctctataaaaaaacagacacgctaaaaaagttacgacagttttcccttaaaaatatatcggtttgtggtgcattgaattgacgttaagattagtgctaaaataatagtatgctaaggccgggagtccagcatagcaaacatcttttcttgaaaaaaaaagagacacttctcatatatttatacaaatttacatagtagttacatcccacttacacaccacttacatatataattttagaatttacatatgtaattttaggacttacatatgtaattttgagacttacattgtaaatacactaaaatttcatatgcaattttagggacttataatgtaaacacataccgactattttttcatgaaaaatatggcgccataaatatagctactctcaaaaaaaaaaacctataactatatgtaacatcctacctccgtcccaaaatgtaagcatatagaatctggacacatatgtgtccagattgctatattttggggcggatggagtattctagtatgaatatatgcatacctttgtctatattcattgtactggaatatggcagatctaattctaagtttatttttgtgggacaaagatagtaagagtttgtatcactattttgcaggtaacgtggagtagattttcggtcattcagaagtacattttctctaagcttgtagatttcggtcatctaactcttttataccatgaaggtgacgtgatataccaacaagatcagtgtactttaataccatatcgccgttttcttgaatttgcccttgaagtaatccttacatgagctttttaaaaccatatatgcatatttttgtctatctcgaaccgctagtaacaactagaaaccaaattacgataatatagtcactgctttaaccagttgctacttgtttgttgcaacgaatgaaccagtcacattatgcgggcaactctgtaacgagcaactaacaaccccataagaaacaaacacaaacacctccttgttcgagtaatagactgctttgttatctccgaaattacgtgagaaaaagaacctcggatttattctatgttatagtttttttactcggagttatcaagctccgaccagtaatatattatatacgatctagtatcaataattaacaataaaaaaccataaactgggcatattcggctgcaaggtaca

SEQ ID NO: 20187 - DNA, 1501 bp, Oryza sativa
gggagaacgaagagggagacggaaacagggacgacgtttgagaggagacagaaaaagagacgtgagtgccatggtttcaattttaaaaatttgcagtggcatccagccgataaagcgaatatgtgtggcatttttttatttgccacatttgcagtggcatggatccaattaaccctttaatcaatgactaattagaaaacagtatccccatctataatatataataggactaggatacaacttgtatcctctgagtgtatacttagttgacacctaatatttggtaaccatatatatcattttaaaaagaagaattatagtgtttgctctaccacccttgatcacatctaggcgatgatgctctatagggatgatttcaagggcggatccaaaaaatgtatagagggagggtttatctcctttctcctccaatccccctgctcttccttctctccctcttcttccccctcccacccccctttcttaatggtgatccagcgggatagagggacttgagtcctccagcacccacgttggatctgttcctgggtagtgttttgtccgtcaccaaacattgctacattacagttttaacatatcacagtgtgttagctatatgtttgctttattgtcacacttatgacattgcaactcgatttttaggctagttgtgccacacagaacgtacttttatgtttttttttcacagtttatctaatttcagttgtggcaagacgccaaccaaacatccaagaagaattcaccacgtttgtgcggacatcaggcacggcgtcctgaaaggacggcctgaattgttcatcaccgggaggcaaggacgatgatgcggcttgctggtaggcattggttgtgtgcccctgctgttgcctgttactcctcatagcctgtcggtactattgcactgggcactggctgctagtctgctacagtgcggcacgatctcctccccgatcttagctacagtaattacccatgaaacattgatatctcgtacaagtctgccccaaaacagccggttcatcattatgggtgccttttctgtccatccatgtttagaagagtcctgcatatgaatcaatatcatcccacttccaaaaacaaacacatgttttatagttattttatatatttaagagcggagtgtatattcggtcctaagcttgtatgggtgtatcatcgagacccctaaacattttcaagtttctatattgatcttcgacatcatataggtccaaacatgttccaatttgctttgtacattgacatggcatgcaacaatattttctacgtattagtgtgacccacgtaacattcatataggaaaaaaaacatattttcttctctctaccttaaaatttttaaaaatgattttttattttctttgtcttttctcctctctatctaacatgagaaaatatgtttttaaattttatttttattttagtgggtcctactaatacgtaggcgccaccgtggcatgtca

SEQ ID NO: 20188 - DNA, 1501 bp, Oryza sativa
tcttgtctatgtcctgaaatatgggtttcgccaatatgtaccgtggggcttgagaactctcggcgacttctatgttcgaatagtatttttcatgctaatgaaaaaggcacgtgttacatttgcttcaaagcgttacatggccgttctacttaatcttattatgtgttgccatgttagtggtcaaatctggagaagtcctattaatgattggaaggttcgattttagttcatatttttacaacgaatctttcatgataggtgtacttccttggaagaaatatgctgcatgcgcacagaatcaaagagttgctaaaattggaggtagaaagaacattaaacacgctctactgaagcctatggaaatcggacgcatttaagcgcattcaactcaagtacatgaaaccaaatacaggaatctaattcaaatcagctcgatttcccatataaacggcaaaaataatcctgcctgcaaacgtgtcctaaagatagtcccaatttgcatatgctcctcatttcatttgctcctacctgaatttctgggactgcaattggcaagatccaagatgccggtcacatgatccaaactggagtaaaacatggacacaccttaggcccgtagctcaggtcttcgtcaatgacaattcgaaggcctcttgtttagttgcttggcacgggcatcaaatacgtttcaaactgctaataagttaatacagtcttcgttcagtgcttatccagtatactgtgcagctgaagtggacctgtcagcaagtaaagccaagaggccaatagggaataattaacaccttactgtaaatgacagttgatactaatgtaatgccataacttctataggatcactaagggtgaaacctcataataaaaaggataatgtagaaatatactagtactaggcaggaggccaatgtgtatcacacccatgaaaactgttcgaatatttttggcagcacacctcaagagccaagagttggtaaggttcacatacagatggttcatttcaatgccaatatgaacccagctcatacgactcaaaaatgtcgaacccttgcctggttctatcaacaagggaataagtattaatattttgacaaggctgtgagacaaggatgaccagctcgatctcttagacttcgaatttacaccctaaaaaattttcaagctaaaatgtgatactcttcaaagtttcaaaacaggagaaatatctctacaattctcgactaaaagaaagcaacttacagtgtgttgtccaagtgaatgggctagttgatgccttggggttcggtcttccacttgacatagtatccacttgcatagtcgcattagtagccaatactcatgggcacactgacatcgcgaacctccctctcccccttctataaaaactcagctgcattgctaagttcttccccatccattgcaacggcaacatacacacaccaccaccaacatagcttcttttgtcactgactacagtatcacagaa

SEQ ID NO: 20189 - DNA, 1501 bp, Oryza sativa
accagttctattactatggtaccagacatgaaccagattaggccctgtttagttcctaaaaactttttaaaaaacatcacacgaatttttaaacatatgtatggagcattaaaaatagataaaaaaaataaggggcaattgtgtttctatccttgctttacgattcaattgtgattttatccctactttttagggtttgtgattttgcccctacttttttaaatgaagtagccgtctgcccctactttgttaactaatggtaccggtgttaaatttatggtgaatggacaaatatacccctgaaatgttttggcattcaatgataatttctagagcaaaacgaacactaatgcctaatgattagaaaaaaggagataaaaagtgacaaatatttgcacttttgctcgtgatagagatttagtcttgataaacgaacagttgcatggatgattttggcccacagcatgcatgggcatcgtgatcgatcaccattgtatttatgccatcccaaatcccaactaactaaacgcagaataatagaagcagcactaacactcaccttatgcccgtctcctccggcgtcggcagcgccatggaaggcgacgctccccgtgctcgactgcgacgtcttttcgtactccgacgctgacgacgccgacgcgcacttctcctccgtcttcgccagctcagcctctgactcggccatgtactcacactccgacgaggagcagttgctcaccaccggcaacggcagcccgagcgagtccctctcgtcgacggcaatgtcctcttcctcgccgtcatcctcgtcgcggcgcctccaaaggccgtccctgcgcgtgcagccgcgcgagcgccgcacctccctgcgcgcgcgccagccgcgacgctgccgccgccgcacctccctgcccgcgcccgactccgccgcgcgctggcccgcaccgcttctcctccctgccgcgcgctggccgcgcgtcgccgccgccaccacttgcaacccagcgcttgcaacccggacagtaaaggaattcgggattttgctcattgaaccaagggtagaatggtcattcacaaataataataacattttctttattcgtttaattcggaaatttcaggcccaccaaacttatgtcaaaaccagaggcagacgggtgcttcatttcataaaagcaggggcaaaatcacaaaccctaaaaagtaagggtaaaatcacaattgaattgtaaatcaaggactgaaacacaattgccccaaaaaataattgcacactttgcatgtaaatcgcgagacaaattttttgaggctaattaatccatgattagccataagtgttacagtaatccacatatgttaatgacggcttaattaggttcaaaagattcgtctcgcggtttccatgcgagttacttcctccgtttcacaatgtaagtcattctagcatttcccacattcgtattgatgttaatgaatctagatagatatatatgtctagatt

SEQ ID NO: 20190 - DNA, 1501 bp, Oryza sativa
gttggattaattttgccttatctaaaattaactcaacaattaaaatgagtattgacatgatcaactagagtctccgaattgcttgtaaaaatgacttgcataccttctattccctgcacacaccttctatgacttacatactcatgggaccacgtgttatctaagttattgattaatgagagatggcctaatgatatgaaacttgcacttgatgttgaacccttggaatttataaaggaaaataaaataactttgcatactcctcaatgttgttcctttcctaccaaagccatatgtcaatcttaatgacgaaaccttatacatatgctgcttgctatcattttgagttttgctaaatggttgtgacccttgttagattattttcatattctcatgaccaaagtcttgtgcacttagccaccaaaaattttgctttttctccgcactgtaggattagcaacacattccattcactttcatatgctaaacttctacaccagaagtcggcatccaccaaataaagactaaaaacattgtatggtctctcctctaatgatccatgccaaatgagacatgagctaaaaaaaactctgctcaaaagagaatgaagcaaattttctcaagcatgatgaaaaaaaaagtatagtgatgttctctggaataaaagtgcaagcaggaggatcataaaaaaaatgagtcaccatcccattttcattttttccactctcccatttccacccataaatataggtgaccaagcttggtcatggttttatgattagttatcttcttacatcctctatttgactttacaatatatctgatgtaagtatgtcttttcttattccctatcctgatctccacataagccttattagaaatataggatgagaaaatgcaacatcaatgccttgatgagtgatttgagagaaattaattgagaagtatagtaaaagttatattgtaacgagcatcaaagaaaacccaaaggtaattcaccagaaggagtaaatgtgacttgattcgaggaccattccattcttcaatcactcaagatgacatgatagacgcatcaaggttcacagacaaaagtttgtcttggaatatttagtatgttatatcattaagcagaaagtcattactataatatattcatgagctttactcagggacgagtaaaggataagtgtgggggtgttgttgacggtcgttaagtgcaaactttaaccgtcaacttatgcataaaagagatcaaatatactatcgagacttagtggtaggagtttactactaaccacttccactagtgtatgattgagatgtcaactagagggggggtgaatatgcgatattaaaaataaatagcacctaattaaaactaacctaagttgctaggcttggtgaaggataagtctaacaaagcaactaggttatgttttgcaatcctggggtgataagggctcaagtatgtctctatgaatgtaaattgcacaaaagtaaa

SEQ ID NO: 20191 - DNA, 1501 bp, Oryza sativa
aattattcttgtaattaatcatttcctacacaaatactacctgcgttgctgcaaaacgataattagtttgtacgacaaaaatgctaaatgtcagactagcaaataaaaatcttttgactttttcatgttaattttttgaaacattgacgctcaatttccttaatacttagtttcagaatataaagatggtagatgaatatttatgttgaaaatagcattcataatctcataaacttaatagaatttatgaaaaagtatggtcaaagtgccaaaaaaagatattaatagatttttcatgaaatgcacttttatatactagtttaatatcttttataaacatatagttagtaaaagtaataatcaaatatatatatacgcattagaaattgtgtcgattgccaaattgacaagtaaaaaaagaatgatgcagtaattagtaggtgccaagaatatattttcatggcagatgaattgtactaagatgttgataaatttgattgcaagaaacgatgctcactaatcatgatttcaagaacgttgcgcctcagcgtccagtacaccaacttcagaaaaggttagtgattttgatggagaacaatcaaccaaaccacgaaggtactcattcctatgagcaatcgagaactggcaagaaaaaaaaataaaaaacaaaaaatgataacttaagggtactcattactaagatgttccaaagacaagtaaccaagtgatgtagccaactgcacacaattacatgatgaagtaacaatgcctaaattatgatctaacaaaacaccaaatgaacttaagggggtggcttagtatttatacatgaagtgatctaggacagtgtgtatgacatggcacgtcgccctacgacaaaccagacccatctgcccaagtggaggtgatgcaacaccattggttttggtttctaggaacaaaccactcttacgattcagattggttggatccgtcggaaagagaattccgagatctttctatcaaatccccacatggatttttagatcaacgggtatgctcgtttgaatttggggtggtgcagcaaactgaaccgaaatattctatcttgcatcctcgttgagcttttgttcatctctaccgtcattcctaatcacaataacatcaccactagcatttagtagtactacccaattcagtaaatcattcttatgcaaccctacatggtaattaagttgacggacacgagctcgagcgattgatccttaatcactggttcagcttgtgtgcttgccgttggcgtgattatatccatgcatggtgcggatgtcctcatcatactaagtcatggtgtagtgggttcatgccttcaaaactgttaaagattagttaccgtggtattgttagagatttggatgtttatgtcaaattcaattgtttttctcgaacaaacaggagagctgcatatcgttatattaagaagaataaaggagatggtaagaacccttacaacacacacaat

SEQ ID NO: 20192 - DNA, 1501 bp, Oryza sativa
gcgaaaatattcagcacaactgtaaaatcctaagttcactggttgagttcaatattttcgatgccaattttttttttgacaaagggcatatagccgtgctttactgaaagtttagggccccttttgaatcataggattgaaaaaatagaggaataggaaaaacacaggattttgataggaatgcaaatgtaaaacagagaattgcaaaacacaggaaaaacacagaaatgaccgtttgattggactgccggaaaaacgcaggaatcagatgagagagatagactcaaggaagttttccaagaggttagagtggatgttaaatttcctatgattttcctctagaatcgtagaaataggaaagtttcctacgtttttccttttttcattcatacgaatcaaaggcataaatagtgtaggatttcaatttctttgtttttccactatttttcctccaatccaaaggggccttaaggtttgagatacagcagttcacaactgggtttgccagctaaacaaacaaagcccagaaacacaaaaaggccttatcctgcaaagagaagtactacaaaaccaaaaaaggggcagaaacggcaagcacccgacagctacagaagctaaagcacaagattctcacacaacttcagcttcccacgttcatgttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataagacttggaaaaagtacaccgaaggtccctgaacttgtcatcgaggtaaaaaacgtcctcaaaccgcaaaaccaaatattcggcgttccttaactaatcaaaaccggtcacaataggtccttcggtggttttgaacccagttttatccgacgtagtggttgagtcagcgtgggatccacgtgggcgccacatgtcaggatgccacctcatttctctctttcccctct

SEQ ID NO: 20193 - DNA, 1501 bp, Oryza sativa
cacatacacatcctacctctatgagtatcttcaagattgagctagcatatcacatatcttcatattcacaaagtcaccattgggtctcgcagtcggtggtatgtcgtgtaccagtgaaagaatacttagtcgtaaatgcgaatgctcatgttaagacatgtacctaaatggatagattttaccaaaaaaaatgaactagctgagctacgttcactttgtgaaaagaagaggattataattagagatgaaaactattggaaacggaatcattttttattatttttaatgaaacagtcggaaatggtcagagaaattctctatatttaagaatttcactgtttagtattaacttcagtgtgatggtgacaaaaattaggaaaaactaaattttaaaaaggtaataatcgataaagatatttctattatattaattatttaattttatggaagggagtagctatatttatggactcatattttttttaaaaaaaagtcagcatacatttacattgtaagtctctaaattacctatgtaattttagtgtgtttacaatgtaaataccaaaattacaagtaaatatcaaaatatcggtatcgatccggtcagaaaatttcctaccgttttcatctttaattataattcatctaagatcagacttcttcctttgttacacattcttatatgattcttataatagtgttgctttccactttgcctatcaactacagcttgttgctccactaagccgttgactatagcaggacttgtaaaggtgtacaaaagatatacacagtggcagacacaaaatattctgaaccttggcgagtcgtcgagcccggccgattgctcaggatctctgggcccctaggtctgccgctgaatgcaccctatctgaactcttgtcaatagatacaccaatatcatgaagaggtcctaggaacgtggaacagtaacaattggtgggaagaatatcagatggaatccaccaatttagtgaaaccatgacactaatactacactaaatatgcctacaacttaaaacaatttaccaaatgcaagattgatagtacactgtattatgtaaaatttcaagatcaatcttaatttcgctgggaagttatgaaattgacaaataacgaagcgagcacggtcgaaacaatttaattcggttgcttacgatttgatatcactagttatgaatttcatatatttcaaagaattgcgtagtattaaaattagcagattacctacacaacacatggtatgttctataactttctgaaaattcttcacagtttgtacagtggttttcacaatttgattgggctggtggttccgcggtacttgacggtccctgctgagtgcccagtgcacacggtaccatcgagctggctagccacgatgagctgccgattcactattgctctcactcacgaatttcgattctgtcagcgaaatataattacactcagattaacagatagccagagagggtcatta

SEQ ID NO: 20194 - DNA, 1501 bp, Oryza sativa
tgccacctcatgttctttgctatctttttcaacctcatgaggggccgatttcttttgtggaggtgttggtggtttcagcggagcatcgatggaggtcccaaagattatatcctttttgtgccatagtattatatattccaccgcatccccaagtacagctaaaccatcacatgtcaggaagtctaaatcgtatgtcttgaacccttcattcacatgttgtggttgcattttcgcataatcatctggaatataatcctcatgatgaatgcggccagggatagccattcattttgcctcgatacaacgggccaagtgcaattatctgaggaactatataaaccatgatgtgctccatcatattaaaatatgatgcaggaaagcacatctcaagtttgcacttggtctcatgtgagaataaacaatttagtgataacacttcaggattgatgagcttctgtgatattgcattaaaaaagtagcacatctttgtgatagcaacctttacatgttctgatttaatggcccttatagcaatggcgagaagcacggtgaatatgacatcaacaaatcttatagtcatgtgaattgtcacaggatatcaacaaatctttcatgaagactagtcgcctgatgtttgatgagaaatctatgggcactttaacaccgtaaaggcacttgcaaaatgccttcttctccttaggttaatgtaaaatgccttcttctcctcagatgttaatgtgaaataggctggagggagatatactttttaattcttctcaccttctatcgggtgtagctcttacttgattcccatatttattagataggtacgtgatagtacactattctttgtcttgtttggtatgtcaaggacaattctgacagtgttatcaaacacatttttttttcatagatgcatgaaatatatggcatagcaaatctccaaatctttccagtaccacatgtactcaaagaaaatcgatgcttcttgaatgtgggacatgatttatcatctggtttcttacgctttgttccctccgaacattttttcagcccttttccgaacacgcattgtattttctttgtaatggcatgtatttccttcctagttttatgttttggtggtggatcattctcttcgataccatcgaattctgacgtcatcttgcggtatttatgatttatgtgtaagaaacgccggtgacgcatgtaaacaagcttgttggaacctagaaggtaactgtagtaggacccatttaagcatatcacacatcatgttttcactttaatctgccccggaactgaaacattgcggggtaattgttaatggtaataaaaatgatgggcctttactgtaaagtattgtcttaaatactcgtcccacacattcatcccagcttcccataaatcttcgatatcttccgtcaatggttcaagaaatacatcaatgtcaataccaggctatcgtgggccttgtataaggacatagagtaaaatgtac

SEQ ID NO: 20195 - DNA, 1501 bp, Oryza sativa
taactttgaagttccaacggcaaatctattttcatagcaagtccgacacccgcatgcactgcaagtaccaagttcatgtacaagaattaagcgtcactaaatggaatcagaccactattttgtatacaggacacatcctgaaacagtagtagtagcattcaaaagtagtgttttattttggtcggccagcaagatgacttgcctcggatttgttcttcttggctacatgagcaccatacgctgcagaacactcatcatacaggagggcagcagcatcaggaggaggatcttgatctacaactctggaacactcattatccagtagggcagcatcagtaggatccggatcctgatcttgatctacaagcgaggcagcgaaggctttgtcctccccaggatcttccgtactgaaattgcatcggccattgttgccgtctttctcatccatggcctgtgctcctaatcctgcctccagatagcctgatcatgagagagtaggagacgtttatccatctataatctatcttgctcaaacgaacgcaaaacgaaaaacagcatgaatatatcacgaggatgcaacgaaatccgaattagttagagctaatgataatgataaatcgattaataagaaatacgagatcagaggcatggaggaattaaacctagttaatttaccagggaccaggaggagtgctccgggaggcgacagcaggctgtagggctgcgtgcggcgcgtatccaaccgatgctcctgaagggttttcgacttgtgttgatgtatggaatggaatcgactgcaacggaatatggtaaggagtattagcccacatactctaaaaaaggtaatagcccaaacggcgacaagtttttgggccaaaaagttcatgtttggcccaaactttgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatcgacgggttcaccgagcagcgacctagatttttcttgaaactattgctgagacaacagaaattttccagctgcaaatgaattttcattcgcacatttccttttaccaacagttcttgaaggaagattttcttgggaatacagtttttttttcacctgtaaaatattttcacttttattcttgggaacaccgaggattcatacagtcaaaaattttcaggccgtttgggtatttggtaagggtaagacatctatctggctagtcattgcaacaaaaacgaactctgaaacagaacgaacatggcgaaggg

SEQ ID NO: 20196 - DNA, 676 bp, Oryza sativa
atttttttctaaaatttttagtaaaatttgttagttcgtgtgcacggtgtgtacaaaaaaaattgtgtgtacattatatgctccctattttattgaccacaactatttatttttaacttctgtcattaataaaaaaaatctacaaccggtagttaagtggtggtataagacataattcagtaaataaaagtgaaagggcctgtaacctagtggttacaagagtctcagtagcacctgaggtcctaggtccaactcctaatggaagcgatttttttaggatttatttttcaggatttaacagggttacaagagcctcaattgtacaattctcaaaaaaaatataattcagtaagtaagagaggatgattggtttagatttatttttttaccagcaaagaccattataaaatactttaatctgaaaatagtaaaacatgccatatttagtaccggatcataatgagggaatgactccatcactaaggtttaaatcctgatgccgatcataaatattacataagcaaataagcttccaatataaatttaatttagtgagactaaagagttacctcaattttccgtcttttgagtgtgcgaaaagaattgcttataaatgtgtgaataaggtgtacatgtgtaatgttgtatgtgaaaatgcgtctcgtcttaaaaaaga

SEQ ID NO: 20197 - DNA, 1501 bp, Oryza sativa
tttcaaaatgtttgacaccattaactttttagcacatgtttgaccattcgtcttattaaaaaaatttgtggaatatgtaaaactatatatgtacataaaagtatatttaacaataaatcaaatgatataaaaagaataaataattacttaaattttttgaataagacgaatggtcaaacacgtactaaaaagtcaacggtgtcaaacattttgaaacagagggagtatcatactagtaccaaggaacctttggttttagttaaactttgtcactccctccataaaaaatataaaacttattttgtttcgttaggatatgaacctttgacaaatgcatatgattttgtgatatttatgttgttagattcgtatttaaagtacgaagaaggtgttcaaggccaagtttggttctatttgacacagttatagctcccaacttcaacttaattagaatcggagttgtgccaaacaattcagatcctctgtttttgggagtgtagttagcagagttattcctaaaaaatatactagggggtagagctgggttgttgctgctccacaactccactccaccacaaaggacccactaccctttaattttaagagaatccactcagtgccactgagtttatcgcacttctataatgtaccactgactttatcaagttcaattatataccatcgagttttctttaacatctactgtgtgccatcacagtccagttaacatctgttacctctctaaaaagacctatttgcccctaactcattgtacatggtattttttttgtccagggaaatatgtcatcgacggtggaggtgaggtcggcggctggtcgcggtgacactgggacaggtggttgcggcgaaggggatagaagcgccaggacgccggtggcgaaggtgtagtcggtcaccggttgcagccacgctgctggcatcgttacttgggcggacggtagcgatggcggcgccaggtcatcattggggagactggcgaccggcggcgtgtagacgagaagtcggccgaccggcggcgcgtcgacgggcagtcggtgggccaattgcgcgtcgaccgggagtcggcgggccgccgacgcgtcaaggggagtccggcgaccggcacatcgatggggagtcggcgccgtctcgctgggagactgggaaagatcgatttgggggtggacggtgtgctagggttttcaggttttcagtcaactgattttcttggatggatatattagtcaaagggtattttagtcattaacaaaaaattcaatacagcaaacagatgcaaactaatggctcatggacggcgatggcacgcagtagaggttaaagaaaacatgatagtatataattgaacttgacaaagtcagtggtaaattgtagaagtgtgattagctcaatggtagtgagtggattctcacttattttttttatcatatttatgtaaaaatgccactaactaccctaaaccacctcacctctccatcccgta

SEQ ID NO: 20198 - DNA, 1501 bp, Oryza sativa
catatctatatccaaaagtcagaatctaacttcttggtcatgcatggctcatctaagacgtaatttaggacggtcaaataccactaatatatgtagaacagcttaagatcaaagaattaaagcgggtgctctgaccatatagatatatgcgataaacggacagacaaagaagtgatcaagacatagttctacacattgaaaaaccgcggccctttgaaaaaaccacggaagaaaaccaataatagccacgaacatagttcaataagagggacataagttacgcttaaaagtggttgatttggtgctagccttctctttggatgtgtgtagacgctgtcggtgcgtggtggttaaattttttctttcctggcgaatgtctcctaaggcaatagttttgtaatttctttctgctctattcaatgaatgatcgtgttgtctgtaactgatcgttttaaaaaaataatagcgaccaaatgaggaatgtttacaaacgtaggggattactcaatctttgtgccttgcttacaatatttttttaaaattacactttacaacataaacactcacaatgcacgcatactcaccctatgaatgcacgtacgtaaaccctacccttatgagcatcttcgataactgagccggcaaatcttggagattgacgaagtcaccacaggcgcctcgctatcgacgggtacatcgtctaccactgaaaacataataattacatataagataaagagtgaatttcacaaaaccacagttattggagtatccgttacataaaaccctggttactgtgatttgtttcacgaagccccatgttttgagccaaatgttttaagaaacctcatattcatgtaaaatactcatattttattattacataagattgttttctacatcaattcacattagttggctaaaaggacatattcttctcgtctacttcattttttttctcaattttgtgctgaaaaagattaacataatacatgttaattataatataataataggttaaatatacacataaatgatcaacgcttgttaaaaagcaactaatgttatatatgtactaaaaagtatctcatacattctctaagataaaagtgcttacagataaatatataagacaaataaacaaattgcaaaactgggcgttttgtgttacagaatccccaaaacacgggttttctttttgaaattttctctaagataaaagtgcttatagaatcatagcaggaagataatccgggagtattatagcatctgtacttctcacctcctaattaaccctgcaccaccgtaattaaacaataatcgctccactgttatcaaatagaattcatataacacaaaatcatcaacaaatatacattgggaagtggagcacggtttaagaagtccacgttcaaatatcatcatatccgtggcacgccatgtttgctttgcatctgcaatccagtgacaaaaacctgcaagttgaagtatcgcgtttact

SEQ ID NO: 20199 - DNA, 1501 bp, Oryza sativa
attggggtttgtgtactagaggtggcatgttgtacttgttacctcttaattaatgagaatatgacatgatttaaattagatctggtactcacctccattataaaacttaccctaaccccttcggaagaacgcgacctttaataagctcaaggaaacaaacccaggcaattcggccgttcagttcttaaaggcccatccactatacgtgccaggctatgtaagccgtaatccgggctttcgacgcgttgaagtcactagttagcccataagtatacgggccttgggtcaccctaaccttggcaacccagccggacgaggatacagacccagcgtacgtaagacgtacctaaacaattcttacaaacttgtatgaaccgtttgatttagttaactaaaatttttaaaaaaacaagatttaatcacatcatgatacgtcaggatttgtaaaatgtttgtacaagaaagtttgcatatatcttttccctgccgtggaaattactactccatgaaaagagctaggctaggaccaaactatttttttttctgctttctacttaaaagctcagctggtttctatagactagctatactgtgggtgacatgtcttcactgtcatgcatatctatatccaaaagtcagaatgaaacttatatatagacgtaatttaagacggtaaaatcccgcttatatatagaccagcttaaagaaataatagcggatgctctgaccgtctatatgtgataaaataagcagacaaacaaaggccatctagaagagagacatactttttcgaactgaaaaacccttttcaaaagatcatggaagtaaaccggcaatgcagacaaaataaggcgtgtttacgagcgtagaggaattaggcctcgttctttttctaattaagatgagattctatctcaatttgtgttagcacgcctttaaaatggttgaacggtacaacgttactttaaaatatcaaataaatctatttattaataagttgtaataattaaaatttagttaatcacgcgcgctgatgacttttttgcatgtcccttatttaatcttaattttaatcttactctaaacacaagtgatacttgttctttgcgtctcagcttattacaagagttacatatgaaaagataaaactgctttcgtaacatgaaaataatctaggactattatagcatattctcgtaccctgcggctccgactagctggccagcggcctagcgttgtactctatccatcagctgtactaaaaaaaaactatttttacgtgcgattaaaattaatttttcacatatagctgccagtaacgtaaacaatcatcgttccaccgtcatcgaatataactcagataacacaaaatcaacaaaaataccttgggaagcggatcacggtttcagaagtcaacgttcaaatatcatatccacgccatgttagtttgcgtgcatatgtaatctagtgaccaaaatctgcattctactattgcgttcac

SEQ ID NO: 20200 - DNA, 209 bp, Oryza sativa
catgcagaacatccaaagtgaagtagtaatagggagcaacagtttctgtgaaatcacgaacaccaaaattaatgactagacacaaatggaaagtttgtggcaactgcaagagtgcatcagatgcatctattatgccaataattaagagaatgaagtctgtgatgcaaagtgaggacttctctagttctggaatctggatattaattcct

SEQ ID NO: 20201 - DNA, 1501 bp, Oryza sativa
acacaccctgtgtacaagctcctccagccacactatcgcgacacgatgacaatcaatgcattggcacgccagacactcatcaacggcggtggcattttcgaacaaactgtctttcctggcaaacatgctctggcaatgtcttcagcagtttacaagaactggaacttcacggaacagggccttccggatgatctaataaagaggtaattaaacaccgagagccacatcacaacaagaaccaacaataacataactttgaataacatcctaattttgtaatgcagaggcattgccatcaaggacccatcaagcccatccaaggtgaagctactgatcaaggactacccttatgcaacagatggcctggcgatctggcaagcaatcgagcagtgggtcactgagtactgtgccatctactacccaaacgatggtgtcctccagggagatgtggagctgcaagcatggtggaaggaggtgcgggaagtcgggcatggtgatctcaaggacgcggactggtggcccaagatgcagagcttgcctgagctcaccaaggcctgcaccacaatcatctggattgcatcagcactccacgcagccgtcaatttcgggcagtacccatacgcgggctatcttccaaaccgtccgaccataagccggcggccgatgcccgagccgggttccaaggagtacacagagctggacgagaacccagagaagttcttcatccgcaccatcaccagccaattccaaaccattctcggtgtctcgctcattgagattctatcaaagcactcagcggatgagatctatcttgggcagcgtgacacgccagagtggacatcagaccccaaggcactggaagcattcaagaggttcagcaggcagctggtggagattgagagcaaagtgttgaacatgaacaaggaccccctgctcaagaaccgggtcggtccagccaatttcccctacacactgatgttccccaacacgtcagacaataagggggcggctgaggggatcactgccaggggcatccccaatagcatctcaatatgagactgctgcacgcgtcacgcgctgctgagttggtgtaggtttgtggctgttatcttaggccctagggcacaagcaatgaagctgcatagtactatttgctacaaattatgcaagaataaagttttagtgctaataataaagttactgttgtagtgtttgtcccatttttaagcagcttcacatagcaagctcaaatgaagaggcaatgctgcaatatggatgattaattatgcagctttactcctatgatgttagggaggcagcttctgtggtcaaatttgcagcaataaaattcttcaaatttcctcaaatgtaatgattatatctcattcagtcacagatcgattcttacttgtaaatctagcataaccagtagcggaatcagaaattaaccacaaggcaggaaaacaagggctacgaagtgatttgattgccaatttgccat

SEQ ID NO: 20202 - DNA, 1501 bp, Oryza sativa
cgtcgatgttgcgcttcgtcgccagcccgatgcccgcgcttcccgggtacagcgtgtcgtcgaggtcttcatagaaaagaaagaaagaaaaaaaaaacagcccgggaaaggcagagtttagacggagaattgaaagtgatcacgctatgagaggagcctagaatcgagagacaaacgtggttaccaaagaggacgcagtcgaaaggggaggaagcggcggcggtggaggccattgttcgacgagacagaggtgcgatggcgagagcgatcagactagcagagagcgtgtgctgattgtaacgcggggagaaggaggggagagcgggtttgggggtggggggtgcgtttaaatagagcgggagacgagctggggggaggcgtggatcacgagagggaattggaattttttttggtgtgtcgccgtggcggttcggctcgtgttcctcgctggacgcggcgctgtgttgtgcggtggtcagtgtgcgtgcaccgctggttcctttcctcgtgcgtgcttgcgggcgaaagaagggaagggggcggcactgcggcaccttggctggctcgctttcgcgatcggtttcggcagacgggcagacggcagcctgcgcgccttctcgccgtgcggttcgttctctgcttccggcctcctctgctgctgcagcccctgaaacgagggcaggaggatattttctggcggattgaccagactgggaatcggagatggattccgggtgaacctccactctgtttcttttatgcaaactctaatgattataaactttttttaaaaaatggtaagataaatttatatatgaaatatatcacttcacaacataaaaatttaaatctagcttttacaagttgtaataaaaataacaaagtgaactctaactaatatatttttttacagttagaagttcaattcgtatttgcatgtgcgtaaaataatatattaccattaatttattttatcattttttaaaacttttacgtaatcgtttagttaacggtaagaaatgggtgaatgtctacggaattgggattgttacggtagtagtaattctagtgaaatactcctagtcctattcagcatttgcatttttttccccagcagtctgatctgaaagtagtaaaccagtcagcagatcaaaggggattaaattagtataccaaagtactccctccatctacttttgatattcatatttctaaatctgaaaaatttatttttgattagcatatttcaatccaacaacttatcatatcaatggctttcttggatttaatgcgcgactcttcattcttacacacaagattggctacatgggcatcgagaaatataaatattaatgaatcgcctgtttacgatgaatgactagtagcatatttaaatggatgataagtagaatcatttatccttggtctgtgtgctaagatgaaatatgactatcaaaaatagatggagagagtattttccacacggcaaatacggagaaaa

SEQ ID NO: 20203 - DNA, 1501 bp, Oryza sativa
ataatatctacatacatcactgaaaaccaaataagtaacataggttcttcgcagtcttcttatatattcacttaaaaagcgtctcggattaaattaaattgacaaatgatttattaattgcgctattttaggctatatatcgtctttcataagtgaccaccaaataacatatataaattgtgctacttcggtttatttcggtcactcccagacttaatagataaaaatatgatttggaaagccatagacttacccgtttaatagaacaccaacttttaaatttaactttaaaaattaggtctgaaatagactaaacataaacatagtttcacatctctaatttatattgtgagagcattttagccagtttcattttttaaggtggaactaaaatcgtttaatcgtttggtttggttttaacttgagtagagatgaagctagagtctaaggtcgtgccaaacggccctttagcagatcgaaaacgtgatttggaaagccaaacaacaaagcaacgtgcaagcataacggattgggtctcttctctcttgacttgtcacatccggcttgcgctggccgtcgcaaggccgccgcatactcttctcccctctttgactcgttttgcgcccaagtcgatccccaacgtctcctcctcgctggttcgcccgccgcgccgcgccgatctccatccgttccacgagcagcggtgaccgggtgctgtcgtcctgctccccgcttcccttccggctccggtgagcacccgtgccgacctcacatcctctctctttccccatccatcccgttctacccacgccttctctcgaattttgcagtaaccttatcttctcttctagatctggaagctaggttttcaccttgtcttcttagtagccttagttttactagtagagtagtagtatcaaccgccgtggcgcacgtatcgttcgcccctggacctgaggattacattccgtgtctatagttcaatccttgaccttaaggagtataaatttcattttggaccactttttattaccggtgttttgctttcgaccaccctttaatcaacgtattcactttggatcagataatcttacctttgttgcattttggactaccctaactctcttctcaagcatatgaacgatttcgagtacgccggctccgattcatcagtgaattcccaccgctttatacctggcaatttatttgacagatgacaagtttgatgtagatagataaaagatttgagtgtgctccaaagtgacacaaaggtaagattttccggttcaaagtgaaaatattagttaaagggtggtccaaagcaaaacaccagtagtaaaaggtggcccaaagtaaaatttactcttatatgaatttcaacattgattctgctctgcagccgatctggttgattgatgagcagcccattgccttttttggcagatttgaggcgctaaagtttccattccgtgttacgaaaagctgcattaggacatggaca

SEQ ID NO: 20204 - DNA, 1501 bp, Oryza sativa
cgttggtctggccctccccgatctccgccgcttcgacgtcggcgagcgccgcggggtcctcgagcacggcgtggaggcggcggaggcgcgcggcgtcgtcctcgccgaagagcgtggccggctggcgcagcacgcgcaggcgccggatgacctcctccctggggaggagcggcgcgccctccttctcctccccgtcgccgcggtgctcggtccgcgacgactcgtcgccgtcgggagcccccggcgtggtcgtggagcgcgacgcggcgcggtggtgggaggaggaggaccggagctgcttctggaggaggagccggcgctcggcctcccggatccgctccatctcgcggcgctcgatctcggcgcggcggaggagcttgcggccgccgaagtcggcgtcgagcagctggcgcttccgctgtagctcgcgcttcaggacgtccattggctcgccggagtgggggtgggtcgcggtggcgcactcgcagagtgggttagctttgctttggattttggagaggcgaatcggaggttccgcatggcggatcggaggatggatggatagtttttgagcattcgtttttgggagatcgatgggttctggaagcatcgagcacgaaaggtttctcgcgcgaaccttctcgaatctcgattttcggagttcggattgagtgaagagtaaaccggtaggtgattggcccagtttaactttaggcctgctaagtgcaaacttaagcgcaaagcaaagcccatacaaacagtgttttctccgtatttgccgtgtggaaaatactctctccatctatttttgatagtcatatttcatcttagcacacagaccaaggataaatgattctacttatcatccatttaaatatgctactagtcattcatcgtaaacaggcgattcattaatatttatatttctcgatgcccatgtagccaatcttgtgtgtaagaatgaagagtcgcgcattaaatccaagaaagccattgatatgataagttgttggattgaaatatgctaatcaaaaataaatttttcagatttagaaatatgaatatcaaaagtagatggagggagtactttggtatactaatttaatcccctttgatctgctgactggtttactactttcagatcagactgctggggaaaaaaatgcaaatgctgaataggactaggagtatttcactagaattactactaccgtaacaatcccaattccgtagacattcacccatttcttaccgttaactaaacgattacgtaaaagttttaaaaaatgataaaataaattaatggtaatatattattttacgcacatgcaaatacgaattgaacttctaactgtaaaaaaatatattagttagagttcactttgttatttttattacaacttgtaaaagctagatttaaatttttatgttgtgaagtgatatatttcatatataaatttatcttaccattttttaaaaaaagtttataatcattagagtt

SEQ ID NO: 20205 - DNA, 1501 bp, Oryza sativa
gatcaaagaaaagccatggccatggccccctctcatgtgaatttagtcgagagtttcttctataatttccctgcttatatatttctacttacatttttgctaatgactcttgtcaaaagtgtagattttctagtggtttccttgatcatcaatggagagtagtctttcttgcaactttccccctttttctcttgaagaaaaataccacctgagttataccactttcttcataggagtatataaaaaggcagccttatgctattcatctcgccgtgtggcttcaataattatagagaaggtcccgaaaatgctgaaatggtagtctttctttcctggttcacgcgacactgaaatgtgcaatatagaaaacaaaaaagaagatccagtatactcctaccaatcaatcaatcatcaatgactattttgtcgtctgcgattgtacttaaaaaatactttttttctcatatcagtctacgctattgttcaagcttttctttctcatttcatcgaaactggctggcaaatctcaagttgacttatgtaaccttggcaatgaaacgaactgtgattacgccattacggcatcggctgatgccccctctgtcctctcaccacaccaatcgccatggcgtaacatgcgacgagcacaccacagtcaccgtggtcacatgctcacagcctcgcaggtgccacttgagagcaagtcttgaaatacagaaaaataatgatttaactacaaaatttcgtgcagctagaagtagaaatggggacaagttttgcagattttctgacagcaactctgcaagattgatcttcccggaaataccggctgaacaataaaaggtgccttttttaaaagaaaaaaaggcctattttacagcccaactgaagcctagcccgtgggtgttacgcgggagaatttttatttatatatttactttaaaaaattttaaaaataattggaaaaaaaaacgaaatactccatctgtcctaaaaagatttaaatccaacaaaactagacacacgtgtctaaatttattgtttttttttaacagatggagtatactctaacgcatgactgtgtattgtaaaagtcgccctttcaaaaaagaaatccttaaatattttttttaatttacagtttcacttcccgtccgttttagttactagtaatgctgatggatcttgttgagctctgtaattttgatgtaaagttttattttatccaacttcatttgacatatttgtaaagtggcaaactatatagaaaaaatgcatttaagtcccttcctgacctcttggagagcggttttcgcaaaataaataaaaaaataaaaaacgtctttacagagagagttaggggtatatttttaatttttgaagacaaaaagaattgtgtacataaaacaatccagtttactcgtgaggcccatattagtaggcccagaacggggttgggaggacgcggcccattacagagcagagaaatcgcccccagttt

SEQ ID NO: 20206 - DNA, 1501 bp, Oryza sativa
gccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgccacggcaaagccttttgataacctcgcattggcagtacccgctccatgaacttaaatcctcatgcactctaggcgtccatgtttctagcagtgagaggagttctggcgctcccgggaaagagaagtctcacacacatattaaattatggctcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgctcggctatctactccgctaggtctatacccatacgagaagtgcggttgtacgagggtcgtttcatgcttaacttcatggctcggtccttaattgaccggggacggtactagccttttccagataccacccaaatcctccgtccgccccagtcgaaaatagttgtttaattttatttctcctttcacaaatcatgtcatcaacatcatggcaatgtggcgctcatgtctctacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattgtaaaaggttaataattatcca

SEQ ID NO: 20207 - DNA, 184 bp, Oryza sativa
tcctgcagccctcccctcgctctaatcttcttcccctcaacccgctccaaaattcccccgcctcccactccaaaaccgaaaaaaatcccgcgcggccgcgtgaagccgtgaatctactcctcccttcctccgcgcccgcgcgtcgccatgaatccgcaggcggagggcgatgcggcggcggcgg

SEQ ID NO: 20208 - DNA, 1501 bp, Oryza sativa
gatccacgagctgacaggtgagaggagcgtcgtgaagacgaaggatgcagagctggagctggtgatcccgccggtgttcgtgcggtgcaacaaggtgctcgacgctggggagcagaaggagggagagagagaaagagaaagggggaggaggggaaataacagagaggtgatgagttggcatcctgacatgtggggccacgtgggtctcccgctgactcagcggctacgtcggataaaactggggtcaaaaccaccgaaggatctaaagtaaacggttttgttaagctgagggatgtaatatatctggttttgtggttgggggatgattttgtaactcaatgacaagttgagggtccttcagtgtactttttcctttgggttttaggttccagtacaggctaatttacattttcacttgggcctaaggcccaaaacttaaagttcaaaaaaaggtccaaacttaagcccatggttgtgttatacttctgactttgttcattgtacttttccagaaacatggcccagaaacatgctactagaaattttcctttttgtgggagctgggaacatatgctacatattttaagctgaccacggtgtgatcaactatgagatctctttgctgatccaaagaaactgtaattattgtaggcagaaaaaacttatgaaaagctgtaacacaggttatttacagcagctttgcaatcatggagttttactactccgtactacgtactacctagagaaacactcgaaatttcacatgcgaaaaaaatctctcacaacagtatgactgtgaagtctgactgtctgagtgtctgcttcatcaagcttctggtgtagtggcagtagtactatttaaatctctgatctgtttggtcatgcatccatgctaagatatttcctcgtgtggcactgttcagtgttcatcagcagtggttggatacgtgaaccccacacgccagaaatcataacgtgcagtcggccatgctgcagatttagatttcggcgatggatcggccgcatccagcagtagcagggggcagtcgtccccaaatctaagcgtagaattttgtgaggctgccagacttccagaacggataatatccatatccgaaaagaccaagcctggccacgaatgcgcgctctcccggatctccccttcatcttttcttatcctcaggtacaagccaaaaaaaacaacaaatcacaacacaacaacaacccccgttgatcggttttcacggacagtgtcacggtgcagacaacgtgtttatcccttttcagactgttctttttggctaaaactttcagagtaacatcgattttactgggtattatgctgacagtactgcaggagtggaaagtattagcgaacactgtaaaaaattgtttctagctagcttccaagcagccgagagcctgagaacgacgtgcatgcttcagatatccaaggtctccgtccacttcatggattttatttttttcagcttaattgcag

SEQ ID NO: 20209 - DNA, 1317 bp, Oryza sativa
cactcaggtcatccttctaagcccgattctccacttccccctccctcgcccaccccgaatctctaaccctaaccagtcttgcgtgcgacttatcgtgacgtcacatgatttcctcacctcgtgcgtgtgcgcgaattaggattcccgcctttccggatgaaacataggcattgctcgaacacgtagagggctggtccagctggtgatgagctggtgacattatacaactatggaaaattacaagagtaatgtttctattcccgtctatcagtgatggagtcggaaaattttcagagcctaggcaagctaaggattgataatgagcaaagatctttcatacatgtaagattcatcatggttccttgtatcaacaaagcaccgtgtcattctgaaatttgaggaagagctagctataagtaaagcacagatgatccaaattcaatgcaaatgcaattgattaaaatcaagtatattatcacaataaactactcactaataaaaaaacaactcctatactcgtgctggttggccaattactgagtttgctagtactgctccttggcaaatcaacactttatttgggcagcaaggataaccactcgattgttgcatggagactaaatgatcataattttttttaagaaaaatgataagatggattaatatgtaatatataactctacaaacatataagttaaaattcaatttctacaagttgtaaaaaaatagcaaattatactatacctagtaaaatagcaaatttgagtatgtatattcacagtcaaatttgttattttttataagttgtacaaattaaagttgaacttatatgtttggaaagcgatatattacatattaatctatcttatattttttaaaaatattttataaccattgttgacatgaaaaatgagtgtaccttgacccgaatgtttaaaagagtttccctagcaatgattgcatgtaatttcaccagcacaggagagatgcagcactaactacatgatagattttcctggacgccgtccccttttgtttccatgctgtccgtaagtggaaccacatggaaaaatagggggacaggcgccgggctgtcgcccgtacgggaaaacacattatctgtgcgggcggctaagccaaccgcacacgaattttcacccgcacgggcccaccgcttttaaccgcgcccgcgcgcaccatctcccactccgcccgctcctccacctccctctctcccactccactcctctcctcctctcctcccactctcctctcctctcttcccctctctcttggccggccggcggcgcgacaaca

SEQ ID NO: 20210 - DNA, 1501 bp, Oryza sativa
ctagtttcttttttgccacacaatcaatccgcatatttgtcaaggacttgatcaagtacgtatgtacagttgattagaaacagtgcacgtgcctaactcagccagtacatacatatagggctacaagttcgctgaaagtatgcatgcgaagctgtgaaactatccaggagtcatctcaatacttgtgctgaagatccagttcgatcttagggataattgggccaggtgaattagccgattgtgtgcacacggatgaaatgttgaagcaggaaacacgctggtgcggcccatggaacattgcacgagggagtgcaaatgttctgggccttggcccttggggtcataggacaaagtaggaagtagatcttgatcctaagtgaacatgggggatgtggccgtgtgggcttggcaccaaagattttgattttgcactcagacctccacaaattcgatccttacgcattaataatatttgtggacatcaaaatataaaacgtggtgagtgcagtatacagctacaagcacgactgcaccacaacactaaccatgcttctcagagtttgattctctaagtagcgaaaaaaatagtgctccaatttttaaaattcccatttcaagttcccattttgttttgtaaaaccttcccctgctagaagcagctacgacgaacttgggcgctagtgaagttcaagtactgaaccactagacgataggggcatcactagacgatagggccgtatacccattgataagttgtgaagagtttaaccataggtaatctcttacccatccggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggagtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcctacttcacacctcggaacgcactgttcttatagagagaaaggggctttcccatcttcttaacccgaaatgaaatggctgaggagagggaggttccttttggggtacccccgggaagagatccagtggagacggggtgggcctgtagctcagaggattagagcacacgggactcccggatcactatggccgggagaatccctctcactttaaaacactagagttttgggtactaaaaaaacgagtggtttctgggctcgcctcttcgaggggcctccgctcgtggacaaactctttccgggtcttacccaccctcgagtccaatctcgggtgggcgcttagatataccctattcactagaccggaatccaatcctt

SEQ ID NO: 20211 - DNA, 1501 bp, Oryza sativa
tcaggagcaatgtgcgcctaactcgatctggctgtagtacgtacatacattgatggggagcgcacgaagcgtcaccggagcatgaaggggttgtttagattgatgtcatttcaaatcatactattttttttataaaattgttaaatatatgcatctatttagttttctaccaaactctagtaaatacataagtaatcctaccaaaacttggtaatattgttaaattgctaaaatttggtaaagtttattttggctacaatctaaatagtccggaagttttgtccgggcccagggaagttggaaacacaacttgaaaaagttaagcccatttaatggcccacttgaacatacctttttataagtatttcttccgtttcatatcacataagtcgttttgacttttttaagttaatttatctgaaagtttgattttatataaaaatatagtagcatttatagcacaaatttaattttattaaatctaatattggatatattttgatagattctttgttttatgttaaaaatattgctatatgtttctataaacttgatcaaagaaaaaaattaacttaaaaaaagttaaaacgatttataatataaaactaaggtagtattatatttgaggttggaagtattttgtactagcaaagaaaattgtaacagttaggtgccggaaattcccgatcgaccgggtgtcgtttccatttaaggggtaccgtttccgaccgtacctttttggctatttttaaattttgttttttttttcgaatttctttctgtatcatattaatgtcgatactgagtagtttaaatgataaatatggtcaattaacagccgatcgagaatcgttttcgaagagatgctacagattccgaccgtttcagatcgttttcacccttagtaacagttatctcgatttcgtttgcgaaatgctatcaaattttaagcttatgatatctgccattagattcactatttccagttcccatcttcatgcatacgccttccaatgggggaacttgtgcagctgtgtacatgaagaactagtgaagtttacatggtgcaacgagtcttctcttttgtcttggggaggggggtttcccgcaggagtcaggtaaatcattttcagaccatagtataatagcactctttatttatatattaagttgttttgatttttttagtcagacttatttaacattgtggacgacaacaaattagttttattaatattaacatttaatatattttgataatatatttgttttgtgttgataatattgctatatttttctttaaacttgatcaaacttaaattataaaataagaaggaaagagtagctatcagtatggagagggaaatgaggaaatattatcacatacacttgtacccactatattttgattttgtaggcaggcatgcatacacacagatcagtacacaatcaaatcttctagcacgtacacataatgatatgatcaagccacgtgtgtgta

SEQ ID NO: 20212 - DNA, 1501 bp, Oryza sativa
agaagaaatgttggatggttttgtctttatgacaaaagcaacactttcttactaccttgcccgacatgtcatactcttaaacttgtgctaactatgccacacttttgaccaactatttattggccacattttttccactatgccacaacttggctaagcttagttataacaatgtaggcatagggatggtaacgaggctacacctgtcgggttcaattatcctattcccatccctattaagaaggaaatcaatctaccccatccccgcactcggggaagggtttcccctatcactgtccccgcatagggttcgaggcacacccaccgaatagtaggagtgcagcaggccagtatgcggcagccatggcgcactcctgccgctgctgcttggacgcgtcatagcatcaggtcttgcttggaggcaacaatgacaacatgatgcgtatgaaaccaatgtggatgcattagccatggcacgacgcgaatgctcagcatggatgtggcggtgcaaatgtttagcatggagaggacgcgatgaggaggcgtggatccagtggcacggtgcaaaggacgagacgaggacacgggttggtcgcctggagtcttggcaggcttgatctagagcactcaagaggaggggataatatgcctagggtttccttactttctatacgagggacttgtgaattgggcctctcctaagtggacttataatttttatatggattgtgcgctcaagcaatatgcacatatgcctaccatactcaggggctcatgggaaattagggacggggggctagggaacgtcctcgttcccacttccccaatgcagacatattttgcccgacaacaacccccatgggtgatgattttatcccatttacatgccctatagagtaatccccaccggggttcaggacccctaccatccctagtcaggcatcaaccaaacattccctcaatagtacacaacgctacgatataggcatctagataggatctttattttaagaggcatccttaatttccataaaacattattactctctatataaccattgttgatcaaggctaaatatatagaatggaccaaaaattaattaaccactgtgatgaagattccatctaaacatacttttattatcatttagattaatctgcacaatataagcaaccaagttatgccatagcacaaggttttgacccacaaatgcccttcaagatacattgtgtgtaacagaattcaaaacaattgcaattgatgcactttttctacgaactaacttatatagaaaagggtattgctccttgaaagaagaattatcaatccacttatcttcccagaatttgatttgttaaatccaaccccccctacaaatcactaatcattccaatctcctaccctcaacttaataaaatcatcgattgtatactataaaaaagtatgtattaaatctcatgcccaataagagaagacatagggaacaacttcgctcaccat

SEQ ID NO: 20213 - DNA, 1501 bp, Oryza sativa
gggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccatgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaagaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaatttcatttcattcgtgaagccgtggagaatggggaaatcacaccgagttacatcggcatagaagggcaacttgcagatatcctgacgaagccgctttctcgaatcaagtttcaggagctgcgggaacaaattggtatgtttcctgtataatcggcacatcaagcttagggagagttttgttagcagtaatcttgtgtgccacggttagttagttgattagttatctgcatgtttccgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatgtaagtaaacagaaaagcagctgagaaaagcgctgcacaaaatttgctctgtttcctctgttctgcgaatttgcaggtttagccacagtacgcgtgcgttgtgtcgtctggtttcctgctagcgatcgctggggaaattcctaacaattggtatcagagcacggtttaggaagtggactcgtgaccgcgcattggaaggcgtcttcatgccgcgtcgtcgctcgtcgtcaccgatcgtgcgcactcctcatgactccggcggccgcgccacgggcagcggcgggggtgaccgcgggctggtga

SEQ ID NO: 20214 - DNA, 1501 bp, Oryza sativa
aatcgttcgtcctgctgcttccgccgcatccatcctggtgagcacatcctccgccaccgccgcctgcgtcgatccccatccatcgcgcgagcgagcgcatagggtcgccgtcgttcctcctgctgcttccgccgcatccgttacgcacgtcctctttcccatctctctctctctacccacgcactttttctcgaatttgcgttaaccctagcttctgttctagaaatttaactcaaccttagtactaataacagcttgatggttcgcaagaagtttgggggtttaactgaaaccccatgtcccatgttagatccgccactgatttgtaattgtcccaaatgtccaattagcatcatcagcactaaccattttggatggtgtccttactgtccttttcaagctaaattggttgactaaagttccaattctttgataatagcttgatgtgctaggtttaactttgatgagtaattctttaccagccaaaaatctaatccatgttgcttgcaaactagaactagaaaggcccattttggtacggaatatgaaatgaccaaacaactcatgatcactaggaactgagtaagggacacaggacgtgacctgacaaaattgtggtttgagtcgctaaacctatttggatgaccctcagccttgttctggttctgtctacccagaactcttggttttgtgtttaccatactatgcaattgacctagaaatgattgtttatgacttactcctatgttccaaaatggccatccaagtatggagagagttttgtttctgtattatatgttggtataaatatagagactaccaccaatgatttttctgttctatttcagctagaagtaaatgattgctgcagaccacattttgatatgattgtttattttctttgtgttaaacctagtaactcagttagtatggatagttctgattttaaatttttcctattctttatttaaggaactggttttcctcttatttcttgtgagcacaagtcattggcgaccattcctatggatttatggttgctctaaccaccatgtcgtaaatgcttcacttgtgaagaagcagcacatgttatggccttataggccagtcatgtagtcatgtatgattgtccatggcttgttgccgtggcttatgtccacttaaatacaaactacatttatattatacacaaaaattgatacaaattgcagattggatttaacgcttgtagtgttaagaattattgcgtggcaactttcataagctaatagctttgtcttggatgacgttggatagagcactcttgttttgtaagggagcagctacgatcagtttactagacactagatagtgtattctagtctaaaaaaaattcatcaaccttttttttttgttatttccttgtatttgacagctctgaattctgtctctcgggtttgttactaatatttgaatttggtattctgcaggtgaatcaagcatcctaattttgtcaagatgt

SEQ ID NO: 20215 - DNA, 1501 bp, Oryza sativa
tgccgcgtcattttcgccgccctctgggagggcggcggtaggcgactacttccgtcaattttcaaaatggaaaattatttttgtaaaacttttaataaaaaaaattataaataaaaaaaattccaaacagcagcccgtgcagtcccgactcccgacgcggattcatgacgcgtggatgaggcgctcatccgatggccggcccacacaagcaagtaatcgacctgcacggctcagaaagtcaaaatctcctttgataccaaaataactcaatttagagcaagtttaatagtatagtccagcactagctctaattcatttatagttaatctagtagttaattcatacaatagttacttactatactattaatatatggtcccacctgtcatatacacattgcgtcttggagtccgcgctacagctggctacagatctgtagcccgctgctcttctctcatcttttatcttattaaaatatatttacagctggctaatagcctgctattgtacctgctctaagagcaagtttaatagtatcgcccgttgatgggctgaaaatttgtacacgtaagtaatagatggtaccaatagatgatacgtataataactagctgctaagttacctacccacacatccctaagcagttgatttttattattttaatcagacttgtttccttcttcccaatctttgagagcaggtacaatagtgggctaatagcctgcttatctaatattttaacatatatgatagagagagagaaagcaaagagagcaaagcggacgacaatccagtcgctggctcaagcacaagcgcctaggcactctggccccttgcagctcgggacaaccaatagaaaattagaacttgaacatgcagaagttaccaacacctgacaggatgccttggttaaagcatgggtgtagccaattgatgtatctactggggtttagttatctcttaaatgatgtggtgaattttagagccggcagttaactctactattgaacttgctatgatggagtaatggttgagtcattgggcaaaagctaggactaggactgagggctggttctcaggactttgcatcgtttcctgtgctggagctcgacgattgcattggcgcccgctgccttctctctccggttttctctctcttccacctatgatttctataatatggatgcttgtatcgctggcttatcatactctattatacctgctctaaggaggggtttcctcctaaaataatgaatctggataaaagttttttttttttttgagggaggtagtagatggagggaggagatgagtagtcccggctgcctcgcactcggctgggctcgacaatacgcatcgcgttcgggaatctttcctcgttttctcccctttaactagcacgatttgcatacggagtactccctatacactcatgactggatcatcagagccaaacttctcacacacacgctgacgcctgagtgctgaccggtgcgcgcc

SEQ ID NO: 20216 - DNA, 1501 bp, Oryza sativa
aaaaccacgataacctccttaaattcaaataaatttaaaaaataatttaattttttgataaattttgcacggtttcgtacggtttttcacgattacagcggttaccgcacggtaaccgtgcttaccgccagggcacggtaaacccggccccggcggtttgggaaaccctgctagtacatcacaaagtcctctgcgttggtatgcctggcactaggcataactggttttttttattccatccggtcataaaaagtttgaccaaaccttatcctaaacgtcaaatattttttatcgaatggataaaccaaccatgcaacttttgaaaaaaaaagtagttttgtttggagtcctctagctaatttggtgcttttcctacttttacttccttttggggaggatggggctggggttgtatcttcctttggtaaatagaaagggcatgtgtgcccagatttgtctttcatcagataattgctcccccagatttgctaagtaaatgaaacttctgtacttcaagataacactacagatcacaaaacagctggtataatggcacatctctatgcattaataactgtaaatgctctaaaatatgcgtgtccaaggtcttacattacatgtaagtgtttccattctccattatctaaaaaaaaagtgtatccattctggaacaggaagatgttaatctcatgaaaagtttgaattttgatgcctaccggttttcaatctcatggtccaggatcttcccaggtacattgagtctgactcagattgtagcatgttgccctgataccctgcatcattttttttaatgacaatttgttactgccaaatatgcgcctttggtgtacctagatggtgagggacgagttaaccaagaaggcgtagcatattacaacaatcttataaactaccttctgcagaaaggtaccgcttgatctcatacttgaatcccctgcaaaagaaaaagatctcatacttgaaactttcaaacttccatggaaactgagtgctgtataactaaatatttccttcaaaccaagcaggtatcactccttatgtcaatctttaccactacgatctccctcttgcgcttgagaagaagtacggaggctggttgaatgcaaaaatggcgtaagtcaaattagtaatttatcctagctttttgtctgttaatctattagaactctcgtcatttgttggttattgacttattttagacttggttttaaacatagaagcacacatgataagtatgaatgcttgggacaaaattatcagtttcttaacacaaaaattcctgactaaaattggctccaattctagacaaatgacaattattatgaacgtgaaagttctattgttctgtcaaaagaaagctgcactgcattatgattattggtacctgttgtctagctaaatgcagcatcctgtatctctggcatcactagctgtataagtaacactctgaagtctggattatcttcatactacttgttct

SEQ ID NO: 20217 - DNA, 1501 bp, Oryza sativa
gatggctgccaaaacagattgtcgattgactctactcttgatgtttgaagcagtaccatattcatcacccagcatcttggtcacacgggagacttgatcacgtgggggcataatcagagagatcatgcttgtgccattgcctctagcagactccagtgccttgatcaacttcttaatcttccaaatctcaatattcttgtcagtttcttgaccatctgacatcttgacaaaattaggatgcttgattcacctgcagaataccaaattcaaatattagtaacaaacccgagagacagaattcagagctgtcaaatacaaggaaataacaaaaaaaaaaggttgatgaattttttttagactagaatacactatctagtgtctagtaaactgatcgtagctgctcccttacaaaacaagagtgctctatccaacgtcatccaagacaaagctattagcttatgaaagttgccacgcaataattcttaacactacaagcgttaaatccaatctgcaatttgtatcaatttttgtgtataatataaatgtagtttgtatttaagtggacataagccacggcaacaagccatggacaatcatacatgactacatgactggcctataaggccataacatgtgctgcttcttcacaagtgaagcatttacgacatggtggttagagcaaccataaatccataggaatggtcgccaatgacttgtgctcacaagaaataagaggaaaaccagttccttaaataaagaataggaaaaatttaaaatcagaactatccatactaactgagttactaggtttaacacaaagaaaataaacaatcatatcaaaatgtggtctgcagcaatcatttacttctagctgaaatagaacagaaaaatcattggtggtagtctctatatttataccaacatataatacagaaacaaaactctctccatacttggatggccattttggaacataggagtaagtcataaacaatcatttctaggtcaattgcatagtatggtaaacacaaaaccaagagttctgggtagacagaaccagaacaaggctgagggtcatccaaataggtttagcgactcaaaccacaattttgtcaggtcacgtcctgtgtcccttactcagttcctagtgatcatgagttgtttggtcatttcatattccgtaccaaaatgggcctttctagttctagtttgcaagcaacatggattagatttttggctggtaaagaattactcatcaaagttaaacctagcacatcaagctattatcaaagaattggaactttagtcaaccaatttagcttgaaaaggacagtaaggacaccatccaaaatggttagtgctgatgatgctaattggacatttgggacaattacaaatcagtggcggatctaacatgggacatggggtttcagttaaacccccaaacttcttgcgaaccatcaagctgttattagtactaaggttgagttaaatttctaga

SEQ ID NO: 20218 - DNA, 1501 bp, Oryza sativa
acacaagttttccaactaccggaattcgaaccagagcgagagtgcagcagacttgcaaaactaaagaaatcactcctttttataataaaaaaaatcaagaaaaatcactcaaggagtgcaacaaaagtaagcagcagtgacgtcggaagcactggcctccgaatattttaccgtccgactccgactccgactcagaaagggcccaaccgttccacataagctaacgaccgggtaccgccacggcccactcacgtccccccgctctctcgtcgtgttcaagtcgcgagcgcgagtttctccgtaagctacaaggacttgacctgggaacccgcctaattgccactcattaatccttttcttttcctcggtcagtttagagtacggattagtagactgaatccactaacccctagcgctgttgcatattaacaagctcataaattcttagccccatacgcatagaaggagtagtgttgcacgctcgcaccggtgcacgttggtggatcgatcgatctccatggcggcgcttcaccaccaccaccaccaccacagccaccagatcaaggcgccggcgccgacttggctcatcgtgaaggctaccccgccgccgagggacggggccaagaagctggccgcggcggcgtactcgccgctcctgctgtcgccgtccgtgtggcagaaggcgcaggacgccaagaagggcaaggcggacggcggcgacggcgccctcccggcgtcaccgaggatcacctgcatggggcaggtcaaggggaggccgaggagatgctcgggcgcgcgccgcggcgaccgtccggccgcgagggccggtagctcgggtctactggagcggctcacgctggggctgttcgggcggcggcggagggggaggacgtcgtcgcgggcgtgctccaaggtcagggacgtgccgacctgctcgtcggcgcagtcgcgggggaagatttattgcggccgcggcggcgcggcggcggtgtgcacgcttgacccgccgttgccggtggtgatcaggcggcccgcggcggacgacgaagcgccgacgctctgggagaggcggcgcggcggcggcgggaaggccctggagactctccggttaacgtagatcgctggctcgctgcagagttgcgcttggcaaccgcagcccgccggtgagtatattgacagaggaggccaaagacaaggaggcaacggacgacttcagccgaaggctacggatgcggatgctaatttcctaaaaatttgtccataataccatgtatgtttacagtttaatcatttctttttgctaatttgtatagttgtatctacttgtatgttgatcctactgtccattttaaaagtcttgtctctacgatttggaagctcgcccctttttttctccccacatatcttctccatccccttcactaaggcatctcctcccaaggtctctaggacgctcccggtggctctgcctccgaaacactcacgtacttgctcccgccat

SEQ ID NO: 20219 - DNA, 1501 bp, Oryza sativa
accggtcagcactcaggcgtcagcgtgtgtgtgagaagtttggctctgatgatccagtcatgagtgtatagggagtactccgtatgcaaatcgtgctagttaaaggggagaaaacgaggaaagattcccgaacgcgatgcgtattgtcgagcccagccgagtgcgaggcagccgggactactcatctcctccctccatctactacctccctcaaaaaaaaaaaaaacttttatccagattcattattttaggaggaaacccctccttagagcaggtataatagagtatgataagccagcgatacaagcatccatattatagaaatcataggtggaagagagagaaaaccggagagagaaggcagcgggcgccaatgcaatcgtcgagctccagcacaggaaacgatgcaaagtcctgagaaccagccctcagtcctagtcctagcttttgcccaatgactcaaccattactccatcatagcaagttcaatagtagagttaactgccggctctaaaattcaccacatcatttaagagataactaaaccccagtagatacatcaattggctacacccatgctttaaccaaggcatcctgtcaggtgttggtaacttctgcatgttcaagttctaattttctattggttgtcccgagctgcaaggggccagagtgcctaggcgcttgtgcttgagccagcgactggattgtcgtccgctttgctctctttgctttctctctctctatcatatatgttaaaatattagataagcaggctattagcccactattgtacctgctctcaaagattgggaagaaggaaacaagtctgattaaaataataaaaatcaactgcttagggatgtgtgggtaggtaacttagcagctagttattatacgtatcatctattggtaccatctattacttacgtgtacaaattttcagcccatcaacgggcgatactattaaacttgctcttagagcaggtacaatagcaggctattagccagctgtaaatatattttaataagataaaagatgagagaagagcagcgggctacagatctgtagccagctgtagcgcggactccaagacgcaatgtgtatatgacaggtgggaccatatattaatagtatagtaagtaactattgtatgaattaactactagattaactataaatgaattagagctagtgctggactatactattaaacttgctctaaattgagttattttggtatcaaaggagattttgactttctgagccgtgcaggtcgattacttgcttgtgtgggccggccatcggatgagcgcctcatccacgcgtcatgaatccgcgtcgggagtcgggactgcacgggctgctgtttggaattttttttatttataattttttttattaaaagttttacaaaaataattttccattttgaaaattgacggaagtagtcgcctaccgccgccctcccagagggcggcgaaaatgacgcggcagccggcc

SEQ ID NO: 20220 - DNA, 1501 bp, Oryza sativa
ccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgttgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggctaacccgtcctgcctgtacaggtgtgacctctggctgctctgagtgtgcgcctctggagctcctccaagctgagaggagcctacttccgtcaattttcaaaatggaaaattatttttgtaaaacttttaataaaaaaaattataaataaaaaaaattcctgctgtttgcaccccgtctgcaccagattttttttccgcagattggcagctgcggtagtgacatgtgggccctgggccgcacgttggttacggccgaggagttgcttcttcgggaccgaaacctatgtgcaatgggattttttttttcatttttagatttttttaaaatatttacagaaataatctatcggccaaaaaaattgtaaaactagaccctgccgcccatctctgaggcggcaagctgacgtggcaaacggggaaggaacgggcggtgacggagggagggtttttttgcaggaaagcccttgccaccctctgttgaggtggcaaggggcctgaatgcaaaaaaaccagtcggggccggtcattttgcaggcggccccttgccgccctttggccgggcggcaggcctcgctgcctataaaaggcatgctggccagccctcagccctcattcctcccccctcaaatccagtgaaaaaaaaagaagaaaggggaggagaagagaagaaggggcgaagccctgccggattcagacgccgatttcaggtaatattcatatatcctatatgtgactatagagttaaatattgtgtattttttaaaactttgtttgaataaatgcattatatttttagggttttatctgtactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcgttgacagata

SEQ ID NO: 20221 - DNA, 1376 bp, Oryza sativa
cggcacgcgcgcgcggaaagcaacgtgcgacgcggcggtttgagcggcgcggctcggcacgcgtgttgactcgcggggccgagcggctgcgcggctccaggtgcggcagggcagcgggcccgggcggcgcagacggcgcaggcgcggcacgggcggcgaccacgcgggcgcgcgcacgcgagcatcggcgcgcgggggccgattttggggcggggagctctctagggatggcggtggggagagggagagcgagggggggcgctcggtgcggcttacgcgcacgcgcgcgcggcgcgcgggcagagcgagggagagagggagagagagagagagagaggggaagatgggccgagagagattcggcccatcgaacccgagggaggcaaaatagacttttgcggaggaattgatttgggaaggatttggattcgggattgaactcgacgattgatctgggatttaagatctgagaaagcacggacactagacaacaagcaaagaaacagatttcgcaaataggatttttaagagataatttttcccgctaggcgccacgacggaacgggcgctacagtcggctcggttgcgggctgaagaacaaaatgggctgaaaaaggcccaaatagaaaggaagatttttatttaaataaatgttgaaatgatgtttgtattattaaaattagcaattaagttcggaaattccaataaaattccaaagagcgtaattaatcgtggggaatttaataaaattaattccaaccatatcattttatttttcacacttactttacttgtaagctagtaatttaattattatacacctagctacttaaaaaatacccagatatcttaggaaatttgtatttcaattaattacataatgtaaatctttcttaacttttccttaattttctggtctttatatttcccgttgcaacgcacggatacttttactagtaacaataataaaattaaaatagttttcacctattgcaatgtacggatatttttttttgccattgatacatgagagccataaactatcttgcttgtgttggaggcttgaagctgtaacggataataataataagaagaagaagaagaaaaaaaaaaagagaaaggtggggcccgcaaggtaggggaaggggcccatgggccaggccagaagaggtcgggttcggagatccccattaccactagtcctactgtacttcggttacggaggagattttttttctaacaaataaactaataattattataaagggaacagatccccggtggggcgaagaccgaaaccctagccgccgcctccgccgtcgccgtcgccgtcgaaaccctagccgccgcctcctcccgatccgaccgtgtcgcca

SEQ ID NO: 20222 - DNA, 1501 bp, Oryza sativa
gtaattttttacgcgtttcgcagttctaccacaacatctccaatggcctgaaagatgtgatgtggaagccggagagtagcataatcgcaggcgatgagatccagcatcggaggtcaccgtgattggcagtttggcaccaaaagttcagtgatagtataaagtagataaccagccaggaaaacctactaaggaatggcctgtggctgtttttttttttttggttctttttaccttttaagttgagttactatctaatctagacatggttgtaaacaaagtttgtatggagatggaatgtgaatgaagaatgtgcatagttttgcttccttgacttattttaaaagcagtaacctgtgaaatccgatgaatgaaattgaaatctgcagcaggatgcctgacgatcgtagaagacttgcagcagatatgagattacatatatcctctttatttcagttttgatgcaattcgtaaatcgcaaggctcccatcggatggcctattcagccaaagaaaaagccaaaatttaaattttcaaacttaattttgacattgattttgagatattttcaacgtagtttctttttgagcattgacttttaagtcaccgagaacacatatataaaagttttacctacaaatttatttttatactctaataagccgtttaggaaaaagcaaccgatgagccccaacaatcgagagcgatctccaggaacagataaactgcttgctctctgcgtgttcatgttcaccggagagtgcggctccgtacactgttacgtcgccggcggcaaatcaggcggcgcagcgtctgccggctatggctggtggccggaagcgcgcagctagcggcggaggagcttctccggtcgccagagtcgagcacgacgtccgtacgcccggcccgacccggcccctgtacatacattgccaacaaatctcggcccgcttgagggaaagataataggcccatctaaacttggctcgctaccaatgaccatggaaaaaatcccatatgattaacttgtcggatctgatttgtgggtcctactttatttctagggcaggtttagattccctggcaagttttttcaccctatcacatcgaatgtttggactagggatgacagtcgggcacgggcagtgagataattcatgtccgcgggtatacccgttactacatgacgggcaaggaacactatccatgcccgttgcccgcgtttacccatcacagactcacggttcaacgctttaaccccaaacagagagacattatcacagtttaaagaaaggtacagttgtaccaagttcaataatacaaagcattacaagttcatcattactggatggtggcatttatactaatttaactgagggaccacatgtcagtcagtttttgtgggtaaacgggtgaaccatgcccgtatacccgttgggtataggttttgacccaataaaaaacccatgggtactaaatggagaacaaatccaactctattagt

SEQ ID NO: 20223 - DNA, 1501 bp, Oryza sativa
atacgatcacatgggtggtctcttgatcatgcatagatctcaggtgagttcattggtgtcacaaagtgctcactgcacaaactgaactttttttgtgtgtgtactacacgtacgtactaatccaatttacatgttagtgggttcaataataaataaaatcaaagctcgacatgcataaacataagtacaatgatatcttgctaggaccacttgtgttgatgaagatgtggcttccaccaagcacaaagttaattaactttaattatgtctaattatttctgatctcaaactcaatcttctcatctcatttgtcatgcaattttttttgttttacatgcactaaccaaacagcaaaagcagttggacagtgagataaatgaggatttgtgctctcttatggagacaataggtcatctcaactttctagccagtagatctcaaaggattagtgcttgcatgcatatgtatgagagctagtaataaccagatgattctggaaattggcagtggatatagaggctgggtttttatccacaattaaaaaatgttggttctggagataatatatactccctccatttctaaatatttaacgccattttgattgttttaaatatgtttgactgttcgtcttattcaaaaatttaagtaactattattttttttctatcatttgatttattgttaaatatacttatatgtatacgtatagttttacatatttcacaaaagtttttgaataagacgaacggtgctaaaaaatcaatagtgtcaaatattttgaaacagacgagtatattagtatacgtcatctgattagcttataatactactgcattattttgttttatatgtgtataatactacagagcatgctccagctctgtagggtttagatcactaatcaacaaaccctaattattaacctatcttatgtccctttcttggcatgtggttgcaaatgatctggtggtctcctatgggtgaaatattttagtacaatgattgctgcaaattgacgagacaaacaaggtgaatagaacaagaacgaggacggtgactggctagattctcttgatcctgaatattatgctaattaactcgatcttatctaaaaaaattatttcgccaagtaggttctgtcttcttctcgccaaacaggatcttgggaaagttacatgcattattttctcgccaaactactgtactagctaccgctccaaaaataaataaatatatagatttttattttgatatgaccattgcgtgcaagtggaattatattgtgtttataattttaattagtttcttgacaacaacctgatctttgtaaaactattattggtcttagttttagtttaagttattaattaggaagagatgcttacaatgtgtgcttagtttgagctgattaattaattatttacttgacaaagtgttttatgatctctaggtatgttgttatggtaatatggtgtacacgttttgttaaaatcagaaa

SEQ ID NO: 20224 - DNA, 1501 bp, Oryza sativa
gagataatattgatcagtctagcaccgcgttaggggtggacccaggaggatgggacttgtggggcccagctgccagtgagagagagagaggggttggaacttggaagctagcagccggcgattctttcttcggttaatttcttccccaccttgtgttgactgtttgacgttgttttcgcgacatcgagatggagatacgtgtgtaacttagctgattcgtctgaaatttgagctcgtggggctttttgctagggttgatgtgctctgctttgacttcgttttgaaaatgagatgatcgatgctgtagctaggtgtcatgagcttatgtcgctccctgtatgtggacagttctcggttgatttttgttttttttttgtcacttgaaaagtactacctctatttaaaacataaggattcctaatttatttagcatagactaattaatgttgagaagaaaagatttattggccttggtaaataagggacaagtggaggtggaaggataggtgggggtaagaaggaagaaaatttgaatgaaaagggacatgtaatactgtcgctagaaatctttgtattttagaataagatttaaacgctagaaattttatattttgaataaatagatcactctcattggatcgaccgtaacgcacaataatgtgtatttagtcttatccgcttgcgtggattgtctttcacatgatggatgacgttatttcattactattttcacttttctaaaagatatgattgattgtaggataatatataattgtcattagcactcctctaataatttatttcaaatcaatcacattactttattacttggcagtttatccaaaaatgatgcatcattgtttggaatggagccaagtgtcaaccttttggattctatctagagccagacctcctttttttttcatgaacatcaggatatgtaccagcgtaggtgatatattgatcccagcaattttgtcttgaggttcttgttatatattactctccccttcattatatatatatatatatatatatatatatatatatatatatatatatatatatatatatatatatatatgacactggctagttaaaatttgaactagccaatatcatataaaaagacatagggagtacttctctgctgggctagagacaattatatatatatatatatatatactatatgtatatatgtatatatatatatgtgtgtatatatatatgtgtatatatgtatatatatatatatgtgtgtatatatatctatatatatatgtatatatatatatatgcatattttgattgtgataattttgtaatatataaatgaaaaaaaattaaaatcatacacttaaaaaacattaatatattttttaaaaaatactacactaaaatcctacattaatattttttaaaaaaatttttagtgaaaacattaaaatcctacactaaaaaaatatagcatcagcatgagctatgtgctcaattaatt

SEQ ID NO: 20225 - DNA, 1501 bp, Oryza sativa
caccccttaagatcaacttagacacccgcatcagcttaaatttggtccaaagtagagtaaagcaagcatgtgatacatctctccatttcgcactaacttcgcccctacctccatgtacatggatgctcatggcagcatgagatgctaacacttggtggcggttggtcgtgctagttctgcttccttctcccggcatccgcagctacaactggatcagataacatcatataacaatcacggcgtcatgtctggatctaacgctacttcaactttgctgctcaaggtgttaggaatggatgagatttgctccggtccaacgaaaagtatctcgagttactggtacctcacggtaccaaatcatttccaattgttagatctaacaatacacattatgtctaactagatttaatgatcagaaataatttggtaccgtgaggtaccgatacctcgagatattttttttattggatcggagtaaatgagaacagagggagtactccactcgttaagatttattttccataacgcagggattaataaggacagtggttaggagtaaaagataagctacccacagtgccactagtaatgcaccgacctacgtttaatttcatattaacgtactacgtgtttctttctcttcgatacaaagttgagttacgcttatgcatgcattgcacacgaatacttagtacacgaataggctcgatcaggaatgtaaaatactaaaatctgcacaaaatttactttattgtttaattactgtcccggcaatgttagacaaaaacaaaactcagtagttactctttttttaataaaagggagcttggtgcaaggagtgctagatcgatcaggctacagggagagaatcaaataatgtaggtaaaatgatcaggttaggtacgtttatttgtggtataatattattgggagtaaaaacataacaacttgttaggtaaactgatattttcatacctactacacaatagtcagttcatataaattgaactatatcaaaaaaaaaaaagcaccattcatcctttaccacgaaaatatgtaacattaactgcatatatcaatatactgtttacagacaactcgctggctctgttagagataagatccccagacaactcgctatgatcagaattgacacctgaaatttctcgaccaggaaaatagttaagcagggcaggaaaccccaggattatccatcaaccaaccaactaggtgcttgcttcagattttcatcagtacatcatctctaatcatccaggtaaaagacaagatcttgtcacgtgatcatggccccatgacacagtattatcatagctactatccaactgacaattgactaacaaatcatagtcactcactgtctgctactgaaagccttcctgtatttaaagccatggatatctgatgatgaactgcataagagatcatttgcattaatttcagagatagagtgagtgatcagttgagtgttgttgcataaaca

SEQ ID NO: 20226 - DNA, 1501 bp, Oryza sativa
acttgtgtcggaactacattttcaggcccgtccacttgttcttcgccatgacatgtccatatttcgtacttgtccataaatccacgagttactaagtactccttcacgttaaaagcattgtcaaagttccaggctatttcattcttactgtcagcgcatggacaaattatcttcctcatattgttcttctcagcgtgtgtcttggcaataccaataaatttagacactttgtttctatatggagacaaaaaccttggccaatgatacatccattcccgactttccatatctctaaaaaaatacacgtaaaatatttgcacaattaataccaaatttgtagggtttattgaaaaaacttatcgctattcaaaactaattaactaaaggttaagtgtaaagtaataaaaaaatcaaagtttatttcaattttttttacacagacatgccaaattagtacattaggaaaatctaacaaaatcatatcatcggcatattacaaaatactataactattttttgattgcaccgaataaatagacattaaaaattttattctctccctatatatgacaagatctagatctagatctagaactaagaggtggatgtgatagcaaaaataaaaaaaattgagaatttatgttaccacattaaaccactacaacaagaggcatcaagtattacacatacatctaacatcaacatatcaaaagaaataaaattaaaaaacatggagctcttccttcacaattttgcatgcataaatccatcacaaattaaggtctaaaagcttaaaaaattgcatacctagtgtggaaatgagtagatctaagtaccgtagaaaaatcccccgaagatttgaagttcaaaacatcccccatatatttaagtcactttaggagagagaaacttcggggagaatgaacagggctcggggaggaagaagactatatagaggcatctttttaagccggccatataagcggcgcctgcaaagataaatcttcgcaggcggaccgccccctccaccccgggtactttttttgccggcggggttttggctccgaattacttgtccgcctgtgaaaatcgatcccctatgacatcgaaaatgaattttctagtagtggcactggggaagccacagtggatcagatgcgagaaaacccattcctatattgcttcttcttactagatgatccttttgcttagcttagttgacgttgagctgattcacaagagttattattctactgcatgtttgtgttgttctacaggacttgctatgctttttagtattcaataatctcaaatcgtggcttcagtagtagtagtagcgtgtttttttttttttgtcaatgaagcacggagactgggactagatcactagaatgaactgtatgtaaatcgttgccatgcaacgtcacaaaccgtatgttgagttaagctatgaatttgacgttggtatggtgttgatattcacctgtctcattttaagaat

SEQ ID NO: 20227 - DNA, 1501 bp, Oryza sativa
tcggcaccctccgatacaaatcccaaaaatgaaagattgaaccctgaccctcgtgtggtttgagccagtactaatgacaaagtttgagcagagaagaatgcttacaattggaattattaggttacatttctgttgacatttttggagattccaaagatgattgaattttgacaagttcgaattgatactttcttccttttctttgaagaagaaaaaaaaataaaactttgattgatccgtacaaatgggccttcgtgggccgtgcgcgcgcgactgggcgagatcaagcccaagttcaaggccttagggaggtcgatcagagttttcttctccgacccttcccctctggcatggacgcatggtgatacgcgcacgacgacagccgccgggttcgcggccatgatctctgtctggctcgcgcccgcccggcgcacgcatccgctgatctcgccgccgcaggtgaacaacgcagccgtgccggcgagcacgccgacgcgcgcgtcatggacacggccaagtccctgaacaagaacagttcgaggtcgacatcgtcggcctcactgccttcccgtggtcgcctcgccggcgccggcgccggccgatgacgactgaggactgaatccccggtggaggccgtagactgtggcgtccgcgagtccgtttcggtgtttcaaactccgaaccccattgacagtgccggttacctcgccatggcctcccttagcttgctcacctcaccggtcaccgcacgcaccgacttccgaccaagttccgggcgccatcatccaatgcatgtgtgcagtgtcagtgtgctggtgaagtggtccgtatactccgatcccaaggggtcggagtcttcttctccgaacccccttgccacgtcaacgtaactccggttcattgttcgtcgactcgccggagcgccgccgcccaatcctggcggtccgctgctttggccgctctccggcggtcgcacgcgcaggaacacccacaggcatgcatgcatggtgatctgatctgatcccgtccgcgagctacgacgagaacgttctcgccacgccgcacgacagccggttcacggccatgctcagtctcgccgcttttgccagccgcagcgcgcggggcaaacggacgccatctcggacgctacgcacgccgcgtgcagagcgtcggcgtggcgaccgcgcgcatggccaggcagagggtgtgcagattaacctgatcgatccccattggaaattctgaatggcatgcagattctgcagttcttgtgggaaaaaaaaaaggagctcttcttcgaaaggcgttgttgttgtattattgggaatgtgctctcagagacaggcatgaactgaattactgaaaccatacaaggttgaagtaaaaaatgccgtactgttcttcaattgcgtaaatgatcatgttagagtagatttttttctctttttttttgaacaatgatgttagagaagaatatcatggtgcattaattgtttgtttg

SEQ ID NO: 20228 - DNA, 1501 bp, Oryza sativa
gagtatcaattatttcaaattcaaaatatattagtttgaaattttaaaataactttcctacagaaaatattggtaaaacacaaaacgtttagtttttttctcgatcagttgttgccgaacgcagccggattatctgatttttttttcagcttgtagctatttgaaggtactactatgaacatgccctcatattcgagaggaatgaggagtactatgagatatttcaaaacatggccaatatgtaatggatatatacaatggcgaatctaagatgaaaatagagatggtgctaatgcatagagctaaaaatataactcagtactagaaatcatatttcctgaaaaatatgaacttaaaaatatccatgtttcattttggaaaaacatgtatgctcagttgaattaaaccctccaattaatgtgccctaatcagatacaaaccaagagctccttgtagatggtaatatctgtgttgtcttgtcctcgccagtttggtaattgaattggtaattgtcctcaccggtttggtaattgaattgggcttggtatagcatttagcaattaataaacactggataacagattgagcactaatcaaaccgcagagctataggcaagttttcttcctctctagtcgctgcaggccccaacatgtatactctaactgtcccagtgtcttctactagctttgaacttattgggagaacacttggggctagaagctggagctagggcttgcgctccaacaagcccaacagtgaatccgcccctggatatatacatagcaaaaagaaacttttggaaaaagacaaaaaaacaactctcttgatagtatgttgtgatgcacatttgatcaatgtatgcttttaacttgttatttttagggtattttaaaaatatatatacaagttagataacctatataaaaattctagatatgttagtgaataaagttcatttgtatttctagtacaccgtattaatagagagcaactagtgtggatcaagtacaaagctaaaaatacaagattacaaccctggagggtcgtaaccaggaaaaaagaaaaaatataccaccacccacacaccgacaacgccaacacataacccgggagaagactagcaccggaccggccgccgctaagcgtgaccgaccgccgctagaccaacaaaggtacacagacgagatcgccccctaggggatgctaaaacgacgtcttcaaaaagagaagcgacggaaaaaccaccgccgccgtccgtcggggctcaaagaagccaaagactaggctttcgcccggcaaccacccttagggggtgagacagcacgacaacgccctcaggattttcacccgccgctcaccacctgcgaatccacggctgacgcaccgatgctccatcaccactcaagctctactgacatgtgggacccctacaccgatgtcttccgctggtcagccttcgagcgccgaagaccacgcacacccactggcaactcctcctca

SEQ ID NO: 20229 - DNA, 510 bp, Oryza sativa
gagagatccccccctttatatatgccttcttcctcctccagcccgagagcaagcttcaaaatttctcaaagaaagaggggaggtcatgccaaaatatgttgtgaaattcttttagtgattatatacaaatcggaggtgtctaaaaggttagtaacttcatcatccaagatttttttttgttgttatattacttttggagctatgtttcacacattttttttctccaaaactttgttgtaagttgatgagagagaaaatttgtgtggggaagaagaatatatagaaattttattctcatagtttaaaatatgatgaaaattacttaaaaaatagaaaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacaattttttttcatttcatgtaga

SEQ ID NO: 20230 - DNA, 178 bp, Oryza sativa
aaaactttcctgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaat

SEQ ID NO: 20231 - DNA, 710 bp, Oryza sativa
aaaactttcctgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagacctagaaccaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttgatgatatcgttgtctgcgtacacacccaggtctccagctccatccttcacagccttgctggccttcacagtgagcacgcgagggcgaagaagaaga

SEQ ID NO: 20232 - DNA, 1501 bp, Oryza sativa
ggtagaagcgaactccccgggtgggtgggccccacggcgattccacgccggcgacgtgtgcgctgcctctgcgcaccgacccccggcccttcccgtcacatttccacaaaaaccaagggcttaaacgaaaaaaacccctgatatttcgttttcttggagtttggaccaaaaccgaaactgcaaaagcgcgggcgggagcgaaactttggcgaatttacacctaagcccctaggaattccggtaatttaccaagtgcccccccgcctctcggatacttgtgcgcgtttcggtttctcccccctttcttctctgcctcttctgctgctgctgcttctgctccagtgtctggttggcttccactcctcgcgcgcgctcgtagcccgcattggtggaggcggcggaggggctcggatccggctgccgcggcggggggaggtgagggagatgggaggcgagccggcccccccgtggctgcgcgatgtgttgatttcattttttttgggcatttttgttctggattttgttttgaactccatttcggatcgattcgagtttggagagggtgtatgtgtgtgtatttgtgcgcgtgtgggtgggatttctccggtgctcgtagtgtggcggtggcggtgggttctcgcggaatgcggtggggtttatgtgctggatggtgctagggttttacgagcatttttgggggatttttcgggtgtggttttgatcctctgtgatgaattctgatccgtggtgagtttgcctgtgggtttgaccgacgactttgctggaattttggttttgaattccgacccaaaacgatgggttcctgctctgtttctacatttgacaaaaaaaattatgatgaaataaattttttgtgcttattttgtcaagttttaatgcttcgcttttttgtacgggccatatccaccggcttcgtgcttccgcaattccgtctgatttggtaccgcctcgcgttgtacttccctatctaggcgttgacgaattctgcgagcaattcaaaaattctgtacaagcgttgttggttgctcagttttcgtatgaggctgcaaattctgagaatttttcctttgcatcgaacttttggtgatttcccaaatatttgtaagtgctacattgataatttggtttgtttacctggctatccaggtcaggcatgtgtgcaatcgtcaagaggttcctggtttgactagaaagcaaagactggcggtgtacggcttgaggttttgattgtggttgtcaggaatggaagcaccaccggagacctcaaagccggcggaggctaaaccgtcaaagacccggctgtctgtgcccaccggcaggtttgcattggggacagcttcttcaatcaagaagcggactgatgttgctccctcagccgagttggggatgtcaaggtcatcgttgacgaagtctacctcgtctatgaatgctgctccagttcagagaagaagcagcacaggaagtgcggggaagcaacagg

SEQ ID NO: 20233 - DNA, 1501 bp, Oryza sativa
tggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggctccttttgaacaatgggaaactaaggaattttggagaactagattcctatggaaaaatttcgtatgtgctcctttggaacaaaagaatatgtcttccaaatcatttaaagtccctatgaaatgggccatttcatatgtaggaatttcgaaagaaaactagcattatcatattttcttattcctatggcacaaagttaactttgtaacttttttcgctgtgtcatccaaacaacagtttcgaagcattcctatatatattattaatgtccataagaattcaattagcataacactttttccccgtgtcttttatctttctttgtttttagaataccgtgttctaaatgagccctacatgtctaaaactagcttgtaggaggcatatccttataatcattaaacatggtgaatcgttaaatgacttaaaaatgctacaaaatgaatcaaaaagagaaaaaacatatactaaaattatgtttttaaagtttaagttttagctattgagcaatcgtctagcgtggctggcctcggccagaaacaagctgccatacatagtctgctcctcgtactctagggctacctaggggaggacaggaggagtacgtggtgggatcctctgtgcagttgagtcacttacatgtggaccatagtaaaatgggacccacatatcagtgactcaactgcatatgcagtaagtcagaagatctgctttcggaggagtactagcagcagctataggccacctccccccacccatccaaaaaaataaaaataaaatcggccgtatctacaggtactgctagtctactactactccaactagttccatgcatatacagactagtatccatactctaccagcttgttagtagtagtatgttctctctcttttttttttcttttttcccaattagtttcatacccttaactttagtctagatttacaaattaattagtatttcctccgtttcatattataagactttctagcattgtccatattctatagatgttaattaatctagacataacatctatatgaatatggacaatgctagaaagttctagacataacatctatatgaatatggacaatgctagaaagtctt

SEQ ID NO: 20234 - DNA, 1501 bp, Oryza sativa
gatgatctggtccaggacgccgatgttcttgaggccgaggacgacgccgacgcccatgatgtggccgacggcgccgcaggccagcgtgtcggcgagcgtgaacccggcggggtcgccggtctgcaggccggagtcgcgcgcctccagcttcagccccgccgtcgacttcctgttcgccgacggcgccagcccgaacctccccgcgaacagcatcagcgtcgtcgtcgtcaccatgatctgcatcgcccccccaaataaattgcccatcacattccattcacatcaagcctaatcacgtcgttgaattcagctaattaaccacactgataaattaattcagtgtgtgtgttcttacaacgttggtggctgagccgatgtagtcgcaccggatgccctgggacctcttcttgctcatcctcaacgatggcagcgtcacctgtgattaatcaagaaccagggacaattaggaatgtgtaattgtatgcatctctagttatacttttcgttacaaaggaaaataatttgatagcattggatcatagaaggaactgaccatggacctaggagaggagtaggtccggaggccatggaactgcggcacggatgtggcggcggagagctgggaagccatggctggagcctaccttctccttctccttgcagctgagtttcgaggaaaaaaataatgtcaagtgccaccatggagatgcattgggctttaattcttggaggagatgtggaatgggagccacaaggggagcttgtggactgcagtggccactcatggataggttacagatccttgctgctgatgtggcatctcctggttagagcctgccaatgtggataagatgctcacctctgcatgcaatgttcttggatgcagctgcaaatgttgttggtggtgacttgatgcatgttctgtcaaaaaaattgacaggcatatatagtgagcaagagaatgggaaagaggaattatgtggagcagtaaaaaaaaatggaaatcttggtattttttcaaccgcagaaaaatgagtaaatgaacctggatttactgtccctgtaggctggaataagtgcaagagaatgggaaataggaattatgtggagcagtaagaaaaatggaaatcttggtatttttcaaccacagaaaaatgagtaaatgaacctggatttactgttcctgtaggctggaatgagttgcttgcatcgacactgaagtggatgtgccactttaccagttgctcctttgctggtgctatgccgagtcatgaactgaaataatcaagaacttgaagcccattgcttgcaattgcagaaatggattttgcaatgtgaaacaacgtggcgacgcatcttactgctgtaagcctacaccacgatgagattacctcacaacgcgcaaagaattaaaatagaatggacacttcaataaccatcactcgtacatatttccatttcgaattttgtatatgaaaccaacgatgacgagccaaaaaaa

SEQ ID NO: 20235 - DNA, 1501 bp, Oryza sativa
atggtttattaagccagtatatggcaaggtaaggctacccaccacaccacttaattactgacatagtgttaaggcataaggcttagtgacaccctacacatatcctatcttcatacagattgtagcatataaagcagcaatttagatagttaaaggtcatttttaactatagtgtatattcaaagaggagctgatgtctgggtggcgataaaggggatttggattaccgacgctacatctagggtttctaggggagccatctatttctttttctctatttctctcactctattagggatccaacgtgtttggacttggtgagtttatatatgtccttggctaaaaattttccccgcactctgatctgtagtgcatacctcatgacaccacaacaacgacacggggtcgcttttacccttaaggcggacgccataggctcgagactgaggcggcgggacaccctaaaagtcgctgaccgccacattgttttcgcgacgccacggttaataaccatggtgcaacatcctccaatgtaataacaagattaacactgaattgactccacaatgctactatttgttttaaccattcaaaactgaaaaaaaaaacgttgtgccagaggcagtaaatatttacctcctcaatccaagttccaaactcggatcatgcctgatctttgaatactgtgcagaataggcagaagagctacaattccttttatgtgttagtccaaaccgttgaagaacatccctcacatataatcccctctttgcgaccggattgtagccttctccaatctgtcatttaaaacatcatgcacgtatatacgatcaaagggagtgtaatttgggcttattattaatttgatttgggatcgtatataccaatatatgtagttaaaattagggtataatttgttagcagtaatcttgtgtgccacggttagttagttgattagttatctgcatgtttccgttttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagaaaagcgctgcacaaaatttgctctgtttcctctgttctgcgaatttgcaggtttagccacagtacgcgtgcgttgtgtcgtctggtttcctgctagcgatcgctggggaaattcctaacaattggtatcagagcacggtttaggaagtggactcgtgaccgcgcattggaaggcgtcttcatgccgcgtcgtcgctcgtcgtcaccgatcgtgcgcactcctcatgactccggcggccgcgccacgggcagcggcgggggtgaccgcgggctggtgatccaccgcg

SEQ ID NO: 20236 - DNA, 1501 bp, Oryza sativa
gaaggtgacatatgtagggcctgtttggggagcttaagattctgagaagcagctgctgaaaagctagctagtgagaatctggagaagctgggaaatccagctttggcttatagttcattttctagattctacaactacagattctcaaaatctggataaaaagttggactgtttgggggagcttctggcaactgaagattttagaagaagctgcagctgctagaagctccccaaacagatccgtagtctgccagagctcatccacaaagcaccacaattagcacaacagagtgaaagccagaagagcccatgactcatcttaggtgggccatgagatgggccggcccatgtgcatccctgcaacacgtgatgggcctcatgtgggctcaaaaggctaactctggacattatgaggcccaattggggagctcctcggcccatcagggcccgatagtgaacgcgatatataagaacaccttctcccacgcggctcactcctcaccctcctcgcgaaaaccctaaccccgccgccgccgccgctcttcgccacaaggtaggcggcgccgccgttgctcttcttgttcctccgcgtcagtgcgccggcggtcgctaatcgtgctgagaacgcttgttttccttgttgcagatcgtttcgtcgcagtcggtgttccggtcttttgagcgcggagatggcgtaagttcttgcaaccaacttcttcttggcctctgctagttccatgttttttctctctctatcctcgtagcattttggatctagcctgttcttgctgttgctgctgttggtagaacactgttattactgtgtaattgttgctgagccttggctgcgctactgctcgctcaagaatcgtttggtcttatcatgtttgagttgtccttgattggggaaattgtcatttggtttccatttcgatgggatcattgagtgaaaggatgtgggagtcatgagtgcgattgctcggatttctgctgtactggtatggggtcttggtgatttagaatttggcagctggtagtatagttggtggattcgttgtatgtgagccgtctagtttagcaaatacaatcatgattcatatcagatgatatgtgcctgttctgtactagcaccaaggagtgtagacggtaaattcacagccagattgaaaaaaaaagctcaattgcttatcaaactatgtttatatggaattgaattatccaacttaattgtcttgtttgcatccaagaagtactgaatttgtacagtgtcaccagtagtgagaaacaatgcattttttatattatgggtgctcaattcttgtataaatgtaacaccacgtacatgccaaagtatttggacctccattattgaaagagcagtcaaattagaagagaactaaaaataccttgtaaagtgtattactagtaattgttaatagatcttatgtgcatctcggtctttgaaacattgatgtattgtagcgagcctattcattttcgc

SEQ ID NO: 20237 - DNA, 513 bp, Oryza sativa
taccctatcactcataatactttaagtgtgatttatatcttacacatttgcataaaatttttgaataagatgaatggtcaaacatgtgagaaaaagtcaacggcatcgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgt

SEQ ID NO: 20238 - DNA, 1501 bp, Oryza sativa
cgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacaaattataccctaattttaactacatatattggtatatacgatcccaaatcaaattaataataagcccaaattacactccctttgatcgtatatacgtgcatgatgttttaaatgacagattggagaaggctacaatccggtcgcaaagaggggattatatgtgagggatgttcttcaacggtttggactaacacataaaaggaattgtagctcttctgcctattctgcacagtattcaaagatcaggcatgatccgagtttggaacttggattgaggaggtaaatatttactgcctctggcacaacgttttttttttcagttttgaatggttaaaacaaatagtagcattgtggagtcaattcagtgttaatcttgttattacattggaggatgttgcaccatggttattaaccgtggcgtcgcgaaaacaatgtggcggtcagcgacttttagggtgtcccgccgcctcagtctcgagcctatggcgtccgccttaagggtaaaagcgaccccgtgtcgttgttgtggtgtcatgaggtatgcactacagatcagagtgcggggaaaatttttagccaaggacatatataaactcaccaagtccaaacacgttggatccctaatagagtgagagaaatagagaaaaagaaatagatggctcccctagaaaccctagatgtagcgtcggtaatccaaatcccctttatcgccacccagacatcagctcctctttgaatatacactatagttaaaaatgacctttaactatctaaattgctgctttatatgctacaatctgtatgaagataggatatgtgtagggtgtcactaagccttatgccttaacactatgtcagtaattaagtggtgtggtgggtagccttaccttgccatatactggcttaataaaccattatactactaggccatgctaataatttatgaggagttcagcatat

SEQ ID NO: 20239 - DNA, 1501 bp, Oryza sativa
tagggattccttagttatggacttgaacaattcgtcatccataacttcatcctcaacctcatcctcctcatcactaacaagatcaacattaaatgacttgagaggagaaggtaacttaggctcctttgccatgaggcaaatgggagcatcctcatcacttgagtagtcgaagagtctcggtggtgatgaaggcttgacggcgaacgttgcgactccttcttcatcacttgagcttgactcggagttggagccgaagatcatcccaaggtgagcttggccataatgttcccgcttgctatgcttgtacttctccttcttctcatccttcttctcacccttcttcttatcttccttgatgtgggaaccatccttgaggtgtgggcaatccgcaatgaagtgtccgggctcttttcacacgtagcacactcttgcggagtgtcttccacttgacttgttggagtagtgcttggaagaacctcccttgaagaagccgcttcgcctcatgaacttgccgaacttcttgacgaagagagccatctcttcatcatcgatctccgccttgctcttgctcttgcgattctcttcttcttcttccttcgccttcaatgccaagtcttccttcttgatgcttgtggttgagctttggttgatgtattggatgacatccttggactcttgcacgagcatgtcatgggcaagaatacgtccgagcaaatcatgaggtgtgagagtcttgtagtccggacggtcacgaatgatggtcaccaaggtagagttccttggagtgattgctcgaaccatcttcttgaccacaacctcatcggtcatgtccttggagccaagtcccttgatctcattgacgatcttgctcaaccggtcgtacatgtcacttgggctctcaccatccaacatcacaaatctctcaaattgccccttgaggatctccaccttggactcacgaacactatccgtgccttcatgcaagttccgaagcatgtcccaaatcactttggcactctcaatgccatccacacggttgaactcacttccactcaaggcgctaagtattgcattagcggcttgagcgttcttgtgcttgttctcgtcgtcctccttggtgggatcttcgggattctgcaacacatagcctttttcgactattctccaaataaatgggttaatagacttcaaatgcatattcatcttatgcttccaagcggcatagtccgtaccattgaagtacggagctttgccgctataggtactcacataagatgtagatataggtggatagtcataaggaaatatagctcccttatcaccatctttgccttcccccgtttggcccgacatgatctctttaagcggttaagcctaattaggagattaggctctgataccaattgaaagtgtcaattaggcctagaggggggtgaataggctaattcaaaaatccaattaaaagcggaagcagtaattttcggatatttccgaaattttt

SEQ ID NO: 20240 - DNA, 1501 bp, Oryza sativa
ggctccctctctcctccccgcccgcgcgcgcgctctgggccgccttgttgggccggccggcccatttagctcggccgagccgccccttttctctcgggccgcgccctagcctcccgagggaagtctaattttccccctccttcttttcttttcttttctttttcaaaaaaaggatttaagtaaatccttttcctttagaccaaaaatccaataatcttataaattcaatatcttcccaaccgtaagtccgtttgactccgttcaacttccaaaattcctcaaatctcgagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaatatcttgagcctatatttgaacttaattatgttgcttgaaagattattatgcattgataggatcgcacttaatctgcttgtcccgtctgcaaggcagattgacggacctacctaatttgttgcatttgatccttcctttgttaattgttataccatgttcccttgtaaccacccagttgcgcctcggaaatcgtgcactctgcacgagtatcgacggccgccttcaaacttaaaatctgaaaaaaacatcttgggtaaaacttgggttttacaaaagacttggaaaacccgacacctgggtcggtgcttgcgaactaaatgaatttccaaaatcgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggatcgatgtttggaaaatctgcagctgatgggatcagctaggcccgggtggccgtttgaaagttgttggcctgggtggtcgtttgaaagttgttggccgggtgccaatcttgatcaattctaaagactgatacatttgcacatactccgaccggacgagacgcactgtctcatccgtgtcgtttgagaagcactcacttagttattttc

SEQ ID NO: 20241 - DNA, 1501 bp, Oryza sativa
agcagcttgggctccaggcgacctaggatataacaccagggttccgaatgacatgctcatagttacaatagtgctgtgctactctgtcattgcacctctgattattccatttggtgttgcttactttgctcttggatggattatagtgaaaaatcaggtgagccaagagttacttgctttaaccgaagttttaacacactaatattgaaactgaattggaaaggacaaattaattagtagtttcccattgtcgaatgtaggttatgaaacctacttcagcatgaacttctgaaatccgctttcaatcctttttaatactcttgagtctctgatgatagccattgctagataaactttgtgacggggtaacctttcttttaacgcaggttctccgagtttatgttcccagctacgagagcaacgggcgaatgtggccacatatgcacacaaggatcattgcagctctactgatttaccagatcaccatggttggtgtcatcctgctgaagaagttcttgtactcccctgttcttgtgcccctcatcccaataagcttcatcttcgcctacatttgccatatgcggttctacccggcgttcgccaagacccctctcgaggtggttcagcacaacgtgaaagacacgccgaacatggatgccgtctacacctcctacatcccggcttgcctgaagcctgagaagctagaggatgtggatatcttcgaagacgcccagttgcacaccacctccagagccccatccatctaatgcaagtgctggttgcttgtgtcgagaccggagagtattactcatcatcactgcaaacgaatttctgatgaatttccacgttgaaatgaacccctgtgaagtgtgaatctgctattgccaggataggaaaacttatgtcatgtccgtgtacataatatgcactcgggattgcttgccttcttaatgtgtgtgttgaggtttattctttacttcatagttctaggtagctgctgtggatatcgcgcctttttaagtttaagtttctatcatatgttcatgctcgtggtgactgctaaatctagtcctcttatgtgtaacaaaactcagaaatctgttgcctagtgcaccgtaacctgattgataatttactgatttactcattgttactgttcattgaagctagtatcatggctgactcggtgtccgagaatgttgtcatttttgctagaatcttgtgtattaaccctggagggcaggcaggtcgtgagttgcaagttgcaaccgctgcactcgccagcggacggtggcctcgccgtcgtcgtttctccccgttggcatgggcctttttgggcccagacatattggcccggccttggcccatctaaccagcccaccgcgttgggccggagattcccggcccactctgcagaagagcacggctcgaaatcgcgcgaaaatccacagcgcccgcgcgggcggcggcgcacgaacggcggcgagccggcgaccagatg

SEQ ID NO: 20242 - DNA, 1501 bp, Oryza sativa
gtttaatgcaggcttcaaggaaaggctgttgtttttgcaattgattttatttgaactcttttctgaaaataactaagtgagtgcttctcaaacgacacggatgagacagtgcgtctcgtccggtcggagtatgtgcaaatgtatcagtctttagaattgatcaagattggcacccggccaacaactttcaaacgaccacccaggccaacaactttcaaacggccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaa

SEQ ID NO: 20243 - DNA, 441 bp, Oryza sativa
tgaatcctacaagaaatcgacatttagtgtcaggagcagagagtatgtgcatagaaccagcccaacgtgaacagcaatttagtcaagtaaaatcgaactacttttttttttcagttcgagaccatggaataataaaaaatcggatcatttgctacacattgatcgtttgccatcaacaagaaactatttgcctcgaaggttatgacgaagttggtgtttggaatcacctcaactgtgtggccagttatcagttttccaacttatactctaatacaaaagggcaaaggtatgcagaccgtagaatctgaagcccgacacggcaaaggatcacagattcaccagatcgatcatcgatggcccaatagaaactgacgaaaagaaacttcatgtgacgggttccagagagctcaccggtcaccaggccgagccggctgggaggga

SEQ ID NO: 20244 - DNA, 347 bp, Oryza sativa
aaacatataagaaacattgaacgataaaatcgcacggttaactttacataaggaaattcaagttacactatgtaaattataaaatgtctccttttaaccttgtactcaagtaagatgtctaattgagaagtcgatgggcctataaactcttaatcaaataaagaaatagtatgagaaatgcggtattaccataatataaaaaaggtaatcgccgtaatcatttccatttccatttcgtcttcaatcctttttttcttcttgtctcctcactccttttcctccaccctctcctctcctcccacttatcccctcctcccctactctctctccatcccactcccatcagc

SEQ ID NO: 20245 - DNA, 1501 bp, Oryza sativa
aaactcattagctctttatattaaaaggacatatttcttagaagagagcttgtctaagcatggaagcagggttgaggccaaaagtggcattggaagagagcttgtctatgcatggaagcagggttgaggccgtgctgtagcgtgtagtttgacaacttgacatgttaaatgaaggttgtgccaaagtggcggatgctacgacgaaacactgtattaaaattaataaagttgtagcagtagaaagataatctgatgtaatattgtattttttttctgtacacatgataactcaactataatcaaaggatgtggctggctatttattctttagatggcttcgattgaacttttggctcttggaaggatgtatgccgctggaaagcagaaacatacaacaggaatggcttgcagcttgctgacaaatacttagcttgaatgcttgaatcaatgataaccaaaagagtattatagtcatggcagaaataatcaaaagacaatatatgtttcagtaaaggatattgatttaagacatgcaaaagaagtaatgataagaagagttatatattttgttgttaatacctcctattataaatatttgaggtttactctccggtagggtttaaaaaaaattcaaacttattagactggcttgataacaaaaatgtttggttttgtgttttcggcaagtttaaaaattcaaactgactttaaatttttgacaaaattcaaccatattttacctgaagtcaatggtttttgcagtaatcggttgggtcgttcgcggtgcatacttacccaaaaaaagattcatacttatctatcttgatttctcgaggaatagctcaaccattctttttggcatggatatgcattgtcctcgtatagtgtatattgaattgattagatataatcgttgatgatcttgaataaataattttaagttatatcataatatttttttgatatatgaccttggactgaaagcttaaatggacagattttaggaacattattttaattgcaatcgaattttaataacttattaagaaaaatgttatgacaccgtagcgttaggacgggtatattactagtcactataaggccccgttgtaagcgtagtagtcaacggatttttgctgtaaattatttgcaccatgcttttaaaaatacgatttctcatattggccgtgggtgatctgtttagactacttgttttaaactgttcgttggcacctttttggtaaatacgtactcaatcacttaaatatttacggtgctatgaaatattatcaaccacctcgacctagaaaagctcttgatcaagatgggtttagaaaagataaaaaccgactagcaaaactgatttagagatcaaacacttgttttgtgagtaaattggaagcatatcgcactttcacggtgaaggcatacgatttaccgtgcaaatgcataaagatggatgaactatgatattattaggtagaacataaagtagaaaaca

SEQ ID NO: 20246 - DNA, 1501 bp, Oryza sativa
catgttgctaggttttcaacatgactttagtgacatcagagatgtgttgttgtttttgtctcttaagcatttaggagacgcattcgtagggatgactgtggtgttgcgtgtatagtggtgtgtgcgtgcgtatgtcatgtttgcttctttttttttttacatttgatccttttagaaatttattttacaaatcggccctaaaaagcttattattgaagattcttttcgtggcgtcagtgttattggcgctgtggtcaaatattgttgtgccaattatgttggtgccatgtcctaaccctccggtgaaagcaaagtcactaatgtgaaggggatggcgccaatgttgtcgacgccgatgaccaatttataattttttaaaaagaacctattcgtaaaaaaaaattcaaattataataaaaaatatttacatataggaccctagagcaattattggcaccgaagacctatttgtaaatacttttattacaagtaggttcttttctgctacgagtacatcctttttaaaattttacaaatatattctcggcacccaacgataattggcatcgtccccattcatattagtgacttaacttttactggggcgagggggatgacgtcaatgttattggcgctgttatattggaccacagcgccaataacgttggcttaaaataagtttttcaaaagaacaggaaggtgaaaaatctagtctgtggtgtaattaaaaaaataaattttgacaacgcagttttgcgagcccacaggccgaaatacctgactcacaaactccggagtaagttcactttgggtccctctatttgtcacccaatctgatttttgttcctcgatcgcaaaactgggtataataggtcccccaacttacgaaaccgtttaaataaggtccctcggcagtatttgactccggttttagctaaggtggcgcctacatggcaaatttaactcggtctttgtctgatgtggcattgaagtggcgcttacgtgacaaattcgatccaaaaaataagaaaaacctatgagactcacatgtcagtttcacacacactgtaacaagaaaatggtggggtcatcctcactaccccttctctctatccactctctttatcctctctctctccctcttctctctccagccggagggtggggtggagcagtggcggtggtggagcggcggccagagttgagtggggaaggagcggtggcaaccttcaacatagtatgtatttggggtaaaatttgtgtgtgtgctaccttctctcccatgacttcttggatttgggcgacatcgccggagatgctgtgcatcacctcgccggtgctcacctccgtgtcaaagaatccgatctcctgcctcagcaccgccttcaggtactcacgccgcatccgcagcgccgacctcttgccgatgatcctccagcaggtgatctctgcttgcacagagtcagaaactcataattcgattcaagagattcccaagaat

SEQ ID NO: 20247 - DNA, 1501 bp, Oryza sativa
ccacatgttagtcttactaggttcatcattagaaacagtggtagcggtaacagaaccatgcaatgtacttcctctaaggacatataactttgcagaattcagatcacctatcatataaacgagagagccttttgatacctttacaactccacctgaactggagtatttgtatccttctgcatcaaatgtgctgagagagatgagatttctcaccatccttggtatgtgtctcatatctttcagcgtacgtgtcatgccatcatgcgtcttgatctgaacagagccaatgcccacgatctcacgtgggttatcatctcccatacgcacgacatctccattctgcacaaacttgtaagaactgaaccaatctctgttaatgcagatatgaaacaaacatgcggtatcaaatatccattcatcatgaccagcaacacaaccagcaaaaacaataagacagtctcctgaatcagagttttcagcaccgagacgacagaggccttaccattggatttccttttctccttattctacagcttccaacattcttcaatgaagtgatctttctccttgcaatacttatagaacttcttacctctggacttcaaacaatctccaccggttctggctcttgccacgatcgttgctgttgttgtaggttctttgctctgacctgcaatgcttcgcccttggaggatgacacgtcagactaaaccatacctttcatcttctccctgttctggagtgcctcataaacttccaaaaggattagttcttcacggcttaatagtatggtgtcacggaaatttgcatacgaactaggaagtgagcataacaatagaagacctaaatctttatcatgaaactgtacctcgatcgacactaggttggcaacgatctccttgaagactgatatgtggttcaacatagaaccagtttcctgcaacttgtgcgagaacaacttcattttcatatgaattttactggttagatccttagacatgcagatcaataccagtttgagccaaagttctgcagcagtttgttcctgcaacacttttgacaaaatatcattagatagatgaaattgaatcagtaatagagccttacgatctttcctcttctcctcagcggtccattcatccttcttctttttcccgaagctttccagcgcctcatcaagatccgaagattgcgttagaacagcctgtgtcgtaacttgctacagcgagaatctcgtcttttagtctagcagcagtagatcatacttcatcgatgccatcccggaaccctaatgtgagaacaaactctgataccacttgttaggaaatgataggaaaacaaacaataaagaacaatagatcaatcatagaaaacacgagatttaacgtgaaaaacccttccaaagcaggagagaaaaaactatgaacaccagccagcaaaatatcttcactatatcggggtgaggttacaatgccgaacggcggcttacgagaagtgtgtt

SEQ ID NO: 20248 - DNA, 1501 bp, Oryza sativa
ctaagtcaaagtgcagcgggcacattatatattcctctcaaatgacatctgtgcatgatttttatttcttttgggtgtggttagttctttgggtgtaaagtttttaaagtatacggacgcacatttgaagtattaaacatatactaataacaaaaaaaaattgcagatttcgcttgtaaactgcaagacaaatttattaaacctaattaatccgtcattagcaaatatttacggtagcatcatatcaaatcatggcgtaattaggctcgaaagattcgtttcgtaatttacatgcaaattgtgcaattggttttttccccacatttaatgcctcatgcatgtgtccaaacatttaatgtaatgtttttggccaaaattgtttgggatctaaacaaagcctttgtgctttatatgtaacatctgtgactgtaaagtgggcatattatactcccttcgtttaatattgtaagttgttttgatttttttctctagctaaactttttaagtttgataattttttatagaaaaatatagtaacattttcaacgtaaaacgaacatattatcaaaatatatattcaattttatatttaaaagaaataatttggtgttgtggaagttgttaattttttttataaattcagtgaaacctaactacggttgtttagaaaagaacggcttatagtataaaacaaagggagaacatataaagtataaaatatagaggtcagacctctctggttggtagttggggcatgcttgactgagccgtggcaaccaattttaaacttcagaaattagggctttgaattgcttcattaatcagtttgggcttttggatctctacattaactcacgtgtgctaatgatagattaattaagtttaataaatttatctcgtgatttccagacaaattatgaaattatttttttcattcgtattcgaaaacctcttccgatatccggtcaaacgtcccatgtgacattaaaaaaattcttttcgcgaactagacacaggagtataggaggagcgtgcttggtcgatacgcacttcacacgtgccatctttctatcacattactgttcatgccgtcaatattaatttccttatcttggatggtagcaactaatgcaatcatgcatgatgattatatatttctgtctacagtagtctatgcataaataatttgatgcaattaattccacattaattcgctgtttcaacatccatcttactagttagagtactacacaagtatacactatctgtcgcattccacaccttgatctcagataacgttgatctcttcaactcatgtgataaatctaatgaaaatcttcagtgcccaacgtgtgcatctacctctcctccaaccaaccacccactatataaacccttccccacttaaccacggttagttcataccaacacatctccattgctgcttaagtttcttggaccaaacgtgcaccccaagtgttcgacgatatggagctcacca

SEQ ID NO: 20249 - DNA, 277 bp, Oryza sativa
tccgtcgaccccgtcgacccgagccgcgccgccgccttccttcgctccggccgcctttttcgtcgtcgccgtcgacctagggtgagccgtggaccgccgcctcttttccctcttcccttcccctctctcggccaccgctccgccgtgcctatggccaccgccggcgaccataggggcgcgggcgccgcctcccgccggctgcgccggcttggctgccctcgggcgcaccgagtggctgccgcgtggggcccggccatcagccgcccgcgcccttagg

SEQ ID NO: 20250 - DNA, 1501 bp, Oryza sativa
gtacagtgggagtggtgatttgtaacgattgggacagtgccatatattttatcgtgccgagcgtgccgatgtgctgctaatctgaactaaatctttagttacggttattttacgtgggactaaagatagccatatttaattttagattcatggtcctggtttgcaacccggaactttacgagagttgcaaaccgggacggtttctccaccagtgagacccggtgggggaatttgggatcactaaactgatgattaaaactgattcactgaaggtgacaaatatgtgcctcaaatagaattcgataaatgatttaggacgtgaaaacaatactaaatggattcccataatcaaaggtggtgtggactcggcgctcgccgaataaagttagtcatatgttagctgaagaagatgtttttgtagaggtgttttatgacatgggtttcggtttctccggaattcatttattaatgtttggcagatgactgtaagcccgatatacatgttaatagagctaggcccgatttattatattaaatctcaaaggcccataataaatgttaagaataataatgccacctcaggaattaaacgaggagtatctcaacttaaatagggagttattggaggctccctgttgaccggttgaggtggaaatcggaaagccacacgcgcgccggggcgagggcgtggcgtgcgttgtgtctgcctgcctctatcctttttgcaacgaccgatcccacgattgcctccgtaacggccaggcgattcaattccaattatcgcgtcggtcgatatcagtcctgcgatataaggaaaccgctaatccgatcagatctctctcgcttgctttccatctctggtgttcttcctcctccgcgcgcctgtgctgcctctgttctacctccccgcttctgatcgtttgcgcgcacgagagatcggaacgagcagggcctccggaaccacaccttcgcctgagatctgcaccggataggcgggtgatcaggtttttggggagtgcttccgccgccgccgtcgccgtccctggagccgctgccgccgtccctggagatggcgcgccaggagccggagccgctacaaacgtcaacgtcaacgaaggcagttctgcctcacaatccagcggagggacattctcggggtatatctttctcctactgttaactcattctttgatacctctgttagtcgtgttagtcgcaattctattgcgtttttggtatgttcatgatgcttattataccttaaacatgctcctggttatatttgattttatcactagatcaccccacattgttcatgccatgattattgtcttaatattttggattaaaatatgccgatatatgactatatttccaacaatccaaaaacctgataggtcattttcggtagttggctttgctgctgcactaaaatcatatgcatttgatggttctaactataagaggtggaaagcacgtacactattgtggttgacagcga

SEQ ID NO: 20251 - DNA, 1501 bp, Oryza sativa
aggtactttagcaatcggggtagcaacaccagatgaaaaccaaaccacgatggaaggtgcgggtactgctgttgaggtggacagtacgactcatcaggggccagcagctttcattgagggggaggttgtggaggaggatgaggacgcaatcgaagtggttatagaggaagaggaagtgcagaaggctggccaatggactatattagcaagattctattccttgaagtctccaaatcttgccgctctctttgaagacatgcgtcgtgcttggcggctgcgatcagacatgacttacaaatcgctgagggataacttgtttatcatatcttttggtgctgagggggattataggtttgttatccaaggtggtccatggattcataggggggatgccctgttggtggcagagtttgatggcatcacctgtccgtcaaaggttactttggatgtgattccagtatgggtgcggatttatgatcttccactggtgctaatgacaaaggcaaggggtgagatatatggtagcaaactgggcagagtacgggaggtggatgttggggacgatggccgcaataaacatgacttcttccgtattcgtgctgatctctcagtcaagcgaccactaaaggataagttaaccatcaaaatctctgcacaaggtagagtggaaacaagaagttttgcacttcgatatgaaagagtgccacacttctgtttcatatgtggcttcatggggcatgctgataaggactgcgataagagaggtgcaaatgtggagaatccctttcgcttttcagctgatttgagatgctcacccttaaaaccgtttgagcgaaaagttaacaaggtcagagcaatgcagaacactggagcagctcgcaatctgttcttccgtggagctggaagtgctggctcatcgtcctcaaagcagagagatgtggaacagtgggatgaagccattccacccagagtggatgctcatgataattttgatgacaaggagaaggagggggatagttcagtagatgagcaattggctctgcaagccaatctgatgaatatggcagggacagaagggatagacaaagagcatgatgatagtcaaggtccgaagttaaagagtgggtctaatgttgtggccctggctggatcaacaggggaggccataccctcaaaagagatgattcatgctattgcaaatcttcagcaacaagcctcctttggggatgggtcgtcagatgactggagtggcgggaataggaagagaacgcaagacacgacagaaattaacaagccggggcgggtccagcaagcgctggtaatataccagagtgcaacggtgaaggatgcggcggatagtagagaagccggcaaggacacaagagcgctgaagcgttccaggaagacggaaggaggttcggaggtgtctaattcggaggcaaccagccatggggccgctggtaaactgacaggacctatgatagggtctcgtcaggagcaa

SEQ ID NO: 20252 - DNA, 1102 bp, Oryza sativa
cggtggtgtggagggcggcggcggcggatccggcgatggggaaggttgtggcgacggatccggaggcggggaactcggcggcgggccgaccgtgtgtggtcgagcttctccgcccgcccgaccacgatggtggccgtgctcgccctcctctccaccggcctctccctgtccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctctccaccggcctctccctctccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctcttcaccggcctctccctctccctctcccgcgcggacctcgccgccgtcgtcgtcgccgagccgcggctgctctgtgcgaaggccgacaccatcgctgccagcgctcggttgggtcatcccgtccgtcgtcgtcgccgagcccaccgccgccgacgtcgcccgagcccgccgccgccgctgtcgcccgagccgtctaccgccgccgtcgccgagccccccgcagccgctcatcgacgccatcaaggaggccggcggcgaccacgtctggaggtgagggcagaggcggcgtcggccatggttgttgcaaacggcgttgtcggtggttgtaaacggcgctcatcccatccctccctcgttccttgaaccaaacaaaaaactgggatcatcctattctacaaaccaaacacccgaatggaatcatcccaatcctcaaatcagggatggtttcatcctatcccacctagtcccagaaccaaacacacgctaagtggccgaatcaaatccgatctttccaacccaaatacccaattaaatagtccgagtacagagccaaattaagtgtcaaaatatacagctgagagtccatatacacagtccaattacaattatacactcccattacatgtttgcagtccatctacaaatttcaattacaatt

SEQ ID NO: 20253 - DNA, 217 bp, Oryza sativa
ctggtttatttcctgaattttgtaactgtaactttttaaatctaaacgaaatgttaaactgtttaaaaatcttaattctaaaaagaaattacagctatcacgagctcagctcagctcaaggaagaggaagaagaagaagcagcttcaccacctcagctcctcttgcacacacacacacacactctcttctcttgtctcgctgtggctcgctggacac

SEQ ID NO: 20254 - DNA, 1501 bp, Oryza sativa
ctcattaggatggtagtttatttagcttctgtgtgtggctgtttgctccatatttcactgtgtttcatggcctgcagataattgtgaatgtctggactgcagcattgctttcactttcatcttttcaggaagcatgagtatgcatatgttccctctagcttattaggtatatcatgcattctgtcatttttatttaagagataaatcttgcatgtcaaggaaggaaggtgagcatcttcccacagtagcttctcctgtgaatgaaatcaaaattctgtttttctatcacaccctttcagtccttttagttcatgtcctatggattttgatggtgttgtgtacgaatggaatttcgacaaattgtcgcagatagtgatttgcacgacatgattgatcttctttttttattattattattaaaactaaaaccctggctcgtcggttgtttttttttttctcattttgtgaacaataattcgtgcaacttttacagatcgatgttaacttcgtactacattttacagacatattgatatttgctctcataattctgcatttctcattagcatatcatcaccaaaaacttcagcatttttgtctacatagttgacaaaaggaggccatggctggtaagagacactgtcagcctttctttgtcagctgtaaaagcaacatttgtgaagcaaatgctgagcatagctgctcatctcagtgaagcgtttatccccaaactgcctgcctttgtggtggctccagattttttttttagaataaaggaaactagttgcagctgcaaattgacagcactgttttgtcaactgaaaaattctgagccaaattccaacgacgtcacatgatctttgtctcatctagcagcataactcatctgtttgtctctgcgaagttggaaacattatctctttgttttaaccgagtgtgaactagacagtgtttccttagatgcaaatattattatagcccagataacaattgctatagcctaaacacaatatgttaaagttgtgtccaactttttggcaaacaagattcatatttatgaggaccattgggttcaagggaatttcagaggattttcctaggaactaaactatcttgcaaaaaattaccgcgttttaaaaattgcctcgaatttcacagggaattagtttaatttccataaaattcctgcaatatctctctgttcaaaagagggggtaaattcacaagattattacctagactctccgtccttaaaaaaaagtctagatttatagttaaaagttattttttttacagagtagtatttatctagaacagtatcctacactgcagatgttatatgtgcctcacttgcgacatctgaactgaactgaactttatatccatgattcatgcaccggaggagatcatcaaagtatgaagaaatcatgggcattaccaacactggtcgctcgctggccccattaattaggaaaaaaaaatgggaccatatattcttatt

SEQ ID NO: 20255 - DNA, 1501 bp, Oryza sativa
taaaaaaagttttagtaaattaagagtacgtgcaaaatgaattaaaaataatacaatgttttgttatgagtgggtatctttaccagtataatcattagtagaagtgaactacaccattgatttatgagttctaccgcaagttctatcagtagcagtagctgagatgatagcatatatagatacattccattaaattagaaaaagaaaatttttactcccaggagagaccataatttttactaccaatagagaccataaattaaagttctatttatatgtgattttcatcgaaatcttgtggtaactatacacttcataaatgtcaggaaaataagaaaacacgggtttatacacgtcatcaggactaatttagattttattattttgatataattacatgtataatttttagtgtgtaattagtataggctgggcatatttatatactccttctgtttttttaatatatgacatcattgaccttttaaaatacgtttaaccattcatcttattaaaaaaattatgtaattattatttattttattgtgatttgatttatcttcaaatgttctttaaacatgacttaaaagatcttatatttgcacaaaatttcttgaacaaaataaatagtcaaacgtttgtcaaaaaaatcaataacattaaaaaaacggaggtagtatgtagtttcttgatctagacaagtactccctccatccagttgaactacaaaggtagctatacttagatagatgaagtagtaaataaaaaagacgtgatgaggatgttgaattatagtcgaagaagtgaactacccaccatgaattaatttcgtcctacctattttgaaattttgaatggattttggattatgcatggaacctcatgtgcgtatatgcatgccatgcttacacaatacgagttaaaccaaacttagattgagatcctgatctgcaatcgagtctaccgcgcctttgtcactaacatgtgagctgttgtccacatgtcagtgataaaggcgtggtgcagtcgactgcagaggatcctcatccaactaactctcatttcaatcgaaggtgacactgttttgcaaccaagaagaacaagagtagcagcatctcaaacctataactacaatatactcacggtgcttggttgttcgacctcggcggcgacgaagacggcgaaggcgtttgataaacattattctgagatttccgtcttggatccacagtgaaagtactggagttgttgccagccgtagtcgagcaattcaagactgcatccgatgtcgcaaggaatagagtcagaacagaaagaagaacagctacatactggagatggagtgccattgcctctctcataatacacagctgcttaatttcagttagacacagccaatattaagcactagctagatctcatcaactgatgctgcaaaattggaaggatgcagatggggtttatgtacagctagtgcggttggcaaccaagacatactcac

SEQ ID NO: 20256 - DNA, 391 bp, Oryza sativa
cctcctccggctagaggttggggacgggcccgacaggtgggccccacctgtcggcgaccccgggagagagagaaggggtgcgggctcagctgggctgtggcctttggccggcccagcaaggcgcgggagggaggaggaaatgggccggcggcccattaggaggagggagggaaaaagaaaaagaaaaaaaagggaaaaaggaatttccagggatttaaataatgcttatgcttatttttaattggttaaaattatttctagagctctaaaaattccactaaaaatcttgttagcatattttgacatgtagaactcaagaaaaattccaaatgccacttccgattattacttgcattaattcacttagggtttctctcttgcattaactagg

SEQ ID NO: 20257 - DNA, 1158 bp, Oryza sativa
tgggcctcggcccgagcgaggatgggagagggagacctcggctgccacgcagagggggaggaggaggtgggccgaggagaggaggaggcccgggagggagggagagaggaaggaaaaggccaagtgggtcgagggaggaaaaaagtactttggcccatattcggctcaaatagagggagatgattatttttaggttttaaactctgaaattggttgttgttgtattaaaattatttattgtgctctaaaaattcaagtaaaaaaaatgaggcgatatttcggagcatggagaatactccaagtcacaatccaatttttgttgttatttgagatttattttagacttttaattttttttatttcttttagaaaatgatttttttaaatttagaatggatttatcagatgtcacacattcttaccgatggtgtaatttcatttctcactgatacgttggactatttgagtcactggctgtgttccggaggtgatgttggaaactcagatcctgcgcacgtaaaacggagtgacttattttgttatgattaattaagtatttattatattttgaaaaatagattaatatgatttttttaaaagcaactttcgtatagaaatcttttaaaaaatcgcaccgtttagcaatttaaaaagcgtgcgtgcatatagcttcaatgcatttagcaaaaaaattagaccaaattactccatccctccacttcttccttcttccactttcctctaatttgtgtaatctcttccactagatctgacccccattgagcccactggcatcaacgctcccacaattctccgctctcatcggccgccggtcgtcgccccttccctgcccaaactagttgctcaccgaccatccccaacccactgagctaccactgctccatcacttgtcacccccatcgagctcaccagagcttatcgctaatctagccgtcctcttcctaggcaacagcggagctacccattttgttagagatagcataagcaaatatcgggcctagcgaaggtgaggtactggagagcaccagctaggctgcgataatcggtaggatctgccacaggtggtccatcagaagcagatagcttggcgcaagtgtcgaccggcgtggaacatggtttgcagtgtagcataccagc

SEQ ID NO: 20258 - DNA, 306 bp, Oryza sativa
ctttttcgctttgcaatcacccgctcccgtgccctctttcgctctcgcaccgtgcgcccgccaccgccgccgcttttccgctctccggccgccgctagccgccgcgccgagccgcgccgtcgacgtcgtcgcgttcgccgtcgtgcgggccacctcgtctacccctcctccgtcggaatccgccgccggaacccctccttcatcactcgccgatgagcatcgccatggccgccgccttcggccggcgtcctcgccctctcccaatttcctctctccctctaaccccctctcctcttgttcactagg

SEQ ID NO: 20259 - DNA, 1501 bp, Oryza sativa
gcgcgggcgctccgacgccgcgttcgaggcggcgctccggctggcgtgccccgccgccgcgccgcgggcggtggcggcggccgtgcccgtcctcagcgacgcgacgccgagctggttcgacaacctctactactggaatgcggcgtccgggcgcggcatcttcgccgtcgacgccgaggaggccgccgacgcgcgcacggcggggcacgtgcggcggttcgcggcggacgggcgccgcttcttccgggccttctcgtcggcgttcgtgaagctcgccatgagcggggtgctcaccggagacgaaggggagatcaggaggcgctgcgacgtcgtcaaccattgatcggattgctccgagctgacttgaaattgaaattgaagattgtgatcttaaaaatgtgagaaattttactgtaattgaggtgatacctcgatgtatcgtactagtaccaaattttacgttacaaaatgtaatactacctaccggtaaaatcgctctaaaagcaaattacgaccataagtttgttgactagagtctgcagaaataaaatgaaacggaatagtaatgtactacgtatttctttgttgagataatcccttatatgacactgaaaattggtctgatcctttatatgacactgaaaattggctcttcccttatatgccattggtgcaaatttgtacaccctttcatgccacaatagtcagttgtccgttgttgaccgttaactctaaagtaaaaaagacatatatgctctccctgagttgttgggcatgccctatacttataagggtaaatacatcttttttccttgatttttattggtcaacacacggtcaactaatgggagtggcatgagagggtgtgcaaatttggatcaatggcatataagggaagagccaattttcaatggcatataagggatcagactaattttcagtggcatataagggattctctcttcttttttaataatggaatttatttgtcgtcagatcaagataaaaatatgataaataaatttgtcaacacaaacccacttcttcatgaaaatgctttgttctgaatgtccgatcctgcaactcgtgtcgaacggctttgagcaggtacaatagctgactataaaccaactataaacatattttaaagagataaaagagcagatagaagagcagcggtatatagatctgtaaccagttgcagcacggactctaagacgtaatgtgtggatgaaacatgggaccaaatattaatagtattataagcaactgttgtatgaattggctattaaattgtgtcgacgtttgatgtcacgattccggtatttgcatggtatggggatcgtcggtattaggatatacgcgagactgaggtaaaagagacagagatagggatttttatacaggttcgggcccctgaattgtcaggtaataaccctacatcctgttgggcgaagccggtattgcttttattcaccataatcacaccaatacaatattt

SEQ ID NO: 20260 - DNA, 1104 bp, Oryza sativa
tacattgttaaacggagggagtactctagatttgcatcaaccaagtttgactagtaattcgattgcaatataggtccatccaataactatatactactaagagtactaatagggatggtaatagtgacatgaaccccgacagagaattactcgattagggtacgtaaatgggctaaaattatcacccatgaggctgaaatcttgaaaatattgccccgtcgggtaatattaagttagtgacctgaccccgttcaacagcccccggccccgagtattaagttagtgacctgaccttgtacggtttttctatttgattttaacttcatcgttatcaccatccaaacggcattacaagttgtcctttttatccccataccaaaacgtcgatcggtggtgtagttggcttccgggctaaccgagcaatcgtccaggctctgtcatccggtgttgttattgtctcaatgaaaattaatgactgtagaagtttttttttaataatagaatagaatattatctcggtctttgataaatgagctacataaaattattacaccaattcgtttaaagcgagcgcagttcaaagaaaatttataaaaacactcccaaacatgaagcaagcacaaaactaataaagagtaagacacaagataaagagtacacaattatttaatcctatttgtgaacttccattcgaagttgataaaaggttgcatgagaattgtctcaagattacaatatgcaaactttaaaagcttgttgttttcatcacacttttgtgagccaatgactgtagaagtttgtcaaggttacggataaggcatatctcctatcttacaatttactgaatatgcaagattggtataccatcttctatacgatatatttccatatgcgataaggaagtatataagatattatggaaaatatcctcacggtctggcgattaacaaagtcctacttgaatatgataggattagtctatatcatgtagggttcattgtctccgagttttactcgaagactaaggcaactcatggtataaaaggcacacccctagagaggttcaggatcatcgaatcatagtgccaaccctcccacctcagt

SEQ ID NO: 20261 - DNA, 1501 bp, Oryza sativa
  unsure (1)..(1501): unsure at all n locations
gtccagtcgtccatcacgaaagggaaacgcttgtcctaataccaaacgctcctttcatcgcccacacacacacacaggcatatggaaccgaggaatcgtacgtgttcatgcacacacgagacgggacatgatttcttcggtcttatcgccaacgttcgctactgagggtgtgtttagannnnnnnnnnnnnnnnnnnnnnnnnnnnctgggtactatataggtgtcgtatggggtgtttgaccactaataaaaaaactaattatagaatctattagcaaactgcgagacaaatttattaagcctaattaatccatcattagcaaatatttattgtagcaccacgttatcaaatcatgtaccaattaggcttaaaagattcgtctcgtaaattagtcacaatctgtacaattagttattttttagcctatatttaatactttatgtaaatattcaaacgttcgatgtgacagggtaaaaaattttggagtgggcctgtttagaagagctttagattctgacaagcagctgtctggtagccagcttctgagaatctggaaaagctctgagacccagcttctccagcttctggtttcagaatctataactacagattctcagaaactgtggactgtttggggcaacttctagccgaagcggtttttgagaaaagctatagctggggcaagcttcccaaacaggacctaaccttgaccagccccaaccccaagccgttacaaagtgaggctaaaatagcgtctggtcggccagagaccgctgcacgctactagattgtggtcttgctgttagccggttgccatccaagtgttgcaagtgcgtcgtcgtgggagaagaggggacctactactactactgtacggatcagcccttcctcgggagcacaatcgaggacgacatggatctctctgtcctaccatccacaccctacacgaccgtccacctatgattgggctgtgtttagatcagggcgaaaagttttagcgtgtcacatcggagtattaaacgtatactaataacaaaacaaattacagattctacatataaactgcgagacgaatttattaagcctaactaatctatcttagcaaatatttactgtagcaccacattagcaaatcatggagcaattaggcttaaaagattcgtctcgcaattacacgcaatctgtgtaattagtttttctttttgtctatatttaatactctatgcatgtgtctaaacatttaatgtgacatgctggaaaatttttgcggaactaaatatagccttggtttttgccgtattttaatcatttggaagattctttagctttaattattttccatgtgttttgtggatgcctactgtagctttgcatcaaccaaatttgactaataattcgatttcgagtgcaatataggtccaatcactatataagtcacttacctgatctattttaaggtttttctagtggattttaacttcaccgtctaatcaccatcc

SEQ ID NO: 20262 - DNA, 1501 bp, Oryza sativa
tttccgtgcacaggagttaggctcccatctcccccatccgaactcagctaattatcagaggataacaacatatagcaattgggccccagcacacattgcagaactactttgcgtgtatatatcttgaatgctatttgtagagatgctgttggaattacaacagagcgggttgttcgttttctttctagcgaatttaaccatattttaatactgaacattcagatatcacttcttttctccgcaaaaaaggattttccttctttaaaattgtttcggtgaatttggaccaagggtccaagggtagccttttgtctgtttaaatacatgggggtagtaccaatgttgtatgcaaatttgcaaaaataacaacaatgcagtgcaaacattattaaaagcaataaaaacagtaaaaatgctcctattaaatagcagtggcttaaattctaaaaatatactcccttccatttttaatgtttgacgtcgttgactttgagatatacgtttgactaatcgtcttattaaaaatatgcaaatataaaaaaacatgattaaaatacctttaattataaaaaaatcacaacaaaataaacaacaattacatatattttatataagatgaatggtaaaacatatattcaatcaaaagtcaataatgtcaaacattaaaaccagccagtacttaagtgcatttgttgtttatgcaacacaaataacttatctcttatatgtcatctgaatggtcataaaaaatttcatagcatagattacattgttatgtatgcaacactaaattcaattttcacacctcaacataaaaaaaacataactcaaattatttattttgatgaagtttgcgtagttcaattggttatttttcacatggtggtggaacttacctatccaggttcaagtcctagcaagacttggcacatgtaattgtatttacgtttaattatttttttcagcgattttttagggaaaaacagcaggagaggctcctagcctcctacggtgattttattgagaaaaacatttacagaagaatttacataaagaaaaagaagggtacataggagaaaaggaattttttcagcgatagatgtcgatactatggtgactcatgaatctgagataccggattagtcttcagaagtgctcatagatgctatgataaattcgtgaatctcaacatataccggctcggtattgtgaggtacttaaagggataatctgtgcatatatatatatatgttaatttatatgaatgcctctgtctgtaatgtattttgaaaaaatatatatttattttgcttctccttgtgtagatcgactttttaacttcaaattttgcatcatggtagacacctgctatatgtaacatcccggcctagggcttaataggattaatagaatactcatatcaacaagttgcaacttcttttccggaagccaatctccaaagaactccagggttaagcgtgcttggcctggagcaatttgg

SEQ ID NO: 20263 - DNA, 1501 bp, Oryza sativa
tagctatcaatagtttctcaatcgttagcctcacccaacactaacttttttttaatcttagaataaaacaacaaaggctcccatatggagaaatgtaaaattacattctaaaatgtaaactaagagtcatagtaaaattatattttgtacaatattcaataattcaatgcaagttacttcactaattttcatcactcgcactttcctaattccctgctataaattttcaggggcctgaagtctagcaaatcttataaaattaacaaataacaaaacaaacttgtttatttgcgtgctgcttatgataatgatgaatcatgattcgatcgagtcggtttcaaaggtacggagtgacaatgatctgccaagattttacagcaacatggtgggtcagtaaatagttgttttccagctaccatacaatacaagcagtcaattaaaatgtccagattttaccctccatttattgacagagatggtggtgggccatctccatctctctcaaataagatggtgatttttttttatttttctttttgatatggggttgggtcactgtagtggtagtagtggcaccacgccgcagagcaatcagacacgcacgcatataaaccccatagagccaagcacaacctgatcctccctatttcagtcacgttccctattacaattagtagctttcgtccttttgccagcttcctacctagctactctcttcgtcccaaaataaacgaacataatatttaggatgatatatttagaactataaatctaaataacgtagtaccagtacatttattttggtattcctctgtttgaaaatatgcttcacagtcgataataggctgttactccctccgtttcacaatgtaaatcattctagcattttctacattcatattgatgctaatgaatttagatctagattcattagcatcaatataaatatgaaaaatactagaatgacttacattgtgaaacggagggagtatattttaagacggaggtactagctgcctgcacagaaattaatcaattactaattacactgaaaagcacaacaatttaatgttaacatgattcctgtagtgctgccgcccaaatcaatcaataaatatatacttccttcgtcttcatctcaaaatataagatacaaccgtattttttatgtctcacatataaggcgtgcgtgcatgtatatattaattatcacctcttagttctttaaatttagtttaatttatttcctgtaccattaagtcttccaatcacactgtttacatgtatggatataattatattctttatttgatctctatgttagaagtggttgagccttatattttaggatggaatgagtatatatacacacaccaccctgaagctggaggcttgcagtgagtcgtacaagtgtagaacaacacttgtgctacctagcttagttatctcgttgccagctgcacagttccagcttcagtttcagctagcgctagctgatcca

SEQ ID NO: 20264 - DNA, 1501 bp, Oryza sativa
gagacgtccaggattgcggtgaatacgggcaagcaggcgccgctgctcatcccatatccgcataacgccatcctcggcctccaccttgaaaccggtctcgtctagctgcccgacactaatgatgttagcagcgaggcgtggaatgaggtaggtgttggagagggttcgatgctccccattcttacaggagaagagcacggtgcctcgcccttcgattcggacgacggagccgtctcctagtcggacgttgccggtgatgcctgtgtcaatgtcggagaaggccgtccggcagccggtcatgtggttggaggcgccggagtccacaatccagcggcccggatcacgcttcgcggcgtcgtcgagcgccgcgaacagcttcttttcctccaggtagatgggatcggatgacggagttggcgcagacggcgctggtgcatgctcctgttcacatgcatgtgtgattactcctcctgtgaggagaagcaaggtgggctcgtcgtcttgtgccacgtgggcctgttcatcccgcttgggcttgctcctgcaatccttggcccagtggccgtatttgccacagttgcggcatttgtcttcacgacgggccgctccggagttcgtattcttcgcgccgccgactccagcgccgccgccgttgcggcctttgccgcctcgccgcttgccacggttgcttgggctgcctgagttcttctttgcctcctgctcctttttattgtggcgctctagccattcttcctcggtgaggtagagcttgccggcgttgtctgaggacgaagatggcaatggcatggcgtcctcagctgccttgagtctgccggtcacctcctccagggacagtgtagagatatcaaggagagtttcaatggaaaggacgagttgggtgaacctgggacgggcgacgcgcaggtacttctcgacgaccttgtctgccggctcgggatcgccgagcgtcgcgagttgattgacggtggaggtcaggcgcatggcgaagtcctccacggtctcaccgtcgcgaaggacgagcgactcgtactccatgcgcaccttctgtgcgcttgctttgcgaattcggtcgtcgccgactcgcaggatcctgatgcaatcccatgcctccttggccgaggccttggtggccaaggtcgagatcatctcggggggcaccgcgctgcaaatggcgtcaagcgccatcctatcctcatgaagctcgacgccgcctggatcgatggcgccccacaggcaccgggcttgcagtttgatcttcatcagcaaagaccaatcgttgtagttggttcttgtcaacagcgggtagttcgctgcacctcctgcttccttgaccacgcggtggatcaccagcccgcggtcgctcccgccgctgcccgaggcgcggccgccggaacctgaaacatgcacggacggtgacgccgaccgccggcgcggggagtgcgtgcgtcctcgaggcatgaagacaccctcaagagcgcga

SEQ ID NO: 20265 - DNA, 1220 bp, Oryza sativa
tgtgtcgtcactttcataatattgtaccaattgatttttggaacacaaacacgataatatatcaccattcattttgagaaaaaaaatcaaatgtatatattctagcgtcatcgaaaatgaagagaataaaaataaatgggcatgtacgagcagctggccatatacatatgtattgtctcctgtttaaatatatacatcatttttctctcatttcttttgcttcctttatttccctttttccctccggcaataggtcttctggcctgttgtgttgtgcaattaaaactttcttttgttctaatatacagacgtgcaatatttttatacgtttgcgaaaaaaaaatattgttgagtcctgactgtcggttgtacgtgtccaggcatcgaaacctctgcttttcgcagatcatattaattaacaacagtcgcttactttagtttgttgctttggcgattaattttccaatcattcagcataaactagttactagggataatttaattacacaagtaggagtatttatcgaatcttgccaggaaatatggttagttccctgtcgagtgatagcagataacattgtaaattaatcggagctaggtaatcggggataaaattattcaagcgccatgttaaagccgtgtccaagtgttggcagttccatcgttaagttggtcaaagtttataatgagctatacctgaatgattcgattttgctagctaaggttacatggatgacatttttttttacaaatgatttggtgctgctattgttatatttgcacccaatgaaatcgggccatgcatatgctagttggtagcgcaaatcataagattattggtgtaacatcttgttttgcggatatcatggatgattatgatgtttgtgtccgggagacgaccacaaatcttgtcagattaaattttgttcatacctgattaattgctaccgtgggttacaattgatagctaggttgtttttgtggatgggaattaattcccttttaattaatactatgttttttctacaaaccgacataagtcggtgaaaattttattggataaagtaaaactaaatataaaaactcaaaaaacatatgcatatggattttaagggatggcctcttgtttgattttccccaccaagactgtcactggcattctttgtgattaaagactctctgatttctcttcccccaaatctcccatgatggcaagaaga

SEQ ID NO: 20266 - DNA, 1501 bp, Oryza sativa
atcacagacggaccataagtggtcgcgtccgtaaaaatcgtgctccattttcacgtgcggctctttaaaatgaccacacggaaaaaatcaatttttgcaagcgggcctcttaatagatccgcacgcgaaaatagcccacccacccttttagctcccggcgccactcgatctcctcccatcctcccgctcggccactcccgtttcctctccctctccctctcccccctccccctccccctctacccactcccggcgacggtggcagtggcattggtgagagtgacggcggcatcgatggcagcagcggcatcggtggcatcagctagggtggtggcgacagagcggatccgtcgtcagccaccgtggcgacgacgacggcagtggcggcagtggtatcccagcctcaggcgtctggattcgtcaccgacaaccgctgagacgacggcggcgggcctcaggcaggccggcggcggctagattggggttccagggctgctaaagcgcccgcatataaaaattgcgattttcgcgtgcgggtgcgtcacccgaaaaaaaaaatcggattttcacagacacttagttcaagacgggtggaagatccatatgcgaaaactgctttcgaccacacgaaaaaatcgttattgtactagtgacacacttcaggttatccagtcgggtgtaagaagaagatattatagttcagctgaatagttgctcgcaggctagtagtcacatatcgacactcacaagtatcacaattttgcatgtggtatccataatccatctgcctatcgcctacttaatttaattatcagcagccaggattggattgggacggccggatcgatctttttctagctaagtgaaagccatgcaacactagttggtagtctgtttgaactggaaacttcaagtctagaacgactgaacgagctagctaacatgcagcgtcgtctaaagaatttgttttggtcattccatgtacatgatcgatatggcaaccaccgcaaaaattggtgccgtagatatggttggaggaactacttgacagtagtatatatatgtgcaatatgtatataggatgtgtttgacagaacttcggctccaactccatctcttctgaggttgaaacccgaagttgaaactgagccaaacctttcagctccacccaaaaaataaagtggaatatactaaagtgctctcataaaataaaagagttagaagcttcaaaactccactcaagttctaaactcctggagttaaactttgaagttagagctttgtataacatgcccatagaacatgctgcattcataactggaatgagaaattaataacctatacaaaaccaatccattctgcatgtatgatgtgaggcaaactgactttactgaagagctgaaaaggcaaactgacaatagtgttaggttcagttatataaactctagcatacgcaatacgctacacaaattggtttcatcaagtgttggtataaatcatc

SEQ ID NO: 20267 - DNA, 1501 bp, Oryza sativa
accgccacttgtggtagccgctaccgccgatagagagagagaggtggggggagagagggacgtgggaggtacgggacgcaggggagagagggaggagttgagggagaggtgggaggtgagggagaggacttagttttttttttttttgactgttgcgacgatttttatgatgcctaagctattttgcaggtggatctcttaagaggtatttttgcatgcggacaacgatatcgcccacggttgttatttttgcaggtggccatttagctccgagaggcctacctacttagaaaaaaatgtcatcatctgggaaaatggtttttctggtgggaaaatggtttttctggtagtgtttctgctaatcatctaatttttggtttcatctaggactgaccaccatcaccatgagtaccagcacaatatacatacatacgagttgttactttagaagatgagtttccaatcaaaaataatatacgtacgacgctattgtctggctccagtgtactaccgaagcaacgatgaaagcctcacacacgatagatgattcaggctatatgatgaattttagtgtgcgcctgttagctgttagctgtgcccacgctgtaacacggtcggacatccttaagatgataccattgtacctatcaaatatacttgatcacgaggtgaaaccgttactatattttttttctcaaatcccgttgcaacgcatgggccctctgctagtatctatgaaataaatgaaaaagtattcaaactacatacaacgagtaatgatctaaagttgtacattacatatcactgcgattttaatttaagctatgtgcaattttatgtagatgaaaacttagaaattttgagacgcgtgaaatctagtaaattccgttctttaattgttgcgctattcgtatgcttttgttgcaaagcgggatatttgtcgtagttgccatgtgttcaggttcagatgtgttcaggttcagttgtttaagaccctgtttagataggattaaaacttttaagtccctatcacatcggatgtttggacactaattataaatattaaacgtagactattaataaaacccatccgtaatcttggactaattcgcgagacgaatctattgagcctaattaatccataattagtctatgtggtgctacagtaaacattctctaattataaattagttaggcttaaaaaatttgtctcgcaaattagctttcatttatgtaattagttttgtaaatagtctatatttaatactctaaattagtgtctaaatacagagattaaagttaagtccatggatccaaacatcacctaaacaatcagacatgtacatatatatttgtgcgattgacctctctatataacaaaaagagtgtactagtagtagtagtatgacagacatgagaaactacaaaacatcaacgatgcaggcaatctaagtccctgtcctttattcctgacaaaaaaaacaccaaacctatactgagc

SEQ ID NO: 20268 - DNA, 1501 bp, Oryza sativa
aaaataaataatttgagttatgttttttttatgttgaggtgtgaaaattgaatttagtgttgcatacataacaatgtaatctatgctatgaaattttttatgaccattcagatgacatataagagataagttatttgtgttgcataaacaacaaatgcacttaagtactggctggttttaatgtttgacattattgacttttgattgaatatatgttttaccattcatcttatataaaatatatgtaattgttgtttattttgttgtgatttttttataattaaaggtattttaatcatgtttttttatatttgcatatttttaataagacgattagtcaaacgtatatctcaaagtcaacgacgtcaaacattaaaaatggaagggagtatatttttagaatttaagccactgctatttaataggagcatttttactgtttttattgcttttaataatgtttgcactgcattgttgttatttttgcaaatttgcatacaacattggtactacccccatgtatttaaacagacaaaaggctacccttggacccttggtccaaattcaccgaaacaattttaaagaaggaaaatccttttttgcggagaaaagaagtgatatctgaatgttcagtattaaaatatggttaaattcgctagaaagaaaacgaacaacccgctctgttgtaattccaacagcatctctacaaatagcattcaagatatatacacgcaaagtagttctgcaatgtgtgctggggcccaattgctatatgttgttatcctctgataattagctgagttcggatgggggagatgggagcctaactcctgtgcacggaaaacggagtggtccattaacacgtgattaattaagtattagctaatttttttttcaaaaatggattaatttgatttttttaagcaactttcgtatagaaactttttgcaaaaaacacaccgtttagtagtttgaaaagcgtgcgcgcggaaaacgaaggagaggggatgggaaaaggtgcatgcgaacacagccagaatgttgttgcaaactgcaaccagtcatatgatgatttataccaacacttgatgaaaccaatttgtgtagcgtattgcgtatgctagagtttatataactgaacctaacactattgtcagtttgccttttcagctcttcagtaaagtcagtttgcctcacatcatacatgcagaatggattggttttgtataggttattaatttctcattccagttatgaatgcagcatgttctatgggcatgttatacaaagctctaacttcaaagtttaactccaggagtttagaacttgagtggagttttgaagcttctaactcttttattttatgagagcactttagtatattccactttattttttgggtggagctgaaaggtttggctcagtttcaacttcgggtttcaacctcagaagagatggagttggagccgaagttctgtcaaacacatcctatatacatatt

SEQ ID NO: 20269 - DNA, 1501 bp, Oryza sativa
ccgtgaagatacctgccatgctgcaaaatcttctgaccccatattcagcggtatagctaggatattcctcacatcctcctcccagaaaatatcctggatcaattctttgtcccattctccaagtctgctacccggttcagtattgtgcctcctcttggagtaattggccgtcgggttatacctgatggaatccaaggatccttccatatatcaatttcagaaccatcgccaacccgccatatcagaccagacttcagcgcctgtacaccacgcacgatactcctccatgaataggaaatacctgggccttccttcacctccaaatctggaaaatacttagcttttaaaactcttgcacatagagagtctgggttggacagaagccgccaagcctggcgagattaaacggatgcaggtctctgtaacccagcccccccttctccttccgactgcacaacctatcccaggctatccagtgcatcttattttcccgatcgtgttgcgcccaaaagaagcggcaaatgagactgctaatttcatcacacaaagtttttgtcagatcgaaacaagacatcgcgaaggagggaatcgcctgtgcaaccgccttgattaaaatgtccttcccagcccgtgacaaaagtttttccttccaaccttgaattttcctccacaccctctccttcagataactgaaggtttttgattttgatctccccatatacaccggcaaacctagatacttttcattccatgcttcaactccaatatccagtgcccctctgaacttctccctgtcattttccttggtgttcatgctgaacattactgaagatttctctttattaatggtttgccccgagcatcgttcatacaaggaaagaacattctgcagacactcagcactccgttcatctgcctttaggagtaacaacgagtcatccgcaaacagtaaatgcttgttgacaaaccttcaccccggatagatcacccctttcttctgccgcattcagcagggacgagaacacctctgcacatagcaggaataaatatggcgagatgggatccccttgacgcaggcctcttataggaatgatctgctcagtataggtttggtgttttttttgtcaggaataaaggacagggacttagattgcctgcatcgttgatgttttgtagtttctcatgtctgtcatactactactactagtacactctttttgttatatagagaggtcaatcgcacaaatatatatgtacatgtctgattgtttaggtgatgtttggatccatggacttaactttaatctctgtatttagacactaatttagagtattaaatatagactatttacaaaactaattacataaatgaaagctaatttgcgagacaaattttttaagcctaactaatttataattagagaatgtttactgtagcaccacatagactaattatggattaattaggctcaatagattcgtctcgcgaattagtccaaga

SEQ ID NO: 20270 - DNA, 153 bp, Oryza sativa
ttttcgcaaacttatgcgtacatgtggaccttcccccgccagggaaaatgctttttggccccatggaaaaacacattttctagtagtgaaacgtaatttaatcgaactcttcgatagtattgccaatgtatataattattgcatggacaacga

SEQ ID NO: 20271 - DNA, 1501 bp, Oryza sativa
atgtaggagatgccatgcttctacggctttaccccataatttctcatagatagtccttacaatctgtgcataatacctcctctaacattgactccttgcatgaaaaaaatatgatgaacatttaacctacggttacacagatgcatgatattcataagtttcctttttaacataaatgaaaatcaacacaaggaacttattggatatattaatatagcacagtagacttaatttctactgttttttttataaaaaagaacactagcaccctagagcagtctcatcggtgatgatgtagaaagatatgggtcttttcgtcggccaccacactaaaccatcaagaaaatattaggatatatataatggacaagatcgtagatagagatagatcaagatgtttcttgccatttgcatattttgtcgttgtgttggaggtatgttgtaggtcggtggaatagagtgcccgtggaccgctggattctcaaatgacaaaaaaataacaggtaagacgcgtgacataaatcattattatattaaaaagtcaaaaaaaaaggaaacaatgttgatagaccattgtttcgttagaggttggggagttgaaaaagaagggaacttatacactaagacgattggatttaaattagatggaaggttgagaattaagctgatcctaaacgattttgttatacatttgttgataaattttctttcaaaaattacagtgtaattacatcataacttacgtgtaattacaaattgtaacttttacataattttgaatcgttaaatttgtttcaaggattcgtgcgagcgaggatggaaaaaatcacaacgtgcgtacgagtgaggggatttcataaaaaaaacatccgctctgcgtaaatagcgtgttaccatgagatttatgaaactttcatataatttataagggacataatgtaatcaccctataattaaactactatatttacatccgttatattttgtagagagaatttagcaacaaacgttttgatagtctcgatgccaaccaacacggcttgaactaccgggggttgttgggcctatttcccatctggacgcagtactttgtcccaaaatcggaaacccgtactatctccgtcacacccctctccacccactgtcatgtgggtcccacgggacccgcgtcgtcggtgggccccacatggcagcggccgcgcggctccccgcggtgggacttgggagagtgtgtgtgtgggccccgccgcatataaaaatcgctacgcgcacacgcgacgaaatcctcctctcgttcgcctcgtcttctcttctccccccacttcctccgcctcctccgccgccgcgcttttcgccgccgcggcgagccatggacgccgcagggtagggttcctctcgccccttctacgtcgtggaggaaccgcgtgggccgattctgggtgggggggttttgggatgattttttgattatttttttatctctctttttttggttttcctc

SEQ ID NO: 20272 - DNA, 1501 bp, Oryza sativa
gtcccaaaatgtaagcatttttagctatgaatctagacaactatgtgttcaggttcatagctaaaagttgctatattttgggacggagggagtagcatagaaataatcatccattaggcatttgaataacatttcttttacaattattattgtggcatgcttatctgtttctttgattatgagcatggcactcttttgcctgtaactgatgcgattccatagcttacacacaagaccatctaataacatcccttgtcatttattatttgtttcagcactttgatgcccttgtagctggccacttccgccaccgtggtcatgccattctggctgcatgcaaatattacatggaaggtcataaggttgggtccgtagtccctaacgaggacgaggaggatgcgaagcagcaggacgacactgatgcaggaggatccggcagcagcagcggagcaaagccgcagcctgaaaagccagacctgtgcaagggccgtgctgcatccttcaaaaccaacatggccgttctgtttgaggagctcttgatggaattcaacgtcaagggtgctgacaccaagaagttctgcgatgagaagttgaagaagaaccagcaggctgctgctgctgctcgctgaagaggccccccagctgcagctacaaaacgcacagatcttctctagttctgagggtttcataatgaagcgaaaaccgtagaaaggggttttgcttgcctaactatagaagtgctgtgtagatagtccattctcgtttttctccttttgttgtacaggttgagtgtgtggacttaaaaaatttaaatgatcatgttagatgctaactgaagtatcatcaacccacccctcgttgtggtgcgatcatgaaatagacacctgcataagtaagcaaggtggcggttccatatgatttatgttggcttgcatttaggttacaccgtgttacttgcaagagtttctccatcggctagcgtggtggctttgatcatatggttagatttgccctttttcttgtgagttcactttttttgcagctaacattgcgttagtttcaaactgctttactaatagatttaattcaaccttgagttgacatttatcttctcggaaacatatgaataattctttactgacggatgtaattcgaccttgagataaccattatcttgtatgaaacatttgaacaatttgtgcgatttatcgtggctagactttttttttatcatctgttctgatagtatcttttacttgtgacagtagtagagtagcagaatttaatctaaccattgaattgctataggtatttaaaacattttatttaaaaatttgacaagtacaactttaataattcatctatggcaacatttcataattttacccctcaaaagtatttgttattcacataaccagataagattcatatatattggtttacttaaacgccgtaggagcggtgaaaatttagagcgctacgtcagcattttttacaaaaa

SEQ ID NO: 20273 - DNA, 1501 bp, Oryza sativa
gtatatggcatggtactacatggaagttgtgattttatttgccaagatatatacttgaaaatatactaagttagtttggagggtacgagttttgatgttcttggcttagcttcccttttcctatagatgttaatgagttaattctgaagtaatgtcaatattccttcattgtataccagtctttttgcagccaccttttctgtgcttttatcaatggcatcttcctgcagcaacctttatgtgcttatgcttggaggtatatatgttttcttactgtcttatctgggtgatatatgtggccttcagatctcttataaaattatttaggtttagtgtcatgatagcataatgtttattgtacaagtaggtttttcctcaatttccttccctatgcaacaaatcatattttatttgttaatctgttgtgctctatatttgtacacagagtgaaaatacatatgcattgataatatcctttgtggacaattttatattcgtaatagtgatgcatacatcataaaaaaattatctgtcaacctgacaacttggcatatgaccccaaaatttggatcatgtagttcattttctgagacacaacggtctttagggcttagtatagaccgccacaggtcttttagcctcatatttggagactacattattttacgaatcatattataacgactaaagttggttagcgctgggtctataagtcaagacagtaattgatcacaaagtatgttgcacacctagcaaaaaagaaatctaattggctcaattgaagatttcaatattgacaagaaatttagtaaaccacaattacgataggttcaggcactttgtataagaggctaacattttttcttccgctataaccatttataagctattaatatttaatatttaatataacattgattccataggttagtgttgtttgcagggcgaactattgcttacccgaaaggattaaagccacaggtataagttctaaactatatagtaccatcctcagttgatatgtgtagtccatataggatgacagtacatatatgtgccaccccaaatgacccaggcctccatatctctggctatactgtgtggttcccgcgttgatcataaaattttatttcagttcattggtgtgtgacaaagctacatgcacttcaaacaattttagatgagacatgccatatgttccaatagggacacactgggatattatttttcttctatacaagcgttattcctgcttttgtttttcccatctcgacatagtttttgaattttctaatgacccatccttccgaatttatattatttgctttgtaaatatgcttacagagttttcattatcaaccaacttcaagatatgattttattaatttgttttctgtttaatttattattgttctgtttgccccttcttggaagacatagatgtttcaacacagtttatttgaaaagagttttgtcctacctgtcatatatactcatcaca

SEQ ID NO: 20274 - DNA, 187 bp, Oryza sativa
tcgcgcatccgtgaagaggagcgcaccgtccaggcgaaaaaaaagcagctttaaagcaaaatcacttatggcttttggattctgtggttgacttttgactttcaaaatcacttatgactgcggccctcgacaccattccccatctcccttcgaccggtcgccgacaccccgctcgtcggggcccggc

SEQ ID NO: 20275 - DNA, 732 bp, Oryza sativa
ttatgtttgtggcgtatgcttgatcgatttacatttgatgctttacaagtttggtgctattagccataacaccgtcctgcttttgtttatactctttttgttattcatgacgcgtgggcacagaccgaaagcaattgctggtaattaaatttgttttaaaccctttctatatgcgcatctttgggtattttttgtgcacattttgttaaggctactgaaaaggtgaatatttactgtctggaaatggaagggcgtttattacgtgaaatatattaggtaactgacccgcatcctaaagcgtgcaaatagtctcgtggttggtgaattactgagttggttaatggttaatgctgatcggtctcatatttgttctctctaaaaagccaagcgtactatgctaaatatttaggcaaattttgctgcagaatatcgtgacttctcgtggttttagctgtaggacactgcacgaaatcactaatgagaaaacgctacagaacatcgtgacttcatagttttagcggtaggacaccatatgaagtcacttataagggaacacactctgtaaatgtggttatttatccgaggacactccatccattaaattaatgttttcgtgctaactagacgagagggggcctacttttttacacaacttgaccaaattgcccctcctctctcattctcatcctccttccttatctcttcatctctctctcattctcttttacaagg

SEQ ID NO: 20276 - DNA, 254 bp, Oryza sativa
ctatagggcgaattcgagctcggtacccgttgatggaaatcgatggattcgtcccagaactcacccgctgcctaattgattaaaaatctagctctgatgcttgatgattaccaccaattggtctctttgatctgatgctatttagagtccagatcacaccatgtcaccatgcagcatgattaatttgtttttgtgatcgagatgcagtcggcgagtcggttgtctggaatttggtggccgcgctttccttcagg

SEQ ID NO: 20277 - DNA, 294 bp, Oryza sativa
gagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctactcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaa

SEQ ID NO: 20278 - DNA, 1501 bp, Oryza sativa
aaatccaacaatttatggagctagaaataacctgttctaaacaacatttgatgtgtgccatggccttatagcgctagacatttattttatcaatcttgaagaaattaccggtgcctttttatcccaccaattgtatgtaagcaaaacctatgagcttataacgcccttacatgacttcaaacacgacccaagtatgaactatgttgtacttcaataccatatttcagggacatatccgatggaaaccatcaaataagtgaaaacacgtgaaaatcggaactaaaagtttaataaattcatgaaaaattactggagagaagtgtaggcatgaaatatattcaccaaatatcaagttaaactcaactttatttgggagtaacaaaaatgccaaatttcggatgaaaaataatagaacactattcacctaaaatttgtcttttatattctctcaaataaaagttgagtttcgacttgagatttgatgtaaatgtatttcatgtctatatttatctctattaatttttatataaatttagagaacttttaaatataattttcatgagttttcacttatttaacggttttcacatgatatttccccatgtttcagcctccaaagatgacaacatgtgtgcgatttacctgtacacgtagcttggcaaaaggttgtagtacagcctaattgtccatgttaggtggtgtttggatcatggacttaactttagtctctgttttaaacactaatttagagtattaaatatagactatttacaaaactaattatataaatgaaagctaatttgcgagacaaattttttaagtctaattaatccataattagagaatgtttactgtatcatcacataggctaatcatgacttaattaggctcaatagattcgtctcgcgaattagtctaagattatggatgggttttattaatagtctacgtttaatatttataattagtgtccaaacattcgatgtgatagggacttaaaagttttacaaagagggtcttagtactactgctaacgaatgtgatagtgacttaaaaattttataaaagagggtcttagtactactgctaagtgtagagagagagagagggggtgtggttagtactaatagctttgggggtggcgtggcgcagggccaaattggttgcagggacaggctgtgggtttgtaggcggtcaaacgagaattccaaaagcgcccctgaaagccgggcaagcgacatggcggcacttgtttattgctcctcctcctcctctagtccttgatgctgccgaaatcagtacggaaaaaagagaaaaagaaggggggaaaatggctgctgtctctcacatgcatcctgcctgcctctgcctgtaggctgtagcaaagcactgaccgttatgtgggccccacatgtcggatgctttgaccaaaacgcccctcactgtgtacagaaccagaggagctgattggtggtggtcctgcattgtccagctagagatg

SEQ ID NO: 20279 - DNA, 387 bp, Oryza sativa
attctcccgtcagttataaagcggtaattttaataaagagaatgcaatagtttaaaacaatataattttcgcaataatcgggttcaaaatgttcgagaagagcatgacttgtcttgctcaaagaaaaggtattcctaagcttcactgacaaactcaaattgcacaacgagaacctccgaagcaacaacaactacacgaacaacaaaataaggctaaaactcttaacaacgaaacgataacagcacataaaaacaacatatgatggttcttttaagttataacatcaacttgtagctcatagaaccgatatatgactattcgaaatttaactgcatttcaaatagagattttttaattgtttaatgcaacatcgctcgagaagagaaa

SEQ ID NO: 20280 - DNA, 1501 bp, Oryza sativa
taatgtcgttgatgacccaaggaagatttgttgatagtgcatcatatttttggccttttgtaatttatcgtacaagcatcagaaactgcaatggacggttgatcggttagttgttaactattactccgtatgaattatgattgcccaaacctgaactgaagttgccgatgaagctgcatatgcattgctgtccagaaatgatggacttcaccagattggatggaattatttgcagtcttccaaatcaaaagtactatgctattgtttggaatttgtgaagttcataggaatcgaattattagtggaaacaattcagtttctctaaggctcaattcgtactgatctgcctccccaagtactttacgtaataagatttatgaacttcaaaaactggaatactgcagcaaatcttcagactaaagttatttgcatgattttacctaaattttttgtttgcactggagtaacatatcggctgtcctggtaatcaaacacatagaaaggcacaagtgccacgattatctgaatattctccagaggcaaacacactttgagctcgctttcagaaagcaaagcatgttgcatcctcctgttgcctgttgcttctcacaagaaatttatttattttatttaattttgttcagagaaagctatccagattccagatctcgtcgctgaccagcaagcacatggcatggccacatggcccaggtgtgagattctcagacgtttcaggaagaatcctaccctagtaaattacccatgtttttcaccagctcctctaaaatcactacgagcattaatcgaaacgacggttaataccatcaatccatatttttaaatttgatccgtgtatgccaaagggctaaaggattttttttttatactttcaagcttggatccgtttgaatgtgctgtcaacaacaaaagtttgatagagttcaatcaatttgagggctgtttggcttcaatccaaaatggcccttgatcttgcacatcgctgccatgcaatgtatatattatgatttcaatttccacgaaaacataaggaaacttgcaggaactaccctctatttgagctctacagcctataggatcctgactattgtttagtcttggaatttggaaatgtcaaaattctgaaattttagtaattagggccctttgatttggaaaaaaaacatagaaattttgcaagattttaatcctataggaaaatttcctatgaaggcctttaaaacaagggattgaatcatatgttatcctttgaaatttctatggaatagacaatttcatagatattttagagaaaatttagcaagggcttcaacctcttgggaattttcctttgagtctatctctctcaaccgattcctacgtttttcctgtggtccaaacaaatggttattcctgtgcttttcatgtattttgtaatcttctgttttgcacttatgttcctattagaattatgtgtttttcctattccttcatttttacattt

SEQ ID NO: 20281 - DNA, 1501 bp, Oryza sativa
ggtctcccggctcgtcgtctcgctgcgcctccaccgtcatcgtcatcgcagcggcgtgttccacgccgtcctcgtctccgtgcagctgctgctagctgtccctcgtcgcctcctcgccggccccggtcgtcggcgtcgtcgtcctcccgtcgttcccggtcgtcgtggcgttcgtccctccgtcgagccgttctcgtccgtcctcggtgtttcgtcaaggtcgctgcagccccgtcatcgtcttcgtcctcgcctccgcgtcgtcaagcctcgtgccggccgtgtctcgccttcgttcaaggatcgccgccgaagtcgttccctcgccgtccgtctccgccgcgtccgttcgtcgttgtctttcccacgcctcgtcgcgtggtggtaaggatctctcctctcgctgccccgtcctcgtcctttcagtgtcgccccgtacccgttgtgcggttgtcaaccccggtacccgtgtaccggtgtcggtagtcgttcacgtgtgcgggtggtgactgtgtagtgtccgtgttagtgtgcccactcggtagccgcgtggtttccacgtgtgcaggccgtgtggtgtctagtggagtccgtttgtcggccactcgcctcggttgacacacggggtccgcttccgtcgacccgtggaccgtctctatgtactcggtctaccgtggtcctttaggttgacatgtggggtccgcatgtcaacagcgcagccttcctgtcttttccaggctagtgcttccacatgttttatagttgaaaaacctaattataataatccgcaaatctccatataacagcactaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgaaggttcggaaggccgttctctttgagcaaggcaagtcacatcatccttgagcatattgaatcccagtttataaaattattttgatttaaattaatgcattaacgctttatttaaattcccgcgttatcactgttttatttagccatgcctatttacctttgttaagacattattattgctattgttattattaccttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggattaa

SEQ ID NO: 20282 - DNA, 1501 bp, Oryza sativa
taggttggctagtccgctatctaagatgtcacttgatgttcactaaaaataacttttagagagatgtagtaattcactctaatgggttggtatcgattgggacgcgtttgaatcataacagataatgattgttagttctatgtactgaacttcttctatcttgacataaaatctacttgaggcatctgccgctggccccaaaaaaatattaatagtttcatagcatgatttgatcttcagttttggataacctaaataccaaaaactgaaaacaaattcttcggctgaaccatattcccactccagacacgctgccgtgccatcccatgccaactggggatggctttaggtggcgcgcgcggctttaaactgtgccgacctagccggccgcgctttgcctttctcctcctttcgtgaaagatttgctgctgctttctcaggaacacatcgatctgtccgctgcaagagcctgtggttcgcccggtcactttcgccggctccagcccagcggtgcgttgctgctcgagcaacccaagcgtactccgtagtgtacaagtgaacttgctgtactactgcaagcactgctcgatcaaggcaaccaaaagcagccagccaagagaccaagcggtttaaggctgcacgcgccgtacaacacactgacgcgttcgatgtgccactttgaccgcgctccgtggggatgcgtgtggcaacaacagaggcacacgggtttaaaacgacgtgattagagcatgtacaatagtatgctataagccagctataaacatattttaaaaagataaataaagagagagaagagcagcgggctatagatttatagccaactatatcacggactccaagacgcagtgtgtatgacaggtgggaccagatattaatagtgtagtatgtaactattgtatagatgagctattagattggctatagatgaattaaagctagtagttagctatactattaaacttgctcttactgtgttactgtgtgccgttgcgccccctctggcccctgcattaaaattcgcgcgccagaaaattcgagagagagagagagagagatgaggatgtgattcgtctcgggatcagaaacctagcagttgggggttcgctgccaggcggttgccacacagaacaatggtgccacttgctcgatatacctgcatggcttgatccaacagtactgctactgctgctactactacaagtgtattgtttggaatagattatttcttcgctgtggcgcctttgcttccttttaatcacctcggtcaccaagcaaagacagcggggttgcctcctaatgattgcctttacaatggtgattaccgccaaaggggaacatgtggagagggaaacggagagtggtatcatgactacgtcatgcatgccaaccgtggtgcgccagcgccatcactagatatatcaatctactagctggtagcctggtaagtaagcatcaaatcaaacttttgctaatgaccaag

SEQ ID NO: 20283 - DNA, 1501 bp, Oryza sativa
agaactcttcttgtccttccttatccgaaactccttctatatatgaggtatgattccgtataagacttggtatatggtgggtcctgccaagcttagtcggttactactgggtatgtggtatccataaccctgacagaatgagatatgtagcttggaaattgttctctattaatttagtatctaaattaaggttgtgttcgggaggtgaggttgggaactcacctgccgcgcatacaaaatagagcgatgtattttctcatgattaattaagtatttactttttttgaaaatggattaatatgatttttaaagcaactttcgtatagaaatttgtttttgcaaaaaaacgcactgtttagcagtttgaaaagcatgcacgtggaaaacgagggaagtatgttggaaaagttggggaaagaactctgcctaaggaaggaggggagagcatgagctagagaggggaggagcagggcaatgtgcacctcatgagcatgcgagtgggcaggggtagtaagtggttttttattttttaagttttctacatatagttctaatgattaaaagtaatgagtccatcgatttaggtgatagtatggtaagttgtttttcatcgttgttctcagaactagctgggtggcccgcgcaattgcgcggctagcacccatataaaattatatatgttttaatatgattttacttaaaaattattaaatagttatctcgatgtcttaagattttgaaaggccaaaccttattatctttgtgtttcaaatttcatagtttttgaaaatcacatcagcaccctttacttctatcatattattcgttattatatagctcaatctaccactgtttctattcattctcctaataacctttaaaaattggatctaaaaactttttagactttattgtcctgttggtcttcttttttataatttctagaagtctcgacaaacgctgttattatactcctctacgaccgtccattgcatcttctttttattgtcattattatttaaaaatatatcatagtttttgtttaggatcatttttttatattatagaagttccgccaaaacatcatcgactttgtcactgtactcctctgcggttcgtccgctgccgcccttctttattgtcattgagattttaaaatcaaacatgattatcattggggtttattttttatttttagacgcccgaacctttaaaaattggaccttatagtttttagagtatattgtcccgttgggtttcattttttttcataatagaaatcctatcaaacgctgccaatatactcctctacgacccatccgccgcatactccttattgccattgggattgtaaaactcaaacataactatcgttggaattcattttttactttctagaagacccacaaccatcggtggctatgccattgtactcctatacgacccgccagctgcctcttatttttattgtaattgagattttaaaaatcaaatatgatta

SEQ ID NO: 20284 - DNA, 366 bp, Oryza sativa
attagtagtttcgtaaggttattgcaaaatttaaaactatgttgtcattgtaatatattttaataatataatgagaaaacagatatgctattatatgagagaaaatataatgatgctagccgcgcaatctgcgcgggccgccatgctagttaatttagatgtgtatgtttgtagaatgatatatgactcaatatacgctgtcaaaatttcacattattttatcgatagattagggatgtgtcgacgttttaggtatcgactacggtatttgcaaggtatggagatcattggtaccaggatatatgcgagattgagataaaaaggatggatacaaggattttaaacaggttcggaccccttcatagg

SEQ ID NO: 20285 - DNA, 335 bp, Oryza sativa
tccccccgcgtcgggcgcctggttgtaatcattatcgacaaatcaggcgccttttatttttgtttttaaaaacaaacggtaatacttcctccattccataatataaggcacaaccacttctttagatgttccataatataaggcatgcatgcatgtagacgattaactatgaccccttctccattaaattattacttttttaaatcctccactctcatgttctctaattctattggatgcatgcattgtatttattaggatgatccaaactataagatgataataattattttcttggtctttgggttatggtggttatgccttatattttggaa

SEQ ID NO: 20286 - DNA, 1501 bp, Oryza sativa
aaaaaaattataagaactagagtgcatgtgaccacctaactccttgcaatttttattcttataatttgaaaatcctataaaccaaataagcccttcaaaggaaattaaatcatgaggtttgaggttaggtttgaattctctaaaaagtggaggaaaggactcaacagaaaaaaaaatcctatagaatttcgatcctataaaattttagttaaaaatactttgttccaaaattgccatggataaaatgtaatttctatgcatacaactaaattatcgatggcaacagtgcatgagcatatatttatttcattgacctacggttgcatgtcttcgatctctatggagtagtaccgaggctaagtttagtttcaaacttttccttcaaacttacagcttttttatcacattaaaactttcctacatataaacttttaacttttccatcacatctttcaatttcaaccaaacttctaattttagcgtgaactaaacacaccctgaattcaaaactctttttattttccttcaagatgtccgatgcacacgctctatgtagacgcaagaagatgttggagcagcagactaacagtagcaaaaaaatggcaggtcgaaaagcaactgcgacggttgctccgtcatcctctcatcgcctttttattgctccggcgttgggaaccgcaacaatggaacagcccaaatcgacagtcccctccacccccctcccccatcctctctccccccacgcaatacttgtcactactcgcgctgcccactacagcgtctctgcatgtatatccatctatccatccattcccccattttccaaataaaaatacagcaaaccaaacacaaacgcagcctcgcactgtactcgaagaaaaatcggtgctgtacgtactacgccacgagataacgagagagagagagagagagagagaggagaaaatggaaatgctactgctcgtaccacgccgctacgtccgctaggtcgacaggcccggggggaggcaggtgtttgtcgtctagctcgggtcggagcgcgccttctcgtgtcgggctcgacgtccgcgactcctcgcccctggtcgagagctcgcaggcgcagcgggagagagagagagagagagagagagagagacaagccgcgcaataaaggcgcgcgcgcgagcgagcgaagcaaagcaccattactaaagaccgcggcgtgtgcttgcgttgcgagcgagcgagagcgagagagagattgagagagagagagggaagggatggcgatgccgtatgcctccctgtctccggcggtggccgaccaccgctcgtccccggcagccgcgaccgcctccctcctccccttctgccgctccaccccgctctccgcgtaagcaacgcgaacccgcggctacaacccattttcttggctccagtggtgcatgtgacaacacggtgagacgttgtgtgtgggtgggtgggtgcaggggcggtggtggcgtcgcgatgggggagg

SEQ ID NO: 20287 - DNA, 892 bp, Oryza sativa
tttacccaacgaaagagttggcagtgccactgccaaaacttacctaaattttggcactaccaatatttcgatagagtacgaaatcagacataccctaggatattcctattattcccttcgtcctaatataactgcaacctaatacatatgtgatatattctaggatgtccagattcatattcttaggataggtcagtacgtcacacctatactaggttacatttatattggttactttaggggcaagagaactatccgctgccttttctaggaaaatgctagtaatcgggctcccgatcaacgccagaaaaatcgggcacccgctgcttcctgcacctccgcgccatccccaccacacgccccaccacatgcgtcgttgcaacaaatcacccacgtattatggaaacgctctattaaggggatcatttcaacttttgtttcaccaacaatatttcatcaagtgtactcgtgatgtttcactatgtatagatcaaatgttgcagtgaattaaaatatccttttgctatttgctgaaacattattttatatatggtaaaacaacacctgattttttggaaaccgtttgtttcatactttgaagtaaaatgttccatgaggtggtttggttgagtttaagctttttaaacaattgaaacgttttcaatctatttaatgaaacaattccggtctacttgatggaacagcgcccgatttttgaaaaaaattcaggtgcctcgccttttttatcagtttatacgttgattgaaggtaaaacaaatcgaccaaaatggtaaatgcattaatggacatgagtctccatacagttcgaccactaataaactagtcaattcgttgaacataggtctaacaatttacttattggcttataagg

SEQ ID NO: 20288 - DNA, 197 bp, Oryza sativa
atcgaagtcactggctctttttctttgatctttgctattatggtaggtagggatgctaccacgttgcagaaggctcacacattgcacttgcatcagacttcccataccacatgtagtaactccttgatgaagctctctctcatagcctgatcttctggtgaggggataactctcacttcaatcaaatgcgacgtagc

SEQ ID NO: 20289 - DNA, 208 bp, Oryza sativa
tacggtcctacctcacaaaccagagcctggccaacaccagcgatcagaacaatattctttcatcagctctttcagagtttcagttcgttatattattatatagcgaacgctggtcaattgacaatttgttgtttagccacacattggctccttgctgttgctgttctcggacggacctgcattctcttttactttcaaccacaacaga

SEQ ID NO: 20290 - DNA, 351 bp, Oryza sativa
cttggtgtcgtactaccaaaccctaactcctcctcctcctgctccgctcgtctcaggtcaacgacccgccggtgcgcaacacgcaggaggccttccagatggacatgcgcggctcccgcatggtacacacttgctccatgatttgtttcttcgcggcggtgtttaaatcttgccctatagcatttgtctaaatgagcaaacttagagctacgatactcctaattttaagcgttgatatcacatttgctgtgccggctggatggagaactggagatgttcctcctacctcagtagtggagacaattggtgtgtaagaagaaaactgagtaattacttgctcaatttggtatt

SEQ ID NO: 20291 - DNA, 796 bp, Oryza sativa
cccattagggcttgttcggttgggccattcctggctgggatcggggcccaatccccatggaaaatcccggcgtggaaaggataccggcccacgcaagtataggcgttcggttaagccgaggcgagattttatcccggcccaccccggtgttttcccctcgtcatcggccgggaaatattcagcttctttggtggcgaggaaaaaatcctcttgacgcggcgacacaccgagagggggcgctgcggcggggacggctgcacggcgcggtgcgactccgacgcgacggcgacggcacgctctctcctccggcagttgactcctccggtggccaccttcttcccggtgagttccttcccttcccattagcctcctcttccagtgttagggtttcttgcgctcgtggcctcgtgctactgcggcggtgcacgacggtggcaggcatggcgggggacgccgcagcatcacaccccctcaccatggcgccgttgaagctctaagcgctacagtaaggagaagcaggaggacatggatctgttctttgttcctcacaaggtttcttgatttattcttctttctcccttgatttgttctgagtaatattcctaacttagtctgaagctctgatcatgtccttcctggatctgatcctctgtttgtagtgccgtagtgagaatatgttgattctcctggtagttgagtagttgaaagaccacgttttctgattctcaatgtgagttgttttaaatttgtacataaaggttatgaaaatggtttattcttaaaattagttggcagg

SEQ ID NO: 20292 - DNA, 468 bp, Oryza sativa
tgggacccacgggcccacctgtcggcgagagggagagaggaggccggttgggggaggagaaatagactttagggggggaaagagcagagggggctgagggaggggaggacttgggccaagcccgaaaggaaggaaggggaatttatttgcttttctttttatttaaattgatttagtgaactttgtggcattaaaattatttcttgagctccgaaaattcacggaaaaatctagagagtgtattagggcacagagaatattacaaaatattcccggccaatgatttttaaaggaaaattttaattctccaattatttcacttaattatattgatttaacttttatttaatttctagaaaatgcattatttaatgatttttaatcctgaacgaaaatcggggcgttacaaaggccaaccactacaccaggcggtcgtctaccaaagagacccgcctctgctccttcagc

SEQ ID NO: 20293 - DNA, 1501 bp, Oryza sativa
ccatgggaattaagtgtttaatgcaggcttcaaagaaaaggctgttgtttttgcaattgattttatttaaactcctttttgaaacaactaagtgagtgcttctcaaacgacacggataagacagtgcgtctcgtccggtcggagtatgtgcaatgtatcagtcttttaattgattcaaggttggcacccggccaacggctttcatacagccacccggccctagctgatcccatcagccgcagattttcccaacatcgaaccctttccacaacagcagtttcacaaagcagtagtcaaacaaaactacgctaggagtcacctcacgtccgcccatgaccgtgggcacggctgttcgaatagtttaataacctctgcagagggggtacactttacccacacgacattactaacccggatcacccagcccgtgcagaacggccacgactggagaccttgaggctttcatgacaaggcatttcgaaagccgacacaggttcaccatatgccaacgagaggggtcccagaccgacatcaggttaggtcccagaccatactgtgccacgaagcccgggggttcccccggcaccaccccgttgaatccacatgtctcttggcatcatggctcctccgattagctaattactcagccaggggcgtcccattccacccatgtggtcgcacttgccttatgttcagatgaaattccaaggaaaacggtccttaagtgcaagagcaggaaaccgtactcccggtatattccctgatctgcgattttggaaattcatttagttcgcaagcaccgacccaggtgtcgggttttccaagtcttttgtaaaacccaagttttacccatcgttggatattttaaatttgaggggaggtgttccgatgcgcgtgcctataggcccgtgcatcgaagcacaacggtcgacaaaggaggtttaagtgttcaataattcaaggagggtaattgtagcaattaggattgggggccggcaggctatctcgcaagccgtggccgaattactcgtgataatcctatttatgcaatatttgcgaaaaagaaatacttagatttaaattataggtgcaagatgatcaaaggtgacttgccttactcgagatcttgagcttgatcctcgaaaaccgcgcactccgggtcttcgggctccgaagctacacgcgaacgagacgactcaacaaacggcgaaattaaagctctattattgacctctaagcatgccattagatagatctcgaggtttgaggaattttggaagttgaacggagtcaaacggatgtatggttgaaaagatattgaatttctaagatcattggatttttggattaaaagaaaaggatttatttaaaccctttttgaattagcaatgaaagagggaggggaaacaaacttccctcaggcggctagggcgcggcccgagagaaaggggcggctcggccaagctgaataggccagccagcccgagaaggcggcccaagg

SEQ ID NO: 20294 - DNA, 1501 bp, Oryza sativa
cgggagtacggtttcctgctcttgcacttaaggaccgttttccttggaatttcatctgaacataaggcaagtgcgaccacatgggtggaatgggacgcccctggctgagtaattagctaatcggaggagccatgatgccaagagacatgtggattcaacggggtggtgccgggggaacccccgggcttcgtggcacagtatggtctgggacctaacctgatgtcggtctgggacccctctcgttggcatatggtgaacctgtgtcggctttcgaaatgccttgtcatgaaagcctcaaggtctccagtcgtggccgttctgcacgggctgggtgatccgggttagtaatgtcgtgtgggtaaagtgtaccccctctgcagaggttattaaactattcgaacagccgtgcccacggtcatgggcggacgtgaggtgactcctagcgtagttttgtttgactactgctttgtgaaactgctgttgtggaaagggttcgatgttgggaaaatctgcggctgatgggatcagctagggccgggtggctgtatgaaagccgttggccgggtgccaaccttgaatcaattaaaagactgatacattgcacatactccgaccggacgagacgcactgtcttatccgtgtcgtttgagaagcactcacttagttgtttcaaaaaggagtttaaataaaatcaattgcaaaaacaacagccttttctttgaagcctgcattaaacacttaattcccatggcttgctgagtactcatgtactcacccttgctttatataaataatcccccctagttgctgaagaagatgaagtggatcccgctgacgaggagttcttccaagagcaagtcggctacgatgagttttagggtttcggtttagttcccaagtcgcgcctgtgatgattggtccaagtcttggcttccgttttcccttttgtaatgcagttgtgagctcgggatctgtccgcagcccaacataactgtactcctactctgtaataaagaaacttctgttgctgtgatattctgtcttcctgtgataccagcactgtttcctaggactggtatcgattaacaggttaatttggagcgtcacgggctagttccgttcggggctagttcggggcgtgacaccgcgagacaaatttattaagcctaattaatatgtcattagcaaatatttactgcggcatcacattgttaaatcatggcgtaattaggctcaaaagattcgtctcgcaatttacatgcaaactgtgcaattggttttttcccacatttaatgccccatgcatgtgtccaaacatttgatatgacgtttttgttcaaaattttctaggatctaaacaaagccttagattatatagaaacttgcttccacctcacatattccagctctcctttttcaaacttaaaaattttgttactaactcaatattggtagtaggctagtagcacctgagatcctgggttcgactccccatgggagc

SEQ ID NO: 20295 - DNA, 522 bp, Oryza sativa
ttggcgtgtcacatccgatatacggacacacatttgaagtattaaatgtagactaataacaaaacaaattacagttccgcctgtaaactgcgagacgaatttattaagcctaagtaatctgtctttagcaaatgttcactgtagcaccacattgtcaaatcatggactaactaggcttaaaaattcgtcttgtagtttacacgcaaactgtgtaattagttatttttgtttatctatgtttaatactccatacatgtgtctaaacgttcgatataaccgggtgtaaaatttttgcatgggaacttaaacaggacctaagctagattcactcaatctccaaatttttccttcggtcagacaagtcgcggatacatggaaatggagattagatgacatactttggtttgtggcaatggctattttttgcctgggaacttaaacatggacatcacttcaaaaattttgtgcgcatatacgttgtgtgtaccaacggtgcccaaatttttcttgtctccttgtagt

SEQ ID NO: 20296 - DNA, 1501 bp, Oryza sativa
atgccatctccacttatgccctgtggcatgctttaggtcctagaaaaatagttgccaaaagaaaacttcgacctgaaggctgccatcaaatgctaaattgtatgcacaattaatagatttggaggatatgtcaaaccttggggttgtcgttgcaagggggaacctgcatcaagaggaaccaatcaacatattttagcttcctgatgctgtaggtcatgcctaatcaaagctatttaattaatcatgtggagagtactatttctaagcctaactgtttttaattgagatatctttttgagaatatatatgtgcagacagtcagaactggcgataatctagacgcaagtgtaatcaaaataatgccagtaacttggaataaggataaggacaggatgtgtctgttgaatgttgataggcatgtcatcgatcttttcgttagaactagctgaatttcactgacaattttatttctagatactacaattcctttttttatgcaactttgacaagcctaatagatatataattgatcctcgttgttaatactgatagccttgatgtcatgcattgaaaataatttctatctctgaagtgttgtggagtttttttttctttgtttaaataacataacaaatgtgtaagcgtaaacaggaatacaatatcacaagactcgacactattttttgtagaagtgcttactgtaaacagaaatgcaatatcacttagactcgacactattatttgtagaagtgcatcataagtgcttactgtgtatgatgtacagtaaacaccaggactaggttaataagttcttagtaagtatgatataccctattatctgtaaatgacttgactttgacaaatgtagttgaacaaagttgcaaacaggatatacaggaagtaccaggactaggtggaggtggaactaaaaccaagggagtgcatcccgtccctgacctgtaaccattatcaatcatgctcgatgggcaagagcactgaaatcctcctggagtgttgttgcagtactgtgtgaaggtgcaagggtaatccttgttttgtggcggaagttggtactaattgatgtctagtaataacatggataatttaacattagtttcatgaaagatcaaaacttcagaagagttatgctgaaaaaactggagatatttagtaactacatgaggtcctttagtccagctgggacaagttgccactgtaaagacagtgaagggcaatcagttgaattatcatagcataactggtagcatagaacagcattaatctgaatcctggattttccattgcttattcgcctaggtagtaggtagtagataagatatagcacaagctaaacaaaatctaggatttactgcacaccttaaaattgatttacatgtgattcccctgaaatagattccttttcatgtttagccttcctagatttctactacgaaagtacatctcgttgacatcttatatataatactattgagtttgcagg

SEQ ID NO: 20297 - DNA, 1501 bp, Oryza sativa
ttagagtgtaatgaccaccataactcataaggcacactaggtattaggatccatgatagttgacagacatctttccctacataaaaaaatacatgtcgctttttatcttttttttcttccgaaacaacatgtggctttttatctattgtctctaacatatttttatgggaatctgattgttgatgttatgtaaaaccatatcgtaaccaattttacttacaatatcaatgttacccttatccttcacatatcatattttttccattttcctcttcccttgcccatccaatgtaactatttttttaaaaaacaacaatcccagtgtttctatccagctataactacgatagacttagaatctactctgtgtgttgttgtttaatttaatttcagtgtacatctactactctacccctaaaatttaattggcaatattaacttcaaataaatatttttttataattgtacaatatttaacgtactatacatgctagattaaaatccattgacacacattcaaatatttccggaacatttggtagacatgcccatatgccatcatcaaaactcggaataaattatttatcattggacctacatgtcatggacacatgagagcccatatagctatatgagtgataaataattaattaccacgtcttaaaagtggtatgtagctatatgtccctcaaaactcacacccgttaagcgtgcttacgtacaggcgtacagccgcacggtgttcgcgtacatgtgccaatcaagcccgagaacggaaaacccgcaggcgagacgcgactccgtcacatggaagccatggactcccccccgcgctcccgtaacgtgcgccgtccgcgccccttggattcgattccggctcatgttttacgccacgcagtcctcctccttccgggcttcggtggttcgactcgtcggttaccttccgttccgttgcctctctctctctctctctctctctcttgcagaacggaccaccgggaaccaagaacaaaactactacccgaaaggaaaaaagaaaataatccttttatttgccctttaatttcccacccttttctgtcgtagaaagaggagggaaaaaaatattccggcgaccgcctcggcggcagcgaaccagcggcgccgccggaggggccctgcctcgcggaggtggaggaggaggaggagaaggagggggaaggggggtgaggaggcggcggcggcggctctccttgggatcctcgctgagaagcttctagaagctgccggggggggggggcgctgagcgagcgcgaggggcagggcgatctagcgagcgcggaggagagggcttctagatgcaggcgccctccgtgatttgaatggagggtagatctcgagagggagggaagcttctagaagcggggtgaggcaaggcgaggcgaggcgaggcggcggttagggcttggtttggtggccgggggagggatggcggggtgctcggaggggggaggaggagacg

SEQ ID NO: 20298 - DNA, 1501 bp, Oryza sativa
actgctaacttaccctgcattgttattttcagccgatgggatggtaggaggtgcagcagaggcaaaactgatgccatgtgcagcaaatgctgtcaaagagcatgaaaaatgtaaggtttagaagaaacagaaatgaatcatgcgtgatgggtttatcatttttaaaaacatctttgttactagtacttagtgagaagtatttagtatttacaaaagcatgtacctcctctgctggcttctaggcctgtatctttcttgttctgctttccaagcctatatttctgtggatcaataaaaagatgtcgccaagaagcacatattagcatcgtaggtggtagatcaaaagaagcaaataaagcaaaagaaaaaccagtaaaaaaaagatgatcagacctgaagatggctcttgaggtggtacaaggtgagacctttcatgcccatcagtctcaacaccgacttgggggttgcctctgtccaaacacagtcaaatggaaaacgaaattataaccccaaagcataaagttgctgtcacaaagcagtacaggactatgcagatgtaactatgcatggccccaaaatggtatgagatgaggatgatgagtgatgatcagcatgatcatatatacggatcactgtggcatctctcatgatggttcatggacatgcttctttttcgctgttagacaattaaaggctccaattaaacaagcaagcaaacaagaacaggatttaatttccttcactgttccattcatcacagctaataaattctgctggcctacagctccagcagctcgattgtgtttggagtttggacgcatgtagcacagagaaagatcgaagcatgggcatggtgacatatactgacatggtgcaaggtgttcggagatggagtcatggagttggtacttactgtcaggcccgccgagcttggtgacggcctcgacgaagcgctcgtgcaggtcgggcgtccaccgcagccgcggcttggggtcccgcgacagcaccaccccggctcccaccgcccccgcgccgccgacgccgacgccgtagcccgccctctccatcccctcgaacatgatggccaatccgtcgacgagccgagacgatctgacaatctcctcgtccggccggctgatcgatgtgtgcgctcgtcgagcggcagtcaacccggccgcggtcacgatcacgatcgatcgctagctgtgcgcacgcgcgtgcggccggcgcgcggctgggagtttgtagctgggagcgtgaatctggtgcggcgtgagttagcgtgggattgcggcgaagcccgaggcggattcccgatgggaatgtgccggtctcgctagctatatggccggcgtctgatggagacacacacacagagacgagacgacgacagcggctgtggcgatatgtaggcaggtggtgcgagaaactagagagagagagagaggcgcctgggcgggagagtggcgcgcgaggcggagccaaaagaagaggaggagag

SEQ ID NO: 20299 - DNA, 395 bp, Oryza sativa
acgggcgggcccgcccgccacctcgctgacgggtggggcccacctgtcatccctgtcctcccgccgctcccgccgcctcgcccgtgccctagcgccgccgccgccgcggattccgccgcatcccgccgcccccgcgcgcaataaagagggggaaatcactccccgtgattccctccctctttccccccccacttttccctctctctctctctctcggattcgtttggaaatcctcccgcaaacttcgccggcgtcattgatggagccgagatagccgcgccggtttccttcccctccggccgccctctctcactcccaacactatataaacgctccccgtgcctccctcctccgtttccgccgctcgccgctctctctccccgtcggaatcgagc

SEQ ID NO: 20300 - DNA, 437 bp, Oryza sativa
aaggtcataacaaaggtggataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaacggcttttactctaataaactccctataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaaatcggatttattg

SEQ ID NO: 20301 - DNA, 328 bp, Oryza sativa
cactcctcgggtcctgggttcgactaccgtggagcgaatttcagactggggttaaaaaaattctctcgcctattccatgccaaagcacaggtctaaggcgtcgttggtcattctcacatgggctacagtaccgttgtataagggtgcaagggtaagggtttagggattttcactactagaaataatattttttcaggtggcccaaaaccattttcgtaggcgggggagaggaccgccgctaccatctcgcctgtgaaaatagactattttcgcaggcggacccatggcccgcctgcgaaaatcatctcagaaaaataaaaaaaaaaca

SEQ ID NO: 20302 - DNA, 497 bp, Oryza sativa
gacacggccaacgtcagcgccaatgtgtttggcgctgaggcgacggcctatttttggttgaagtttttggcaggggttagtttcgaaataagttttccaaaagggtcaatttgtcaataaaacggccatatatgtataggattcttttgtatccttagattcattgtatactcctctaattgaggatcttgtatattggaaaggctataatataggggcttttaactatttgccacttttagatttggcaaataactatttgccacccctatctcaatgacatgtgggtccacatgtgtctatgacatgtgggttcagtggcaaaaagttatttgccacatctaaatgtggtaaatggttaaatatctctataatatatggtcacccccctcattggggagtgtggtgttccctcctattctctctacatggtatcaattccaagttctcctccttccttccgcatctctgaactttcctttgtgtgctacaccagt

SEQ ID NO: 20303 - DNA, 1209 bp, Oryza sativa
cttttaagctagcctctatgcagctgaccatcactagtttaaaattatcatcatgtgatcgaatacctatatatgtattaaggctagttacaattaattattacgaacaagcatgcaataaacaactccctccatgacaaaccaaacactagagacaacacattgtattatggtaaatgctgaccttgattgtgctatttgcaactgagaaattgtagaagagaacagttatttttccgtgtcctttctgtgttgcatgccattggattcatatggagttcatgtcatcagaacaccctcgcactcacttgatcactgataaacctttagtctgaagattcccagacgatgaacagtgatctgacgaaactgaaaatctgaagaaagaacagagagcgagctagagcaagtttgttcgttccttaatgccttgcagtttttcaggtttacttctccttttcacctcccatccaggtgtttgacatatatagatcttgaatgaacggaacactggatcgagtgatcctgccatcccacaatatttcttccagcctggccactacttataactgagaaaaactgaaatactccctccgtttcaaaatatttgacaccgttgactttttagtatgtgtttgaccattcgtcttattcaaaaaatttaaataattatttattcttttcatatcatttgattcattgttaaatatactttcatgtatacatatagttttatatatttcataattttttttaataagacgaacggtcaaacatatgctaaaaagttaacggtgtcaaacattttgaaacggagggagtaatagctagtgaggctgaccgaatcctagactaactcagttagcctttttcgatcaccaacacctaatgggatgaacgaggccaaactcagctggaagcaacccaagccgagcagagcaagcattgtagagcgtattcacatcactaaatccataaaaaaaaacataaaatcacaatcactaagacatggtgaagagattcaccatccaacaatattcaggaatcaaaatcgaccaaaaaatttactaaatcacaatcactaaaaaaatcacggttcatgccatgttgtcctcttcgattccatccccaccggatcccgcacctgcacaaacaacaagaagagaagggtaagaagaaaggaaagtgaagaattgggcaaatccaaaa

SEQ ID NO: 20304 - DNA, 1501 bp, Oryza sativa
tagcatggtctaccaggaaacaaggcatatacactttcctgctcagttctcattttattttcatctaaaattccgatccctgcctagattcctactagctaatcgttacattcccaaatataagcattctagaattcatattttgtatgcaatataagcatttctcaaacctttattcctgctaaacaatctagaaatgcttatatttggaaacggactcctcactgttcagaaatgctgccaatgaatatatgctactagttttgattcacatatagatgctataatattactctgcagtaaagtcatacatagtgtttcatactcctacctttgttgggctagatgttaggcagagcgtgatatggtattgaaatgtgccttcgctgtgcaaatccttcctgcttgacatgtcattgacctttaatctagcttaaatacatacatgtgtatcctaacatcacgtcacattctttgcaattagatatggaggactacaggtgatgagatgacagttggacacactacaaggtagtttgtgatttattattttccttctttattattgttacttttcgctgtgtttagttccaaaatatttcttcaaacttccaacttttccatcacatcaaaactttcctacacacataaacttccaacttttccgtcacatcgttccaatttcaaccaaacttccaattttagcgtgaactaaacacagcatttgtataataaagactgccgatccatctgtaataacttgctgatttccatgtacatcttgattcaggttctgctcttttctattgagctaaccaaacaatctattatatagacatgatatattcgtatgccaagtctttgatttatttatattatattttccccttgttttcgtgtcgtagaaggattatagatggcaacggggaattcactgccgggatgaactagacttggctcaagactgctgcaacacgaaatcaaggagtacctgtctgtcaatcttctaggcctctagggcgacaatagtaggcatacaaagttatccattaattttgacaatttgaccctttgcaaaaactaattttacaaatgaaccatcatcaaaacttatttcaaaaataacctttttgttcagcgccaaatcctgtgacgctgaatttagacacctcagcgccaaatagctcggtgctgagtgtgcgttggcacactgactcagccttccatggtggcacggtattcagcgccaggtgatgtggcgctgaggtgtctaagttcagcactacacgacttggcgctgagaaaaagggtcacttttgaaataagtttggcggcggttcatttgtaaaattagtttttgtaaagggtcaaattgtcaaaattaatgaaagttatcaaccaaactaccatggttccagtttcgcacaccaagttttgtgatcacctggaattaagcagacctgaatgcttttgattaatcaagtccacctgtaccacaaac

SEQ ID NO: 20305 - DNA, 864 bp, Oryza sativa
cttgcacgcttgctgcgagattttataactcttttattacgaaattgctactatatgaaattgctgattgattatagtgttgctgccatgttgcttctgcgaacaacggagagtggacgaacttcacactttagaaatcagtaattgttattaggaaaaaaagaggagttggcaaagttgtagctgataacaaaacaaagtatcaaatagtataagcattagggatgggattaggccttgtattcttttggggcttatttttttatctgtttccctgtaatttgttgctaattaggcatagataaataatactaattgtggatttgggggtcctattttttttggggggcctgaacatatgcacaggttgcacctgtcaatatacggcactgcgtactgtgataaaagatgctagcatcagaaaataagatactccaatggtttgaattattcattttcttaatgttcaaaccactgtgttgcacaaaagccactgcattgcactaattttgaaaataaactaatcatagttcacttgcgcattagaaatttaatttatgcacatgttttctctatgtctgaaaataaactaatcatagttcacttccgcattagaaatttaatttatgcacatgttttctctgtctgaaaataaactaatcatagttcacttccgcattagaaatttattatgtaaaatctgaaagttgcatatgtctgaagtaaatatatatacatttttatttttgtgagatatgtttagtacttgctctgtatgtgttactgacaaagagagtattgaagtacaatatgatagtttgtttacctttttttaatttaataatctttttacctgtttgcagg

SEQ ID NO: 20306 - DNA, 937 bp, Oryza sativa
ttcgggcgcaccgagcggctgccgcgtggggcccggccgtcagccgcccgcgccctcgggtgcggctgacgcgtggggcccacggcaccggccggtgtgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaataaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtgggcactctactcatggtactactagtatgattttagttagatgcttcgccgcttaattaggcaacattaggtggttttacaactctagactttgggatattcatatcacctggacactatagaattgtcggattattgtggaattggattcacacctccccctctcttcaaaatcctcaaaatggttttaggctgggctcggggtgcatggttttgatagtagcacctcggccatataaggaccggt

SEQ ID NO: 20307 - DNA, 1501 bp, Oryza sativa
ctactctcttcagtccaagatgttcctttcccttttcttttcttaagagggacccccccccccccccccccaagacggtcctggacactcagagaagaataaagctgggccgtagccagcccgtaggccatgcacagaaacacacacttgtggtccttgcgatgggctggtttgtttcttaagatgggctctcgctgcgacccatctctgaactactccatgatgacacgcctcgtcactgggactcgagtactctcgtcctttgcttcctgcacgctttcgcctttgccgtcttttaaagtagcagtactagtactacacatatttggagcataagcacgcaccacatgacatgcacctgtgtggctatgtgtgtgtgtgtgtgtgaatggaccggatcgattcccttccctctctggtgttattatgatcccaaaaatttgggggggggggggcgctgtccacgatgttgctttgagaaacttgagtggtgtggtgtgggtgtgctttgtctttgctttgttccttgcttgagagttcaggcaaaagatgtcctgggttttaggacattgtgatggttttgttggtgcttttcggtgatgtgtgagcccttctgctaggcgtctacgcgactaatctgggggtcggaagtgcgccctgtcctgcttttgttagccctaatcatcgggatggagatggaatcgatcggtgatcattaaccctgctgtggatatgattggcgctttacttgagagaccgagctgtcgcgtaggatttgattgctgaggcgtgtgcgttagtggtgaatgttgatgccccgaacgaaactcccgcagttttatatactggaaaggcaatggcatgttaaaagttatatgcagccactctgttgccaattgcaagaaattatatttactgaatatgcaaggcaaaaatgttacctcagatatataatatcatctgttgtatgatgatgtcaacttggcattcgttcaaaaaaaaaaaaggatgatgttaacttgactaatggatatttaataaatatttttacaatggaaaatcaattgatcccttattcaggaggataattaattaatctgcacaaatttaatgtggtttcagttgaaggacatggtgctcaagttctccggcagcggcaggcaccaatacaagtccggcgggagcccgtcgttgaggaccagccgcttccaccgctccagccgcctcgccgcgtacccgggcatcatcgacgagtcgggcttcacgtcggacggggccggcgaggcctatacttacatgaggacgacgacggcgagcgccggcgcccgggccgcgccgtcgacgtgggacttgccgcccaaggtgaaccaccgcagcttccagccgcgcgtgatcaggagcccgagcgcgagcggggtaccgagcatcggggaggaagactacgacgacgacgacgacgacgatgacgaggagacagtcctcctggaggaggaccgcgtgc

SEQ ID NO: 20308 - DNA, 1501 bp, Oryza sativa
ccgaccagattccatcaccccattgccccttattttgatttaacatccaagaacacattttaacattcatgtatcaacatccaacaacacagtgaatacagagaaagaggagggatggagcttctccggcgacgagcgtggtgccggatgcagtccttgagctcgagcccattggatatggttatatatggtgccagcgccagcaccgttgatgctcgcggatggggaggacaccgccgaatctcacgagtggggagggcgctactactgcagctcgcgggtgggaagggagagagcggcagcgcggaaagggctcagcggcgcaaggaaggaggcagcggcaacaaagcagggaaaggggcatcgatggttcttgacggtagagccgcaggacacggggcagcgaggtggggatccggcgccagcgggccttgtgagctgcacgggaaagggggtgacaaggagcggatccggtgctgacgagcctcgggaaagtggatctacccccgcgggcctcgggagcgacgcggcgaagggggcggcagcggcgcggggatcagatccagcaccggccatccacgcctccttcgggagcacgaatccatcctgacctcgtgctctatgatgtgatgtgaaagttttgtgatcaatctatgatgtggaatttgtatactgtgatgtgaattagtggaatatttgtgctccatgctctatgatcataatcaaaccatttttgtggaacttgtgctcgttgatgtgaatttgggatttggggatatggatttgggaatgctgggcaacattatgtaggcattttcatttttgctcgcagctagagggcagctgcatggggtattttcaatatttttttgccgtgaaatcgattatccctgacggccagcttaacacagccatatgaaaaatgaattatcactggtggctcgcgtgacacaaccgccagtgaaaatcaattgtcactagcggttgaagtctcgcttgtgaagaccttagattttcattgaccgttagttgcagacggttagtctaactactagaaaggactgattttagtcaccacgaaaaacctttcttcgtagcagtgactagctagattgaaccaggaccagctggttactttgtgtatctaacatgtgcaaaaaagctgtttgacaaagctaaatagtttggcgatcatgcccaagcttgaagtaaagcccattcaacagtaggatgttattgccattatgaattttgcgtcatattggtgtcaactccgaaagacgtattgtaaatcacattttgtcactttaagtttatgccacatatattgggtttgctttgctatttccatcatcagctcccacacgctcactactcttaaatatatatctggcattacacaacaacctttggaatggcatgtttcttgaaaaatacaaaattgtccctgtcttaaatgttggtctctctgttttttaaaaatgatttttgcatagaaatt

SEQ ID NO: 20309 - DNA, 1501 bp, Oryza sativa
tttaggggtagagtagtagatgtacactgaaattaaattaaacaacaacacacagagtagattctaagtctatcgtagttatagctggatagaaacactgggattgttgttttttaaaaaaatagttacattggatgggcaagggaagaggaaaatggaaaaaatatgatatgtgaaggataagggtaacattgatattgtaagtaaaattggttacgatatggttttacataacatcaacaatcagattcccataaaaatatgttagagacaatagataaaaagccacatgttgtttcggaagaaaaaaaagataaaaagcgacatgtatttttttatgtagggaaagatgtctgtcaactatcatggatcctaatacctagtgtgccttatgagttatggtggtcattacactctaaaaatctaaggataaatggggatcaagaaggtgcaatcgcgaacgatgatgtactcaagtagctacaccactttcgcactgcaaactcaacttgagcgttatggttgtagaatgaacacaaagttgtcccgcttaatggaatttagaatgctgatagattggtcatcgttggagctctaatccagaagctgcaataattcttagttatgcaaattggcgatggaaaaataacattattttgccatgatatatggttaactgcatctttattggcggaacactaccttgcactatacttgcatgcaacatctaaacacatcatagcaggtacgtccatgagacaatgactttgctcatctataatctccatgttatcatctatggcaattgactaatagtcgtaggctcttagctctaactagaaattgtagatgtgcgcatgagtcgtaacaaaggatgatgatgagacacaatgtgccacatgatgctcccatccctctaaatttatttactacaaatgtagggtgacaatagaggagtgacctaactagttagcgatttatatgggataataaggcggcgccaaaaataaccttcttgtatggttaatgtcaaaggagcatctccctatacaataaatctatctattccacaacaaaaatgacaaatacaaacaagttggatggtaaataagagtcttagcatgagataaatcttatctctactcaattcaggtttgtccaataaaatgaatttatctattcttaaaaaaaatgacaaatgcaaacaagtcagatggcacatagtcatttttcactgtaaaacattttccctgtaaaacaccggcccatgggacgatttaattggaatggcccatataaatggcccataagttgcagaataaattccattaggcccatatggcaaatactcagacgcttggtcgtcgagccagcctgctcccaacttttgggctgcttcctgcacattcctcacatgcgcaagccctaaagcccataaagcccagcgcaagccctaaagccagcaacggctaatttctcccctcctcatcgctgcgcacta

SEQ ID NO: 20310 - DNA, 1501 bp, Oryza sativa
aattcagtcgtgacgacagtgcagtgtactactcgagtatggacctagattgtagccattcttaactttattggcaagttaaaaattttataatgtgaaaattttagcaaagtttgtcgtttggtttgatattaagattttggccaagttaatttttgtctagtctcgccaaaatattttgtttttccatgcaataaaccaaacatttttatgattgttttaggtattgaaccaaacaccccctatatatatatccttctgatatacgacaaccattgctttttagagggtagtatcatgctgcagtagttaaaagccatctgaacatgagcggcagcgccgccacgaagtttctcgatggaaagataataccataacgaggagttctaatatctttgccatctagaaagttcgtaatcttatttctctcaaagggaatcactcaacgtgttgctagtctagtttcttgtcaaagacaaaagaaaattgcagtagtgtatactgtatagcggagaagtcttctcctcagacctccagcttgaggtaaaaaaatccgaatgcccaatacagcaagcatcaatacatgttaggaatgcttactctctcccaagtgataaaaaaactttgttccaattttcaaaataatattttacctaaactacttattcgatttatgatataattatgccgttgtattcgttataattactgctgcatacattctctgcatgttgccccctagcactacaattgtacagtgtgcaatattcccggaaatacttaccattggccgttcggctaggaataaaaaatcggacgtctcaatctaaaagaacaacagtgtaggtgcatggtgaaataattggttaggtgtactgacaagccaacggagcatgcatgcaaacatgtttcaaaatttaaatgattttttctcttaaactatttatccgaatttcaaactaattatatcattggattcgttacaattaaatctttataacaagatatcacatgactacattccgatgactttttattttactttttaaatgttgcacacattgttactgaaatgttccaacaagactttgttgatatttcactaatgcattagcaatatttcatgctatctttttttatatgtttcagcaaatacattttttatgtttcaacaataattataattcgatgtttcaatctaaatataaaaaaatgtttcactagtcgggacttaatatttcaagtaataatgattattgttgcagtcaatactttttatatgttgtacctctttggaataatttgtgaagtgggttgaaacatctccacaagtgatgaaagaattatttttaaatagttcaacataagtttgttttttctagagcacatatatatttttatcaaaatatattcatgtgagatcttgttataaattatagattggatatatattttagattaaaattttgtttaaagtttgattaagagagagagaaagtaa

SEQ ID NO: 20311 - DNA, 1501 bp, Oryza sativa
ctggtaaggtatggtatctgtttcattccattgccccccatctttctcgtgcttgcgcccctgcccccgccgctgtactttcgcgtgccctggattagctggttggttcatctgcttgttgcggcgcgcggcggatctgtgcctccagccgccggatctgggtggttcgcgggcgttcggtgcaatgcgagtctgcgcgtaagtttttttttgtgtgttgtggtgaacagtggtgataattattgcagggtttttttttttatcttgtgggggtcgtgtccctgttgggacctcggatctgttcttgtttcgtggctaatttggattttatggcagaaggaagacgttttgtcacaatagattgagaacgctctctttttccttcccatggatggtcataatctgtgccttttggtgcttagcgttgtaatttgtgattagggtagcaatgcagattgtttcacatcatgttccaacccaaggcaatgcttctgagttacgaaatgtttgtaatatttatgaccttgctgtcttgccatgcttgatcgatcattgttgttaaattggatacccgcattacttccaattttttgcacttcttaggtagttaggggtataggatgatcattccatgtcgacgccttattgcaactgattgaatagtagcatcggtgtcaatattttgtcaatgcagcagcaacactctaccttatcaggcaatgttacctatagtgcatttttttttattctaggaggaagtgtatttgattgctgccaagaaggcagtgcttcattttgcacacatcagttttggtacttgcatcatgtggcctgtacatcattgtttgcaaagaagagaaagctgaagcgctataaatccttcaagcagttttttcggtctaaacccagccatatctgagtatgttagaatgattattatgtgcaaggtttctgtcggttttgattgtgatcctcagacataccttgtgacgcagatattcatgctgagttgattccttctagtcactttgcatgtacctatagtttgaacatgtgcacggaagtaatgatctttgactgtgttatatgtttctgacttaaatctgttatattagattggaccagctgtgatttggggagcttaaagttttgatcagagacatggaaaaagtgatcttctgggcacatctccttaaatgcaagctttttctttcaaaagaaactcttgattggtgtgttttagctcgtgggaacacccaccacttctctctggtgaactacacatagtggttttatgctcctttatgctcaagaacatttggctgattcaatctttttcctgaagccatatttcaagtctgccaaacatctacatgtaatgcacctacttcatagcttgttcttccttcattttgtgtcatatggactaatttagctaaccaccatctttttattctactagcacgtcatctctaaagaagcttcctttaagttgtagatg

SEQ ID NO: 20312 - DNA, 1501 bp, Oryza sativa
ctagcctctcgagtagtccagaaccgcgcaaatcctccttccctgctcagtcacaaacaaagtccatcgaagagccaagggaggagattgtcactcgttttccgcgcttttcaaactactaaacggtgcgttttttgtaaaaaaattttctatagaaaagttgctttaaaaaatcatattaatccatttttaaagtttaaaatagttaatatttaattaatcatgaactaatgactcacctcgttttgtgtatcttcccaatcttcccaatcctctctctctcaaacacaccctaagataagaatctggtcctggtgtatcaaaagaggaactgagccgtcacgcactcacacggctaaaatccaacatgtactagcaacgtagcagtgccattgatccagtgtgtgcaaggagtaaatacacggaacatttctagtagcagcaggtacatcagattacactgcagccactgccatggctgcagtgccagccggccggccggccggcatcaactccgagctgagtagccatagccagtgagtaaacgccgctctagctaatgcatgccatgccatggcctgcgccgcaggcttttgccttccttaaaatcgatacaccgacagcaacccctcgccagccgagtacgctgccaccatggggcgcacacgcccgcgcgtgtgtatatccatgcccttgggccttggcgcggccggcctgggcccgaacgcatgtttgcacgcgccggctcactgcagaccactgccatgtttgagctctggcttagctaggggtaggcgaggcatcgagcaagaaacggagtcaatgccccccaagctttggctgctttatggagtagtacgtagtatgagaggtacagggaggtagctgcggcaaagtatagcccgggtggtggattgattgattgatgcatgcacggattgatattactgcttaatgctgctgcaccggtgggctcagtgtgcaggcgtgcagctagtacgtcgtcgtaggtagagcattcattcactcaacaagcataggcttaattatgcttgctactgcagcaacaggcaacaggcaaccaaggcatgcatgccgataatacacgagggagcagagaaggttctgagaaaaactgtactagcaggagctcttttatctactcctacgtgaggacactgccactccgaatccaagtgcatcgtccagttccaagcgaaaggttggaagcttggagagcggccgatcgagctgagcaggaggcagatagatagacggatgatgcacatattgcacatttgcatggatagagagaagcccttttaggaccagggccctcatggaaattttatcagtggttgggagtggattggaggacccactgaaggaaatggaaaggcaaacagaagccttcttgcagtgtaacatcccaactaaaaaacagtcctacttgcacctacaaaattcgcgtgtattgtactattgtaatactaccgttttt

SEQ ID NO: 20313 - DNA, 801 bp, Oryza sativa
ctgaagcctggattatgaaagggataaattacagctgagcatgtgtgcaacactaaacgtgtccatctctaggtacacgtggctggtgccaacccacatcaacaattaatgtgcatgtgtgtatcattttttttcactccacaggttattgattcattaaacaattgccatatttgtttatgagaggttgttaacaaatgctggtgaacaaatattttggatcagcacaaacaaactaatttgttatgcacgcacgcataaatcggccagcaaaacatactttccctcaaaaagtaattgccagcaaaattttactcccgccaaattgacagagttacctcgctatataaggctgcccatatagtacaatccattcgcatctagagttctcgatccctgcacacacttgcagtcaaaggtaaagaaacaaatatactatggctctttgctatcctcgcaatcctataggatccattcggcattccccaatttttattcactgcatagccctagagtacatccatctttgagagattacacccaccactgccaggacacaatcacacaaccatcatctccaaatcactgcagtcctattgatgatagcgtggcgtcgcagggatatgacctgccccttctggcgtccactctctccgtcttgtttttccgcatttatgatttgtgttaatttcctaattagatgcaacttaatatccatttttaattgggattctctttcttagttaatttggttctcaatctaatagtatatcggtgttttgtggggatttctatcttagt

SEQ ID NO: 20314 - DNA, 1501 bp, Oryza sativa
cgagaagaggatgcccgccagcggcgtgccgtaccgcgaccgcgccgcgaagaaggacgggagcatgccccgctccgccatgcccagcagctggtacgagtcgctgctcatctccgccacgaacatgcccatgttcgacagcgccgccgccgactgcacccaccacatcagccacgcgccgccgagcagcttcgcgatgtccgcgaagtagccgtctgtccactgccccctgtccagcggcacggctcccgtcccggcgaggagagggtacaggtaggcgaccaccacgaagatgaccgcgtagaacagcgccttgggcagcgtcttgccgggattcttcacctcgccggccaacgtgctgatcgaatcccagtagttgaggttccagaacagagtgttcaggtacagattccaatcgacgttgtggaggtcgatcacgagccacctcgccggccggagcttggggagcgcgatgagccccatgacgaaaaaagggaggagggagaagacgccaaggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgct

SEQ ID NO: 20315 - DNA, 1501 bp, Oryza sativa
agaggatgcccgccagcggcgtgccgtaccgcgaccgcgccgcgaagaaggacgggagcatgccccgctccgccatgcccagcagctggtacgagtcgctgctcatctccgccacgaacatgcccatgttcgacagcgccgccgccgactgcacccaccacatcagccacgcgccgccgagcagcttcgcgatgtccgcgaagtagccgtctgtccactgccccctgtccagcggcacggctcccgtcccggcgaggagagggtacaggtaggcgaccaccacgaagatgaccgcgtagaacagcgccttgggcagcgtcttgccgggattcttcacctcgccggccaacgtgctgatcgaatcccagtagttgaggttccagaacagagtgttcaggtacagattccaatcgacgttgtggaggtcgatcacgagccacctcgccggccggagcttggggagcgcgatgagccccatgacgaaaaaagggaggagggagaagacgccaaggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgct

SEQ ID NO: 20316 - DNA, 1501 bp, Oryza sativa
tcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttacaattgggccatagatgttagctaaggcccacgtctagcaaattgggccgaatcggcgaatctcgtcagccctgacagaccaagacatcgatgcttcagttccttcctggtccatggctgcaccgtacaggttaaaaagtcgtacgagatgggccgaatcaatgcggaaaacttaaaagatcttatcccaaacaggggtcagattgggattggtagcgatgcgacgagagaggggaaccgattagccgacgaagcgatcccggtgcacggctggctggcgaacatggccgcggctctcactcgcacacaagtagacgtaggagtatacacgagcagctaccggcggcaaaaccacgagaaataggattgagatggagacggggatcgagcgagctctcacctcttgcccggtgtcagcgtggccgagatccgccgccgccgctgccgtcgtagaagctgccgggtggcccggcgaccggaccgtggccagcgacacctccggccgtccgccggtgtccgccatggatcccccgatccctccttcctcctccccgtgccccggatgctggagctcaacctgattattattacgcctccggccgtgcggagtggaagcgcgcatccagcataaatagtggcagtacgtcgctttccagtttacaaattatcaccagcgtgagcataaagcgcgcagcacatttggactgaagttgaaccaaac

SEQ ID NO: 20317 - DNA, 1501 bp, Oryza sativa
gtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccgccgccgctcacccagccgcgcccgcagccacctccgctcgctcagccgcgcccgccgccaccgctcgccccgccgctgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatat

SEQ ID NO: 20318 - DNA, 266 bp, Oryza sativa
gcggccggtctggcgacggtttttttttttggcgatttggtgaagagaaggattgagaagcgctaatcgcagtgttaatcccaccaaacaactcgtgccttttatattagtctagatatacaccattttaagtgtttaagaattattcttttttgggaaaaaaaacaaggagttcaagtttaaatatgagtactgtctggtgccatttataattgaatagagggaatatttttctgtgatggcaaagtccaagcaaaccctaaaaa

SEQ ID NO: 20319 - DNA, 1501 bp, Oryza sativa
attggagagggagaggagtggtaaaggaagagaagaaatagaagggtcactgacatgtgggccccacatgctaacttaatttgttggactaggtcaacatgccacgtcagcaataacggctctcaaaattatcgagggagttaaattacactagttttaataggtaaagagtcaagacgtctgctattgtgttttaggaatacaaatcggattacctatacttgagggagtcaaagtgtactttactccctaacaaatagagtagccaggctttgggctagcttgggccaattagtgagcagcagcagtacatcgagcaaagcaattagcagcactgtagcaagcaataatacgccacctcaccaaactagctggagtagtagtttataaggatagatgcccattgactagcaataccgagtttaatttcaactttttgtatgtgcgaagtggacgaaagcacagtcaatagcttacatgcatacaacgaataacacattagatatgccaaacaatagagatacaacacatacatcgttctcacataaatccatcgatcgatctctcacacagtcacagtactcctctcacatctcacaactttcatttattctgcaccaacaagctgacctgggaaatcaaccatgcaagaaccaaaagaattaaccatgccatgaaatcaaacaaaaaagcaagtgtcgatattgatggaatggacgaattaattaattcagctgtgatatgccggccggagggctgggagacggcgccgcagctccgccaccgttcgccgcgccaccaccgttcgccggcgtcggcttcggcaacggcgtcggcttggggccttggggtctcttgtggaagtagtcgaagaaggggcacaggaacgccgagttgcactccgccgacgacgagtagcgcatcctcttgccggcgacggcgacgaaggtgttagccttatcaccgccgttgtccgttgttgacgacagcggcacgatcttggacggctcctgcccggggcacggcgtgctgctctccgcgctgtgcagctgcgcaaagcagtcggcggcgccgtggaggtcgtcggcggcgaggggcacgctgaaggcgccgtcgccgtcgaggtcgccgacggccttgctctcgtactcgccgtcgccgttcctgcacttgatcgccacctggagacctgaacatcaccaaacaattaatcgacgacggtgatatatcgatcgcaattaattatcgatgaacatattatcaatttatcatcatcattatgatatatatacccttgaaagcatcctgcgccttcatgttcttcctggagcagccaccgcacttggccaagccgacgacgaccgccgccgccgcctcgccgtccgccgcggcggtgacagccatcacgacggcggcgcagacgacgacggcgccgaggactagtgctcgtgctaccgctgccattgctgaatcgatcctagcaaactctaccgcttctact

SEQ ID NO: 20320 - DNA, 180 bp, Oryza sativa
cattccggcgtagggcttaataggattaatagaatattcatatcaacaagttgcaacttcttttccggcagccaatctccaaagaactccagggttaagcgtgcttggcctggagcaatttgggatgggtgaccgaccgggaattcttcccgggtgcacacgagtgaggacaaagtgtgc

SEQ ID NO: 20321 - DNA, 552 bp, Oryza sativa
tgaccatcatccgtgacgtgcaccaacttgaggcccgtttgagataacaactaggcccgtcacaaggcccgtcacagatgactcattagtgacgggctatatacttaatctctatcgggcattaactaaagcccgtcaccgatgactatttttctatttttcatatgaaatgtttatatttgtaagttgactatagcaaaataattaagtgtagtataataattcattttatgagtcaaaataattttacgggtagtaaatgatttcaaatggaaaaaatttcaacaacaaagttatataacttatcaagatttacaacttttagtttggtcatttttcaatataatattttttttgaacagtttgaatttgaatttaaaaatatgacaacttcaaacaacattttcaaatactaaatgatttcaattgaaaaagtcatcaacaacaaagttgaataactcatcaatacctaaaacttttatttttgttatttcttcatccgacaaaatgttagtaatattattcacaaattttacatatatgtgttatagt

SEQ ID NO: 20322 - DNA, 1501 bp, Oryza sativa
cagttcgaagttggaatataggttgatcagttcgaagttggaaacctggaacctgtgtggttgtgttcaatcatggacttttggtaaattatttatccaaatgatgtgtaacaactgtctctacagaaccacgcagtctaggccatccgatggatggacgacccacttacacataccacctcacttacggttccgttattgtttcgtgtaaaggggtaaacccgagagtgatatggctagagcgacaaacccttataagttggttttacccttactaaactagtaatgtggtagtaatgtggtagtaaacatacacatagctctcatggataacatagggtatatcctaattggccctgtatgtcacatacttctcccctcagaggacccgatgtccccatcaatccaacctacctatgtgaatttaggtgcagttttttaaataattatatacaagttatatgaaagttataatgtagttatagtattgttacggtgtaattgtatgtaaccacaatgtaactatatcctaactattgtataattgtaatgtagttacactatacctggtaaaaaaaatgtagttacactataactatgaatctctatataattaacttgtatgtgaatttacatgtttttttaatacttatagacaagttatatgaaagttataatatagttatagtattgttatggtgtaactgtgtttcaattatatgttatagatacatttgaaactttttcacttaaaaaacttgtgtcccttctttcaacaaccacttagatacggctggtttttgccataattcttttatttattagtataattttgatctcataatttacaagatcattattatactaataaatagaaacatatggttaaaggcgtatctcttaaagagatattaaatatctataacataattttttttgtttgtagaaaacaaactagcctaacatcacatctatatgtacagacaaaacctggtaatatatataataatggtccaaaagccaaatgaaaacaaacagattaagaacaattcaatcatgcagtactttggctgtgcaggcagcaagctattactatttccctttttcataaaaacaaactagtactacagtactagctttgcattcacctaactagagacaggcgagtacttaattaaagctttacctttgcttgctaaacaccaccaatgggaagcattacgtacacagtgcccgtgtgcatgcatgctactcttcttaatcgatcgatgcagctaagctggttcctgatcaaaatcatcaaataatgtacggcgttaattaattcattttaaaccagcaaattcggcgccaaatgctaattgtgtactagtatccagcttctgctcgatcgatcttcgtctgcatgatcatatataaacgcatggttgatctgcttcttgctcatccactgatcagcaacgagtagaagcggtagagtttgctaggatcgattcagcaa

SEQ ID NO: 20323 - DNA, 608 bp, Oryza sativa
tcaagaacccatttttgtgctttgtttctgcttgttatagggagtttattagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatccacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggacacacacctccccctctattcaaaacccccaaaatggttttaggctgggctcgaggtgcgtggttgggttttgctagtcgtacctcgggtactataaggattaa

SEQ ID NO: 20324 - DNA, 701 bp, Oryza sativa
gttgggattaacagaggccggccggaggggaagcaacccggcgcggctatttcggctccatcaatgacgccggcgaaagtttgcgggaggatttccagacgaatccgaaaaagagagagagagggaaaagtggggggggaaagattgagggaatcacggggagtgatttccccctctttattgcgcgcgggggcggcgggatgcggcggaatccgcggcggcggcggcgctagggcacgggcgaggcggcgggagcggcgggaggacagggatgacaggtgggccccacccgtcagcgagggtggcgggcgggcccgcccgtcagcggcacgcgcgcggggaggaggccgattgggccgcgggggagaggagagagagggagggaggtgggccgagccggcccaagaggggaagggggggaaaaagactttttagggtttttctttttataaactcattttaactttgtttatttcttaataattattatttgtgctctgaaaattccactaaaatttgagggctcctttttgaccaaggagaatttaacaaaaattctccgggccacatttgaatttttcttgcacgtattttaatgtttgccaatttcttttcgaattttaattaattctattattccttttagcgaatgatttttaattcgggatgaatttatcaggacgtgacatcagggaagagaa

SEQ ID NO: 20325 - DNA, 1501 bp, Oryza sativa
gcgccttgggcagcgtcttgccgggattcttcacctcgccggccaacgtgctgatcgaatcccagtagttgaggttccagaacagagtgttcaggtacagattccaatcgacgttgtggaggtcgatcacgagccacctcgccggccggagcttggggagcgcgatgagccccatgacgaaaaaagggaggagggagaagacgccaaggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttac

SEQ ID NO: 20326 - DNA, 986 bp, Oryza sativa
cgtgtacgagaattaaacgtgaaagaacgaacaaacgtgaacgaacgagcgtgaacgaacgtcaacgaacgtgaacgtgaacgaacgtgaactaatgaacgtgaacgtgaacgaacgtgaacgtgaaatgcaatataggcaggtgaatgaacgtgaacgaacgaacgtaggtgaatgaaacatgaccttaacgagaacacgaacgtgaacgaccgtgaacaaaacgtgaacgtcaaatgcaatatattttacttcgcgtttatcctaatacatctttttgtatcttgcagaaaagacgttgtcggagtcgtccctcaagccggagtggtagctagccctcgaaggaattcgcgcaggcaagtgacataattatatatatgattgttatatttgtaatgcaattaagactattagatttaatatacgacacttagacttagcatatatcactatttgagtttcagtataagattattagatttgtaattagactttgcatataagattgtgtagggttctaatatacgacagttacacttagcatacatgactatttgagttttagtataagattatttgagttttaatataagattattatatttgtaattagacttagtatataattattgactagctagggtcctataatatatgtctcctagacttagcatttatcactatttgagttttagtataagattatttgagttttaatataagattattatatttgtaattatacttagtatataattattgactagctagggtcctataatatacgtcacctaaacttagcatttatcactatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacaga

SEQ ID NO: 20327 - DNA, 1501 bp, Oryza sativa
ggcagatcgccacccatccgacgacggtgagcccccggtaattcagcaatgtcagcacggccgtcaggccgacgacggcgaacgccctcggcgcgcctccgccgagcgccgggacgccggacttgaggtagtccaagaagaggacggggtagagcgcgttgtcgatgacgccgctcaaccacttcatccacccttgctggaacccccagtacgggccgagcgccgacgccacccacacgacgtacccgccgttctccgggaacatggcgcccagctccgccgtgatcagcgcctccgggatgctccagatgacggggaggaccaagaagccgatgatggcgagcagcggcccggccgcgcccacgctgtcctcgatcccgaacggcccgccggacacctcgtagaagatgaggaagatgagcgggatcatcgaaaccgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttacaattgggccatagatgttagctaaggcccacgtctagcaaattgggccgaatcggcgaatctcgtcagccctgacagaccaagacatcgatgcttcagttccttcctggtccatggctgcaccgtacaggttaaaaagtcgtacgagatgggccgaatcaatgcggaaaacttaaaagatcttatcccaaacaggggtcagattggg

SEQ ID NO: 20328 - DNA, 1501 bp, Oryza sativa
gttttggtggatctgtgtatgaatgggctacaagtgtgagctgacttctcccccgttctaagctcacaatctggaaaagaatcaagaaaaaaccccttctctatgggcaaggtcctccttttatacttcaaggggataccacacgcacccttctctttccaaactggactgttctttttctcttgaacgggcggagatcagcacggttgctgtccgaatgacgctccgatgggacagcccacgcctacctccacttccgccgggggtgagcgcgtcgtgggagcatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcctaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatatgtcgcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgacaggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgcca

SEQ ID NO: 20329 - DNA, 1501 bp, Oryza sativa
cgtgcgtgccgacgacggcattggcccgccggcgtcgccgtcggggaggcccctgtactccgtgccgcactcgcccatcggagcggcaccgttcgccggttgggcgctctcgacggtgggcttctgcatgtcggagaagagaagaataattggttatctatacgaaagcattagcagaagagatgtattgttgagttgtagtaggcaactactcgagttcaacaaggagacccgcctgcaaaaaacacaagaaaaacacaatgacaagaacaaaccatgtgcatgtagccacatagtatgtttagacaaaaattcttgacgaaaccaggcgttttgtcagtacgaacgaagatgtaataccgaatcaaacaccaaccattggcccaccgtgtaatcttgattgtgaagaagggcaagaactcaccaccagaagaagctgcttaatccttcaatattctaatttggtagtctcaccggagggttcccatctcaagatcgtgatggacccgaaagaacagctagaacctgaagagggattggctcctttgctccgctctctttagcatctttcagaaataaggtacttgctgcatcttcgacgaagacatcctgcattcctactacgtatcatcaagctatcaaccaagcccgcaagtggatttgtttggtgaagcagcggcggctcacagagagctgagagaggtggtgccatgcggcgttcggccggtgacacctgttgcggcagagacggccacgcagtccgctccggctacacttgtaaactgcagggctaggtggctgcttctctcccgcctctccgctgcttcacggcccaaaagccttctagcacaaacttacaattgggccatagatgttagctaaggcccacgtctagcaaattgggccgaatcggcgaatctcgtcagccctgacagaccaagacatcgatgcttcagttccttcctggtccatggctgcaccgtacaggttaaaaagtcgtacgagatgggccgaatcaatgcggaaaacttaaaagatcttatcccaaacaggggtcagattgggattggtagcgatgcgacgagagaggggaaccgattagccgacgaagcgatcccggtgcacggctggctggcgaacatggccgcggctctcactcgcacacaagtagacgtaggagtatacacgagcagctaccggcggcaaaaccacgagaaataggattgagatggagacggggatcgagcgagctctcacctcttgcccggtgtcagcgtggccgagatccgccgccgccgctgccgtcgtagaagctgccgggtggcccggcgaccggaccgtggccagcgacacctccggccgtccgccggtgtccgccatggatcccccgatccctccttcctcctccccgtgccccggatgctggagctcaacctgattattattacgcctccggccgtgcggagtggaagcgcgcatccagcataaatagtggcagtac

SEQ ID NO: 20330 - DNA, 976 bp, Oryza sativa
aagatcccgtcggtcttgcgacatcatatatgaaactcaagatactataaaaagatatctagtaggttcagcattgttttggtttggtagaatcgcaatatcatagtcgtagcattttatgataatactacgatctggattaggatatttaatcattgtatactcacatggcaaaccctttcggttttctctcaattatattgctggatagctgtaacacttccccgaatggtaagagatcgaacccatccaattcaactggcatgatcaacaccgcggtgaattatcaaccagcgtggccagtgttgaactacaacgactcctactattattactgcatcagtttgaggaataaaaccgttataaatgtttactatccggcaggctagctacccagtgtccagaggagctcggctaacaggctaactgctcatatacatcaggtgtgtttaggcccacgccaaaattgaacattcgattgaaattgaaacgatgagacggaaaagttagaagtttatgtatgtagaaaagttttaatgtgatgaaaaaattaaaagtttgaagaaaaattttaaaactaaacttggccttgatcgaatttcttcgggcagctacagcaatgcctagtggtggcaactcttgtctttgacccccacagagcttggtcaagaaaggtgacagctagctaagggagatcaaaagggcaaaaaggagaagcgaagtgacaaggctaactaacccaaagggacatgagttacgcgcatgattgaaaaccagctagactggcaggctggcaagtgtatgttgccatgttgggttgcaaccccaatgtggcaaaaaaccagataacaagcatttatttcaagcctattacctagtagtaagcattatgggaagaggtagtagttactacctggtatttgtgctattgccggcaacaaccaaataaaatataagatggatggattttttcagg

SEQ ID NO: 20331 - DNA, 769 bp, Oryza sativa
tattttaggaccctaaacagttttaattcaaaaacttatcaactacaaagttgtaggtcgtgtcgagggctaccattttgatataaaatttgtcttcattagagttcacatgaaaaagttatgaattactttttaatataaagtttttaaaccgtcctgtttagggaccggggtgatacaactgaacaagttggaggacctaaacgagtgatctgcaagtttggggaccgggatgacacagtcgaacaagtttaaggatctgaacggtcgatttgcgagtttagggaccgggatgacacagcaatataagtttagggagcggtgatgaactttactcttaaaaatatgtcgtaggtgtagtgaaataataagaaaaagcacacgaaaacactcccggccaattgcagtgaggtcacgaagccatacattccaagctgggaaaagtcgagcaacttctggaagttcttcttcttccattgcatggaactggaaacgctgcccatacgcttcttttccttatcgcgttggccatatcatacacacgcctcactcacaaactccattataaataggcctccctcccccacgtatcgatcatgccctcagcaagatcaagtgcacgttcgatctcgacgtcgccacgcgaaatcccactggacggacagcgttcttgaatataatcttgatcgatgcggccgccggcaatggcggcgctcttcgaggccgcggagacggcggccatcgtggctgcgctgacgcgcgtcattgc

SEQ ID NO: 20332 - DNA, 411 bp, Oryza sativa
catctccccctccctcccggcgtcctctctctctctctctctccccccctcccccctccgctccgcccgcgcgccgcgcgcgcgtgcgcgtgagccgcgcccagcgcccctccctccgctctgcccgcgcgcgtgcgcgtgagccgcccgcgccgagccgagtcctccctctccgctccctcgctgccgcttcccgcgcgccgtgttcgcgtgcacgtgcccgcgcggtcgccgcccttgccgcgcctgcgctgtctgtgccgcctggccccgctgccctgccgcgcagtcgcccggctccgttagccagcgcgcgtgcccgagccgcgccgctcaaaccgccgcgccgcccgttgcttcccgcgcgcgcgtgccgtggtggccgaccgcctggtcaccgccgtcgtcagt

SEQ ID NO: 20333 - DNA, 1501 bp, Oryza sativa
tccaccactgcatattgacaatttagtcattgtctctatcaacatttttgttacagcctatgatatatggtagaggaccagcaccagctggaatgaggatggtaccaatggtgctccctgacggtcgtctgggatatgttctgtaagataatgctgtcctagagtcacaactcacaaacaagtcttaccatacatcttcatttcctaacagttctgtttgtaatgtcttgacaggcaacaaccaggtggaatccctcctccgcccccaccgcgtcggggtgaccggagggatggtggcagcagaggtggcgaagggagtcatggccggcgatatcgcccttactagctttttcgttcccttggtcctgccgccatccagccatcacgcaatgtgatggatttcttaacctaaagaaacaagatagaagcttgtaaccctgttccagcataacacctgcaattgcgcaagacatgtaccgtcttcttttttcagttatatttatctgtcatgcatgtggtgcttgtgacttgaaaacagtgtcttgaagctttgtatctcgcggtggcgtctgtagtggtaaaccgatggaattggaaaattatctgcagacatacagttggacctgtctacctctttacatttttttccccaatatgttaatcttgtgccagttttttcggtgggtgcgtgattttgtaacctcatcattgctggtctgtccaggactccaggtagagcattatgctcctgggtgtgcttggctgcttgccgagattgtcatgtggggattgcattgtgcacggcgccgtcgcagagttccgccgacacaaccgtgacgaggaatagtaatcggtttagtctgttcagtttaggagtttgttagtcatctttatctcttgagttgttaggattctatcccttagctcccttataaattgtaagctgctttcgttggaagtaatcaatcaaagttcagattaatctagtatcagttcctgccttgccggtgcggtgccgaacacggctcctccgcgccgacgaggtccaggaccacgttctgttacagcctttaaatacttcctccgtcgcaatcctccttccaatctcctcgtccgtgacaacttggtatcagatttctctggttccgttcccatggcttccactcaagcacagctcgacgaaatcgccaagaacctgacatccatggcggcccaaatctcagacttggccaggaagatgagcgtcctcgaacctttggttcccctggcgcccaagctcagcagtttgcctgaccgcgtcacacaagtccaggcgtccgcgttcgagtactccgagcaagtccgcgccctcaatctggccgtccagcgcgtcgaggccagccatcgctcgtcgcccgtgccagagacgtcggggtccgctacgcacgcgccgcgcggcgctccgccacccaccggcgacaatgacaagcagtcgggcgacgactccaccgtcgacaacagt

SEQ ID NO: 20334 - DNA, 210 bp, Oryza sativa
cgtgtaaaaaaatatagcccttataatttgggacagacggagtagtttctttaatgattttgtaacaccttaaattaaattgcattgtcatccattgtacattgattttggtagttcatatactgtccttttccatgaaatatgctttaagtaactctgaatacccatgctagaaatcctgcatccaccactgcatattgacaatttagt

SEQ ID NO: 20335 - DNA, 207 bp, Oryza sativa
atcgaccccggggggaggcaaaatagacttttgcgaagggatttgatttggaaggatttggattgggaattgaacttgacgatagatcggggattgagatcttgagatggcacggaccctagacaacaagggaagaaacaaatttcgcaattagggttttagagataattttcccgctaggcgccacgacggaacgggcgctacaga

SEQ ID NO: 20336 - DNA, 1501 bp, Oryza sativa
gcacggggtccgttgtgccgagttgaacccgctgctcatacgcccgggcgagcatgatcgtgtcgtccagtgaactcggccggcagagagctacatctgtcttgaggggattgacgaggcctgccgtgaacaattgcacctgctggttctcggatagtttggcgtcgcggcaagccaaggcgaggaagctattgatgtagtcgtccactgtgccggtgcgccaaagtgtcgtgagttcgccgagcgggctgtccgtcatgggtggcccaaagcgagtgtgcaccaacttgacgaagcgctgccacgatggttcgccggaattgggttacaatctgtagtaccataactgagcatcaccgagaagatgcaaagatgcataccagacgcgacgtgactccggtgtcttctggccacggaagaacgtctcacagcgattcagccagggaagcggatcgcctttgccgtcgtaagttggaaactccaacttggcacgaggaagaaaactgttgtcgacggtggagtcgtcgcccgactgcttgtcattgtcgccggtgggtggcggagcgccgcgcggcgcgtgcgtagcggaccccgacgtctctggcacgggcgacgagcgatggctggcctcgacgcgctggacggccagattgagggcgcggacttgctcggagtactcgaacgcggacgcctggacttgtgtgacgcggtcaggcaaactgctgagcttgggcgccaggggaaccaaaggttcgaggacgctcatcttcctggccaagtctgagatttgggccgccatggatgtcaggttcttggcgatttcgtcgagctgtgcttgagtggaagccatgggaacggaaccagagaaatctgataccaagttgtcacggacgaggagattggaaggaggattgcgacggaggaagtatttaaaggctgtaacagaacgtggtcctggacctcgtcggcgcggaggagccgtgttcggcaccgcaccggcaaggcaggaactgatactagattaatctgaactttgattgattacttccaacgaaagcagcttacaatttataagggagctaagggatagaatcctaacaactcaagagataaagatgactaacaaactcctaaactgaacagactaaaccgattactattcctcgtcacggttgtgtcggcggaactctgcgacggcgccgtgcacaatgcaatccccacatgacaatctcggcaagcagccaagcacacccaggagcataatgctctacctggagtcctggacagaccagcaatgatgaggttacaaaatcacgcacccaccgaaaaaactggcacaagattaacatattggggaaaaaaatgtaaagaggtagacaggtccaactgtatgtctgcagataattttccaattccatcggtttaccactacagacgccaccgcgagatacaaagcttcaagacactgttttcaagtcacaagcaccacatgcatgacaga

SEQ ID NO: 20337 - DNA, 355 bp, Oryza sativa
ttttcttcagaaagaaaatgtgcaggtttggttttctataatttttctagagaggaaacgttcaggttttggatgtttttgcttggaataagtccactttgactatcttaaatatatctctaatctaattcatatcccgtaacaacaataccggatatcttgaccccctcaaatattacaactggtataatttaactccctcagcagttttggaggatgggtccgctgacatggcgctttgaccgggtctatctcgctgggtcatcctgtgggacccacatgtcattctcacactccttcccttttttcccatttctctctctccttcatcttccccattcgacttcaatacagt

SEQ ID NO: 20338 - DNA, 161 bp, Oryza sativa
atgtggaggagaatgtgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagta

SEQ ID NO: 20339 - DNA, 1501 bp, Oryza sativa
gatgggtagtgggtctggccggcgacggcgataaaggtgccctctgacattggcacgatcttggatggctcttgtccggggcatggctcgttggtcgcgccatggagctgtgcgacgcagtcggagctgtggaggtcggcgtcgagggggatgctgaagacgccggtaccgtcgagctttccggtggccttgctctcgtactcaccattgccgttcttgcacttgatcgccacctggaggtctgaataaaagaattccaaataatattgtcaatcacttgtaattagctatatctttctgatcctgatggtgtatagctgatcagctcagtgaattccagataaattgttacgtactcttgaaagcatcctcagctttcatgttcttcctggtgcagtcggcgcacttggccgtgccgacgacgaccgacgccgcctctccgccgacggcgaccgccatcaagacggcacaaacgccgaggagaactagtcctcgaggagcacctgccattgctgagctaaccctagcttagctctgtgtagctattgctgatgtgtagagatggatgaagtgaaaggtgaggcaacgcgtggtttatataggcgatcaatatacacagcttgcattgttgatcgatccaactatgatctaccagctatgagcaaattaaaaagaccaagttggcgccgtatttgtagatgggcgaattgatgccgtccaaactgaatgatctgatcactcagtagtaaatctgtgaaaggatatggtataacttaatacaataaatctggacatgatgatattcagattcgttatactagactatgtaactgtaaaattaaaggtgtttttgattgttattctgtgatgaacaattggcatcggagattattggttttgatatttagaatttattcacgaagtggtttaggagatgattggatttcacaggtaaatctacaggtactgctggaataggtccggtcagaccaggcatgtgctaccggtcagaccggcgtgtatcgcgcagtcagaccggtgcagcccgcggtctgaccggcggactctgtgtcggtttcggtttcgggttgtttgtttggatatccgtgattgtttcatgattatggcttctagatggatactatacgtatgtaatactgttgtttgctactaatgagtcaaggttggagatagcttggtctcggaatatgatttctttgtttgttctatgtgtaggtgactcggatggcaggagagtatttgcggtgatggactaagagtcggcttggggataagacgacgtccgtggtggtcagagatcatacgggatactacggctagagttcaatacacatggttggtgaagattccatatggtatacgatggaggtattgtgtgtgtatggaatgcggagtcgaatttgaaaggagtccaaatttggtatgagtggttatgtaaagtttgtttcttgtactagagggtttcctaagttgtatagga

SEQ ID NO: 20340 - DNA, 567 bp, Oryza sativa
agctgatacacatactccgaccggacgagacgcactgtctcatccgtgtcgtttgaggagcactcagttgtttttagaaaagagttcaactaaaatcaattgcaaaaacaacagcctttccttgaagcctgcattaaacacttatttcccatggcttgctgagtactcccgtactcacccatgctctatataaataatcccccccagttgctgaagaagatgaagcggatcctgctgatgaggagttcttccaggagcaagccggctacgatgagttttagggtctcggcctagttcccaagtcgcgcctgtgttgtttggtctagtcctggcttccgctttccttttgtaatgcagttgtgagctcgggatctgtccacagcccaacatgactgtactcctactctataataaagagacctctgttgctgtgatattctgtcttcctgtgataccagcactatttcctgggactggtatcgattaacaggttaatttggagcgtcacgggctagttccagtcgggactagttcggggcgtgacaagagatggtatcagagccgact

SEQ ID NO: 20341 - DNA, 1501 bp, Oryza sativa
tacacccatggcccatcagtccttatgtttacaacattaatatatcacagtttttacctttcatgataaaatataagttattcagattaactccttttgcaaataagattgttaacattttgattatcctgttcaggtgagccactttttttcatactgtatcggtattgctctaccgctaatcattgacttgataactgatttgtatactgtataacttcttctttttatttgcaaccgagtcccaactttaaagttgacagtgaaatggatctggttgggcttgtattgttataagtataaaggttatattatgctttgttatttgtagtgatacattcaattgatgtataacatttctatatacagtatgaaaccacaattatgaattggatgaatctcaggtttgtttatattttatcagctaggtatggatccaaatgcttcagccaatggggggcgtattgccttcagagatgtaactaatgtttctccaggtgttgtagcatgtataatattttctactttttgactgctctttgtatacatatatgaaccacatcttttgtttttttccattttgcaataaaactacaacagctccaaacacaccttttacaacgaatgaacataaaaggagagaaattgctagaaagcacacaaatcaacatgaaaagaaggctgagtatgagacatgtgtcaatccttttgtgtttaccacacctaatcaagtgtcacaaaccaatatgttagacaaacaaaagaaagaagaaaagaacataaagctatgtgaatggcgtgcaaggagcgcacagaaggccgagtcaaaatttggtgaagaaggtgtgacaaatgatgctataatgcaaaatttgacacagactgaattgttagtgaaagagaagaaagatgaaaagaatagaaaactgcgtgaatggcgagcaaagaggaaggctcagtctaattctgttgatggtggaggagcatcagccactgtcatgcagaatttgacgcatgctcagttgttagctaaagaaaagagagagaagagcagaaagcaatgtgaatggcacgagaaaagcgcaaagaggaaggcagagtcaaacaatgttccagatgaagtaacatcatacaaaacaattcatacaccgacctcttgccactcgcaagtgactgaaagtcaaaaggtcaatcattctaaaatgttgagcatagacaaaaagagtgaaaatgagatgtcgagtatagacaagaggagggaacagaagacgaaatatcagcgtgaatggcgtgcccgaaagaaggctaagttgaacaatgttgacggctggagtgctacatcaagcccccctgctattggtaagattaatgccttccgctaatttctccgtctttaatccaatattctgatattgttttgatatctaaggtgctttctccaccattaatgaaggatcgctttatggaacagtatgttccaccattctaaatgatgcgcagg

SEQ ID NO: 20342 - DNA, 216 bp, Oryza sativa
attcctgcagcccttcagcaagtatgattccctccagccacctgtcatgccagaaggtggttccagctccatttccaacttccactgtagttagctcgtgcaggcagggcagcagtttttgtagggaggcccaatgagggccaagaggcctttgtttcataagatagttttcagaaggaataagttcactttgtgtccctctatttgtcgcccagt

SEQ ID NO: 20343 - DNA, 1501 bp, Oryza sativa
agcggaggccggggtagagcttggcacggcgttgccgacggcgcaagcggcgaggtgcggcgacgactaacgcagcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggacatcgccggcgagcggcggcgaaggggatcggcgtggagagctcggtagagggcgtgggggactcgggaaaacggggaaaaaggaagaggagtccacggggattgattttatagctcaagggggcgaggagagggccggggagcgccggatttcgagggaaagtgggccggcgtcgtgggggtgtgccggctcggcgtggcgttgattcccgcggggagagagggggagtggggcgggatgtggtcgcgaggtggaaggggtctcgggtccacgccggttgggacgaggggaggtgcgggatcggcggagggagtggccggcgtgggcggcggttggagctggccggaggttggggatgacaggtggggtccacgggtcccacctgtcggcctgagtgagaggggaggccgggagggaggaaaagaagacttgcgccaaaaaggggaggcaagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaagaacccttgtcgaaaagcctttccgactaatgtccgaccggcggcatgtgacccacagatcctttcatgtatatcgaggaggagatgtctgccgtcgtcggacgagacgcattttagaagtaccccgtttggcgccttcttgtatagatcgttgcctatcatacagtagacttttgctttacgggatattttctctgcttttgcgtcgtcctcgggcaactcttcgctgcctatgaatttgatgagtggggtgtgccagtcgtctgtggtctcaatgtcggcaacgacgcgctctgcctttgtagcccctgagctattgttgagggagaccgggctatctttgccgcttgcgtctttcactgatggccttgtcaggacgtccagaaaggtgctaggttcgagtggctctcatctggacgcacgccgtgctagatcatccggttcgatgttgtccttgcggt

SEQ ID NO: 20344 - DNA, 1501 bp, Oryza sativa
gcggtcgaactcgtgctggcgagttaccaggcccgggaccccagcttctctccctggatggcgctggaggagttccctcccgggaccgaggacgacgcgcgcgcgcgggtcggggatgctgccgaccacatcgtcaacagcttcgagggctcggcccctcggctcgcgttcgcccctgactccgacgaggagggcgacgccagcggtgaggacgacggtggcgacgaggccggcgacccgggcgcatcggaatgagcccccaggcccccgccaatcttatcttttttctttttctttcttctaaggccttcatgcctctcttttgtacaaattaacttaatctgcaatcagaaatgatgaaaaaatttttgtgttagttttattttgctatgcaatgagttgaggatgatctgtgccgtgatcctctttttgtgtcttagcctgatttaagggcccgtgcccaagtcccagtcttcgaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagttaagattttttcagaaggaaaaacggcacagacacaacctttaggaatttgaaactgcttttattgaaatgctgaaaggaatatatgtgcatgtgtggtagcccccggctaaccctgcacacccgaggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcg

SEQ ID NO: 20345 - DNA, 741 bp, Oryza sativa
cccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgccagagcaattttccttcccaagggaagcggtcaggtgtgacgccacccctaaagcctggtgacaggtgggaccggtctccgtagttgggcaaaatacccaacggtctcaatccatgcacattggtattgataactttggttgtccataatgggcggctattcaagactgccacaccacttgagcggcgcgcgaatctgggtgagcagatttgtctcgcccggagatacggtaacgccgcttcggtcggcgagcgtaattaacgcgcgcacgatacgatccatttcgaatgccacaaccgcatatccacttcatgcgccgtaagcgggcgaatgggattagtggaagcgtgggcgcgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccacctgagctctaaccctttctctgctacgccccactttcgccacacgcgctcgttctcaatcatctcatcctccgccgcca

SEQ ID NO: 20346 - DNA, 152 bp, Oryza sativa
tgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaagg

SEQ ID NO: 20347 - DNA, 766 bp, Oryza sativa
attatcggtctgtgacagtcacagccggtcagatccgggttaggtgcggccaggcggtctacgcacgccttgccccatccggcaaggtgtaagttttaagcacttcccccccccaattgaagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagc

SEQ ID NO: 20348 - DNA, 1501 bp, Oryza sativa
caacgaaacgtggacaatggtgttcgacggcgcactcaacagccaaggagcaggggcatgattcatcttgacatcacctttgggagatcagttcaagcatgcaattcacctcaacttcagggcgaccaacaacagccgagtacgaaggactactcgccgggataagagcagcagctgcactcggagttaggtgactgatcatgaaaggggattccgaactagtcgcgaaccagatgcataaagattacaaatgctctagccccgagttatctaagtatctcgcagaagtcaggaagctggaaaaaaggttcgatgggatcgagatccgacattgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgcacctgccccgaccccgagggccgaggtgccccgaccccctgaggggtttgcactatgtacatgggttgggtgagcacagcagggctcacctaaccgcatttattgcgcatcggctaagcgtgtcacgccgcacgaagtgcagtgcagtgcactcgattatccggtctgtgaccagtcacagaccggtcagatcgcgggttaggtggcggcaggcggtctgacgcacgccttgccccatcccgtcaaggtgtgagcttctaagcacttccccccccccaactggagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagctccgtcatctggcgcgccaggtagggggctcagtgtgtgttttctgagctctcagactcttccgcgtgcgccaagtctttcttgttcagcataa

SEQ ID NO: 20349 - DNA, 165 bp, Oryza sativa
gcagagaggattggacgtacgtgatcaaatcattcagtttggacggccttaattcgcccatctgcaaattcggcgccaaattggccctttttgctcatagctagctggtcgatccatcgattgatggatcaataatgcaagcaagctgtgtttgtattcatcgat

SEQ ID NO: 20350 - DNA, 1062 bp, Oryza sativa
cttatccaacaaactaaccacctactcatttcagattcctttcaggacattaatttgtaccaattgtaaatgtgggcaagctgttagatttgcctcatgtttcaagtgttttgattcagacgaattgttagatgttgggtctcattggctctattagttaattgcactataatgcatactccatcatttacaaccagtatgcatctcgctaacttttggtcactaacaccataacaattcactaattgtgcactatttttgtgtgttagtttctcattgcttttgattaatggggtgggcattgctgaaatacccactcccaacttagctacctaagcttatatgactttatgtttcaataagcctttttatgctataaacctattaataataatattgttgtgctataaaacctgataagcttgtggtataataatattgttgtgataaaacatttttatgctctctttgttgtattcttgttgtgcaacttgaaacagcagatggattcgatttatgctatgtgctctccataattaattttctttcctactgatatatgtgttgtcacttgtgttctgtttggttcacatttgtatgctggtttgggcccacatagtataaacattttgtgtggtcggattagtcttacatggagtgctcagataggtttgggccagcttttaaggctttatgttccaagggtccactcctttagaaaaagttgggtaaacacaattgctatgaaacctaactcttggttttaatcaattcaatgcagagttactgatggctccaaaaaggaaagtgaatgagtcaattgtggctaatctacctattcctgatccatcgttagttctttctcaccctttactagttctttcttacttaagttcatgctatgaaaattatcttacaaaagaaatgttttgtttttcagaatgccaattaaaatccctggagactctaaggtgaatttcaacttttatattatttgatgcaaataaaacaataagacaaataggaaataccttatcctattacggttttaatttgtgcaga

SEQ ID NO: 20351 - DNA, 1501 bp, Oryza sativa
atctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttcgtgaataaattctaaatatcaaaaccaataatctccgatgccaattgttcatcacagaataacaatcaaaaacacctttaattttacagttacatagtctagtataacgaatctgaatatcatcatgtccagatttattgtattaagttataccatatcctttcacagatttactactgagtgatcagatcattcagtttggacggcatcaattcgcccatctacaaatacggcgccaacttggtctttttaatttgctcatagctggtagatcatagttggatcgatcaacaatgcaagctgtgtatattgatcgcctatataaaccacgcgttgcctcacctttcacttcatccatctctacacatcagcaatagctacacagagctaagctagggttagctcag

SEQ ID NO: 20352 - DNA, 942 bp, Oryza sativa
aaaatcactttgcatggaaacttcatttgagcaaataatttgactcgaactcattttttttcttagcatatgtttccggacgagcatggggggacggagtttatcccatgctacaacaccatcatttttgataaaccaaagaattgattggtgttcttattaggtttaaagacaatcacaatattaccgttgataatgtcaagtccactgtactgtactgttagtacttctgaagctacaatacatatgttcaactgtacctggtacgtgaactttatgataattttgaaaagaatttgagagaaggactgaagaccagcatgagattctgttcttcaaatgaatctttctttgtggataataaatacagtgcatcagttttatcaattaccatgtaaaggtggaggttgtatcagtatacagttgttaatttcttgggttttgattggaggcctgctgttgctcttgctcaatttctgtatcactcatcccatactaagcatcacagagagcaaatacatagcatgttatgctgctagttgacaactatgctagtgtggttgggtgaaagaacgccattcgtgttcctgccaagggtacgaaacgagttagattaatggcccctagctggagttacttggtatcttttagctggatctgtagacaaccaataacttcaagtgtagttgtactgctattacttctgaagctactatattttattaggaatgtatagccatatatgccgtttttttgacaaattaacccttttcaaaaacttatttcgaaactaacccctgccaaaaacttcaaccaaaactaggccgtcggctcagcgccaagcgcattggcgctgaggttggctgtgtcagcgccaacgggactggcgctgacattgtgccaccgtggcggccgggccgatcccctagctgacgtggcagc

SEQ ID NO: 20353 - DNA, 1501 bp, Oryza sativa
acaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttgaacctgcaaattcggcgcaaatttctaatcatgatgtaatataattagctgatctcagctcactcccaggtagcctttatcgatctacatgatgctatgcatgctggcgcctatataaaccatgcatggcctctgcttcttcttcactcatccacacatagtaaggaggaggggcaatagagtttgctaattgctaggattgattcaacaatggcatcagtagtgttggcgaagatttccctgatcgaacaccttgcgcgcagactgcacgcgtccggcacggcacaacacagcaacagtgacaaggaactgagaggagaaattcagagcagagtgaagaacagagaagtttcagaactctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaat

SEQ ID NO: 20354 - DNA, 1501 bp, Oryza sativa; identical to SEQ ID NO: 20317

SEQ ID NO: 20355 - DNA, 383 bp, Oryza sativa
cgtatgtatggtccatgaacagcctttaatttctactagtgttgaacaacttgtctcctatctatgcttaactagccaataataggttcagtttaggctgagactgcactgcatagggagtatgctgtatgcatgctttagtcttgggctgttgattttggccacgatcaactaagtaagggttaatgtgatgtatgccattgcaaatatgttaaattagaaaaatatcattattattcacgatatcggttgggtgccactccaattttgtaaatttggaaccataccatcgctgtcacactttccgtcatcttctccccaaactacagcaaggaaccaattagctcctgaaaaaatatagagaggaaaaaaaaaagaaaaaa

SEQ ID NO: 20356 - DNA, 1501 bp, Oryza sativa; identical to SEQ ID NO: 20133

SEQ ID NO: 20357 - DNA, 1501 bp, Oryza sativa
attcaagactgttccatttatcaatcacccaggatagtaagatagccaccgctgaagttcacaggtacaagaatagttttgaataatttatgtgcttctattatatattggataattttattctgaaatttatctctaacctttactcaaggacgagcaaagagctaagtgtggggagtttgttggcggctattaaatgccaaatttatgccgtcaatacctgcataaacagaaagaataaagtatccaacatagtgattaggtttatttctaacatattccacgagtgttggtgcatatgtgcctgcaggtaataaaccgccgaagttgggatgaaaatcagacttaagtggaggtgaaatcctatccatacaacgagtgggccaataactacacaaaacatcaacaaatggtccttccactcgaagaaatagatatgggaggctgaggaggagcaacaggccgaaaagtgggcctattgggccatacatgggttcggccgaaccactcccacagctgtctgatatgcggcttggcagggacagtccagatgactccctaatggcggttggagggtagaatggacatttcacatcttcacttcactcacacactccaagcttgagctgaattataagaggctctattgtactttattgtatactagattagagagagagtagagtagaagaagtcagaggagttccggaattgtcggtaatcctcttcttatttcttttgctttgtttaactactctgattataatagaaatatctttcgagtaatttagttttgcttggtgagaattatctcttggttagttcctaatcagcgtacgagatcatcgttcactataatccagcaaaatatagtgattgctttagtgtgtacctaacattaaagtaagttattaattgcttagacgctgtgtctaggtagttattaatcgctccgtatcccacagtaggtgtggggtgggtgtagaggtggtgacagccctcaagatcactgaagtcctccctaactaggtacgtagtagagcgatatctgggagtagtaagctggccagtgcccgaagtatcgtattaggattaaagttaagctttccatagacactgtttctcaccggtgaatccactctatcctttgcttatccttagctttatgtacttggacgtacctggtgaagagccgacacagacgttccctgtggaaatcgatacctgagaatactcctgggtgaagtgttacatcggtatatctctataaggttaagaaataccaacatggacccagtcatgttccctgaagcagattactaggttggacagatacgatctacaatagccaatctaaacaattccttcttggagacaattggaccaacaacctagcgtccttcttgttccccatctcaaggagaagagcaacatggagttgggaatgtcaatgttgaagatgtccctagcgaacacctgagtttagacccaggccgtaatc

SEQ ID NO: 20358 - DNA, 233 bp, Oryza sativa
atactggtacttgtgaaaatttgtgatttgagcgatgctatttgatttgtaattaagctagctatctcttttttcttggaccgcaatgtaacatcgtgttgctaacttttaaactataaaagtaagataaagaagtaacaaaagtgtgtgcttgctatgtaggtctattattcggagcaacaaagggaaggaatggagcaaactttggacgtacctagatcgttgaggctacc

SEQ ID NO: 20359 - DNA, 563 bp, Oryza sativa
ccagttgctaaagaagatgaagtggatcctgctgacgaggagttcttccaggagcaagtcggctacgatgagttttatggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctatgataccagcactgtttcctgggactggtatcgattaacaggttaatttggagcgtcacgggctagttccggtcgggactagttcggggcgtgacaaagtaggacgaggaccaagtcaaaccagtcacgtaggcgtcacatcagtcatttccttaactattaaaatcggattaattgacctttcttagactgttttgagagcggttttggctgactatgtggtagagagtttttagtaaataaaacaaatacatagagcccatatctcatgggcacacccttctctctcacgctcttcttgtccacctccataata

SEQ ID NO: 20360 - DNA, 857 bp, Oryza sativa
gctacctctgcagtgaagagctgctggaggatgttcttggaggcaaagatgccctcaatgctttccgggaatccgacctcaacggctacctcgaagtcgaggtacccttatttcttcgtgtccaacttactttatcttccaagttccaaccaatctagacatagatacatcccttgatttaacacttgtcttctcttgtaaatgatggcagactgaaggcctgaaacagctcacctccatgggcagcctcgtgctttgctgtggggatggtgctgtcatgaactcaaccaatctgtatgctgccttcacccaccattctctcatatctcacatccgccttctcatcaactcttcttatgctaattctcttagagggctactgaggcatggagtctccatttggattgatattcctctggaattggtggtgaatgatatgttgaagacacaagctacttcagaccctgattccttttctgaggttcatctgtcctcctcttgcacaatcctctttaagactgcaaccttcatagtttctcggtttttacacataatacatataactctggctacactatgtccagcaaccctttatttgttaaacaacaatcgactccagcatttgttaacaacagcctgtgaatatgtattcaagtatactcccttaataatcttttcctatgtaaaacacactgcctcccaaaatccacatcctgttgcttgatgcgttgcgagtctaggttgactccatggctggctatatttctgactttgtcgttgcattaaaatgactttattaagagccaactttgttgtcacttgactgcttaatatctgccggtcacatctgaaatgtc

SEQ ID NO: 20361 - DNA, 1501 bp, Oryza sativa
agagggctactgaggcatggagtctccatttggattgatattcctctggaattggtggtgaatgatatgttgaagacacaagctacttcagaccctgattccttttctgaggttcatctgtcctcctcttgcacaatcctctttaagactgcaaccttcatagtttctcggtttttacacataatacatataactctggctacactatgtccagcaaccctttatttgttaaacaacaatcgactccagcatttgttaacaacagcctgtgaatatgtattcaagtatactcccttaataatcttttcctatgtaaaacacactgcctcccaaaatccacatcctgttgcttgatgcgttgcgagtctaggttgactccatggctggctatatttctgactttgtcgttgcattaaaatgactttattaagagccaactttgttgtcacttgactgcttaatatctgccggtcacatctgaaatgtcatgtttgcaggcaatgagcagagtccgacagcgacacgatgaactaaaagagcgctatggagtttctgatataactggttcagtacaaagtaaacagagagatgcataaacatcattttctttcataaaagtggaaaagaaaaggaaaagaaagcaaattgtgaattatatatatgggtgtggtattattgacttggtggtgaatacctttcagatgtggcatctcaactgggctacagtagcatcgactcagtgaccctagaggacatggtccttgaggtacccccaatcagttagatagataaaagtagtaaaaaagatgttgtagagctggggaagaaagaaagaaagaaatgggttttgcgaaagaaagaaatgttgacagcattatttttgtgtgtattttgaacaacagattgtgaggcaaatagagaggctgatccgagcgaagtcgatgatggaagctgctgggaagcccttctaaaagaaggaaggatccattgatgtatagactgttggtcatgtatgtacctcctgatccctgaggaattgccttagatgttccaggaccaggaagcaaaaagtgccgccacagctactgattgattaattttgtaccgaatgatcaatcattcgattgatatttttacattcccttgtgacttgtgagggagacatatgtagcagaatgaaaaagaagtcgaatttattttcaaaaaaagaagctgtgagtgtggctagaatctacacttgttcatatctatgcttgttcgtcagttgtgtttgtgtcaaatgagcaagtttgtaactgtggacaggatgacaagtgggaactcgatggacaatgcatttgctttggtgcggaggcccatcaaatgcagcccagcccagggaggtccctatcgagtagtaagtgagtagaagaaaagtctgatctccacccacgggcggagttgacatactagtagtagtagtactagtacacgaggagaagaagcaagaggaagggcatcc

SEQ ID NO: 20362 - DNA, 216 bp, Oryza sativa
ttaatattagagactaattattggttgcaaaaaaaactttgagttgaaaaactcataaggagaagataaaattaccttgtcatttcgatatatggcatttatcatctttgcccgtagataattataaaactggtatcaaccacaaacggtatacccatcaatgacgaaagagatccacgggtagcataaaaggctaaatatacacgaagagatgag

SEQ ID NO: 20363 - DNA, 227 bp, Oryza sativa
cttgccctcctaagtgcttatctgactcttaccccgcgctcttctgggagtttagatggctagccgtccccgccgtgcagctcgtgcaccagcccgctttggttttgaggatggtagagttgagccagaagaaaatcatgaatcagctaatgagcagtctcaccacagcaaccgttcgcatcgtactgtttcccgcaacgcagaggttgagcaaccccgccacagca

SEQ ID NO: 20364 - DNA, 1221 bp, Oryza sativa
actactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaagaattgcctgtgaagtgaagtcgcccgctgctgaagtcaagcttcccggtttagctcgcttttatcttttccgctgcatttgtaatattttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 20365 - DNA, 907 bp, Oryza sativa
ctgtcaagagcgaggtatgcattgaggtccataatctcaatcagtaagacccaattaattacatgccatcataaacttgtctcttgacagacttgccactgtgtagtttcggtttaggaacatgcccttcagaattaaccgattttgatgcctgggacttgatacttgcggttatatcgatctcactgcgtgataaagtttttcggtaatggataacaaagccgaatgttaacataatgagtgcgtgttcctctctagaaaaatgaataacattgcttccttgtttgcttgtaaccggcatgtgacaaacacatgttttcttctttattgatttgagtatcattgctactgctctgatatagaaatactccctccattcctaattgatcttcatatatgctttgtgcatcaataccaagacaatcatgtggagcacttaatcagcatcgaaaacagcgtttcgtatccgtgaatgtaacgccatcaattttgcatgctgtatggctggccaatcagttgtgagcgtattaaatcgatgcatgcagcggctcctaatcagttttgcatgccgcatagcctgaccaatcagatgcatgcagtgttcgttaggaagtgtcattaacatccttcccgggattttcatctcctccccaccgtaatgcgacgatcaaaatggaattattatttttttgcaatacgatgatcaaaatggaacggagggagtaaaacataacaacgcatgctaatattggacatttggaatggagtgcttttcttgaacctgcatattaatacaaaatgctattatattcatgatttatagctagtaatactgattgggaaatactgctggttatctctcttttattgaaggttgaaggcgtatcagagatgataattacagaca

SEQ ID NO: 20366 - DNA, 1501 bp, Oryza sativa
tgcataatccttgatctctcacacagccacgagggcgatctagcggttagacgacaagcggaagcaactccttgatcatcgcgccatttcccccaaccgaactcacaaagggggatctcacgatcacccgctagagaggatcacttctcgacagtgggaatttacttttttctcgtctatcccccaactttgtccgtgccctaaggtcacgacagtggcgccgtctatggggacgtaaagtctcccagaggcgagcttgaaaaggtaaatgcaacgtccacaacgagcgaagacagtaccagcaagatatacagatacattctcaagcgcggtaggtagcataaatgaatagtacataagcagatcccgatactggaagaactgaaaggagagaaactcaagttgaaacaatcattgaggaagtcaagaaacggcaagaacatcagctccgacgaaagtagaactagcaaaaaatggtgcaagcacaaggggttgtaacggtgaacagagaacaatatgaagggttacaaagggagttgcagcgattgcaggctttgcattatcaagcaatgagggcaaacagatcccagaggcaagaagggaaaacacaacgggctgacggaatccaatcaagccgtgcagtggagaatactcaagaggagaatgcacatgaagaaaacttgcaaagaagaattgctcgaatggaaaacactcaaccaatagaaccacgcaaggaattcctcaaatccaaaattttcaaaaccaaattccccaaacctagaatcttcaagcccgaattcctgaaacccaaattcccaaacaaagaatcctcaaacccaaattccccaaatccaaaatcttcaaacctaaatccctcaaatccaaaatctccaagctttagatccctcaaacaaaagtgcttcaaaaccaaaatcctcaagacaaaacttcaattcattccctcaagtcatttcccaataccaagtattttgcactcaacccaatcaaacaatccaagaacaccaaaaccaaacattctaacaataccaatttcaacagcaaatgccctaccaaaatacttcacaatattttggccaattccaaaatcagataagcaattttccatcaacccaacacctccaattccatccaactcgtgctacagataccaaaaaccctctaagccaaagtttacaaatggcaccatggccagcaaatttcaagttatccaacatcagcaaatacaaaggcgacgctgatccaaacgattatttgagggtgtatgaaacagcagttgtaagccaatacctcctgaaatataaatatcacattagttgcctatattttttgaaatctctcataaactattacatttcttacatctcaaaagacaagagataggcaaacaattcacgctcataaatgtaatgattttatgttttactgtttcatagcaacatgccatttagattaaaaaccaacaatgttagctctgtacatc

SEQ ID NO: 20367 - DNA, 1501 bp, Oryza sativa; identical to SEQ ID NO: 20107

SEQ ID NO: 20368 - DNA, 308 bp, Oryza sativa
cccttcctgctttagttagcaccattcctccacttaaaactctagtccgatccatagtaccttagcaatgtattcacgaaatataatgtgaagcttcatctcatattctaacacacaataatttaaggatatcaagatgtggtggtaaggcgtaatatccctttccaatgcattttgtaagttatagcttcatttgaacattgtgttataatgttggttcgaggaaaactttgaaagttcaaagtaaagaaatactttgattgtctacgttatgttttttttgtaattttgtgttcacataaatgttt

SEQ ID NO: 20369 - DNA, 1501 bp, Oryza sativa
gtcacatttaaaaaatatagatttggccagttcattttgttgattctatcaattctgaggctccgttcatttattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaaacaactgtcaccagaaatattaaaaaaataaaaaagtactagctcatattcatggtcaacgagtcaacggtcgtaatccccctcgccgaagaaaacaatataataataaagaaataaaaaaaaagaaggatcatactccaaagaaggggtactttgcaaccggcccgaatcggacggccaggataacgcccaccctatcttccgggaatctccagagaaaccacggcgaaaacaagaacagcaaacacacgcggccgacgacacggtcaccgcccgtgggccccacctcccctctcccctctctcttctccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttggga

SEQ ID NO: 20370 - DNA, 1501 bp, Oryza sativa
tattgctgcaaaagacttgtaaattaacttcttattgcagatcattttctttatgaaatgttatttgaaattttatatttgactttaattcctttttaaactattttggcaatggcacaacaggaacaggaaaagaaaacccaataaataccagcatgataaaattttgaaaaaagattttagctgtttcaaattttgttacacgttaccatctaaactccttgggaaaagaaactgttgatttggatatatattagtatatatggtcttcaagataaaagtttcaccgtcaatttctattgcaaggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacactttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcaacaggacagagggcccaaaaccaagcaggatcaattgataacattttggttaaattttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctccggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaatcatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctc

SEQ ID NO: 20371 - DNA, 678 bp, Oryza sativa
attttggtcaatttagcataattcattaacactattgttgtgtatttatttctcaatgcttttgattaatggaactgatagtgctggaataaccactccaacttagctacctgagcttatatcactttatgtttcactgagcatttctcacatcgagttaatcaaacactacctcttgataacatgccatttttgtctcaaatttatatctatgtgttgcccacacttagtgtgttctaatttgttccacatatgtagtctgacatcaagttaatcaactgcagagttaccaatggctacagaaaagaaagtgaacaagctatctgtggctaatttaacttcggatgattcattgttagttatttctctccctttactaattaaggatattatcatccttactaaagtactttcttactgtaatggaaattatcttacaaaatcaatgttttgttttcagctatccagttatagttcctggaaactctaaggtgaatctaacatatatgcaacctttaaattatttaatgcaaataaaatagtaagataaaagcttaaatcctaattaagattttaatttgtgcagattgagatacaaagccgagtcagaaacttgactgtttatgctatcaaaattcctggcagcgtggcatataatgctatgttgttatattcaga

SEQ ID NO: 20372 - DNA, 1501 bp, Oryza sativa
aaaaatgcaacaacattgtacacagatgtcctgaactgagcatcttcaaaaaagtccaatagatttgtcacccattctgattggttccatatttctgataaacggagaagtatgctggaaagcagtattgtatcttttttaatcctgtgacaaaatataatatttagcaaacttaaaaccatgttatgaaagaaaaaaatgatgtcattgtcaagtaccatggacaagccactatagaagtgaaagctccaaagagaaagttattctcttcaataagatgagatcccattccttcactgataccctggagaacaaacataatacattacatacattagagatgaaagtcatacatggataacataacaaacataatacattaaagatgaaatccatacatggatataacatgtcaatgtgcaagtttaaatatatctaccagcttaaaaactaaaaaaataattaaacaacatcacaggttttgaagattgaatatatgtttccatcacggttgtggaacaagatttagaagattccattacccatcacaatctagcataaaacttgttacttacacatctgcgaatatatgtttccatgagtgggatttcagaaatttgttcctcgctgaacagctcgagcaatgtcctcaccaagggattcacaatctctccatcctccatctgtgacaattgaaaacatccatattatttattattcattatattaaaattgatgatatgccaccaaaagaagtagagaattctggcataaggaaaaggaaaaaaaaaagaacattactattatcacaagctagcaattcattcactaaaatcacacaataaggccacatccacaaacaatttgtaaatcctagataaataagttgatgcagagaagaagtaatggcaaaccagcggtgggtctttccgcgaattgtcctcgccacagctgtctgaagtggtggagtctcgctccgtcaacgaatcgtcgtcctcgtcgctgatggcttctagtacgctgaatctgttgcgtgcgctgaatctgttgtgcctcgcggagtcccaaaggatagccggtcgaaacttgtagattccagggcttggaggaaaccgggatgttcccggcgaaagcgaagttggcttcttgcgaggcatgttttagagggagaggggaggataggagaccgcagccgggacggtgttggggttgtcacttgtcagacagcggcacggcaggagtcccgagcccgacacggacccaaccctaattcctggccacgattggcggcgaggccgggtcgcgtccgggtttccccctctctcacgccggactccccctgtggatcgggtcggggaagagagccgatcgagccggaggggggggctcagcacgtcacgggactcgtacgcggcggcggcggcggcggcgccgtcgccgtcgccgggagagtcgagagtcgaagtctcgaagacgatgacgtgaatccctccgcggtggg

SEQ ID NO: 20373 - DNA, 164 bp, Oryza sativa
aaatccaaatccagttcggagaagctgttccaggaggcagcctggcttgatagatctccttagatgtcaagtttgtccccaggcttttcgaatttcttcgaatgtccagttcatcagtacgagtaaaatgctgaagtagttcctctagttcaatcaattgaagt

SEQ ID NO: 20374 - DNA, 220 bp, Oryza sativa
ttccgtcacatcgttccaattttcaattttagagtggaacgggttgtgtttagttcacactgaaatttagaagtttggttgaaattggtacgatgtgatagaaaagttgtgtgtgtatgaaagattcgatctgatggaaagttggaagtttgaaaaaaaaaactttggaactaaaaacagggccaaacagtcataatgtgcagcttgtcctgtcactagt

SEQ ID NO: 20375 - DNA, 170 bp, Oryza sativa
acattatcctaagatatatcacattctattctagattaatttttcgtgggacgaagggagtatgtactatgtaagtgtctttcgtgtaatagaaaaaaataaccagttgatagctagggttggtcaggtttactggtgattttgattagccacacggtttaaatttcagc

SEQ ID NO: 20376 - DNA, 204 bp, Oryza sativa
tccaactgtatatctgcctgcattgtgcagtacttgccgtccgcgagcactcagccatcttcatagcaagtggatgctaatgtagcaatatatatactctcttctcttctcccgtacgtgtgtgtgcggttgtgagtagtgtttctctctggttgttgtgcagtcatcaatcgccatgattcttctgctctcgttttctgcagc

SEQ ID NO: 20377 - DNA, 1501 bp, Oryza sativa
gcagcttgacggggatggcgagcgtctgtgcgttgccaataaggtggacgagatggcctcccgctgctctatcaggacggcgtgggcggccaccggcgtgatgacgatatgttgttcacggacgcgggcagctcagcggcgtccgtgttgttgtgttgttctcaacaagagcttctggatcagcgtgactaggcagcatccgcggctgctccgacgatctccggcgcgtcgcgtcgggcggagtggcatcacgatggtcttctccggcagatgggtgttggtggtgtcgcagtgccgggtagcggcactccgaccggccttctcctcgagcgccttgacgatgagtgtgaggaaggtggcagcatcgtcgaagatggccagcagacatccacggcgtcgccgagtggaggcagcggtcggcaaggcaacgtcatccaacatctaggcgagatcgcagcaatgagcagggtcatcgtcaccggcagctcgaacatcagagcttgaggacgagcggcatcgatcttgacggaggcttgcgatcagcgtcaacagattggtctacgcgacgactccggcgatggcagcacacccggccgtcctccatgcatgcacgtaggcactggaaccaaaagaaaggaaccaatctaaattagctttacctgtagtggccattaagactttctttggtgtcgcttcttgaatgatttgtagatgaatggatgagtccatctgagatgagatggagatgttgatgaatgtggatgacggcgggcggatgagtctcgatggcagcggagatggttcagaaatagtcatggcagccacgataaccccggcggcgtcgcgtacaggctcatctcccacctgaaacgagagaaaagaaagcgacagagacttgctctcctcctgaaggtttgagtacgatctcctgcagcgtttgatctgcccaaggaagatgtcgttgttcctcctcatgtgcgcctcttgccggacacaggggtgctgtggacgaggtcgccggccgccgagatcacatcttgatgctcgttgccggtcgatggatagctaggtcgccggtggatagttgtcttccaggaggagatggacagatggatgatcatgtgtgtcgatgggtgtttatggattgatcggcgtccatggcctccaggctgccgagagtacgtcgacgccttatataggggcctgaggtcggtggagaagtgcggatatacttgatcaatcgatcggtttgttaatcttatctcttcgatccgcctgacgtcaaatattggttctgttaatttctgatgggcctacaggatagaatttaactctcgtacgtgtgcgcatccgccggagcgcgtcatggcggtttccgatattccttgccactcttccgttgctgggccggtgagagtccggcggaaggccgtctttcgtatgcgcgtggcttgcaaggattgtgttgaattcattcagataaattttatctcttcataaa

SEQ ID NO: 20378 - DNA, 982 bp, Oryza sativa
cgagacctaatatgcttttgcagttaatctattagctagatatagtgcaaccccaaccagaagacattgggttggtgtcaaaactatcctcaagtaccttcgaggtactcaagatcttgggttatggttcccaaagaaccaagatccatccatggtgggatatgtggatgctggctatatgtcgaatcctcgtaatgccagatctcagactaggttgatttctttgtggtaatactgccatttcctggcggtttgtaaagcagaccctggttgcaacgtcaaccaaccactcagaaataattgctctatatgaggccacacgagaatatgtggggcttatgcggatgatcggtcacatccagaagtcatgtggcctaaacattgataacacccccaccatcatctatgaggataatgctacttgtgttgcacaaatacatatgggctatgtgaaaagcaatttcacaaagcatattactctcaaattcttttatccccatgagctccagaagagcggggaaataaatgtcctgcaaactaagtcatgcgaaaatctcgcagatttatttacaaagtctctgccagcatcaagttttcatagatgtgttcgtggcatcggcatgagacgacttagtgaattgcaagaatcagggggagcaaacaattaagagaatagcccatgattatgatcctgaagaatcacaaacaagtcctgaagacttgatcaactgttgtactctttttcccttggtgagttttttttccattgggtttttctcacgcaaggtttttaacgaggcaacaggtgcaacacaatattcaaagtgccatgtactcttttctcctaccattttttcccactaggtttttgggatgagtttttatgaggcatgcgcataattcaaattcgtccaagggggagtgttatgaaacctatcttattgtggacgaattaaattataagtgggaagcttactacaga

SEQ ID NO: 20379 - DNA, 1501 bp, Oryza sativa
tcatgctgataaactgagcgcaattgaccacaacacatcactggtgggaatcacttgaaacacgtcaagaagcacccaagcatgggactcgattcttaatcctcataatctcttgggaagtttggaaggagcgaaaccaacgaattttccaaaacaaggagctaaccacggtggccctaatcgcgaagataaaggaagaggcgaaatcttgggctatggctggagccaaacacctagcagagattcccgaccgtgatgctgtaaatatttttttccttacctgtaaaaagaaaatttcgaacgaaaggcaaagcttgcctattctttttaaatatactatatccgattttgaaaactttcagcttaaacttgaaaactttcaaattacgacattttcaactcgaatatgaaaatattcaagtcaaatttgaaaactttcaactcaaattacaaaaattttcaactgatatttaaattttaactttcaattcatgatttaaaattttcaactcaaatatttttaattattaaaaatatgtctatcgctaattgccattagcattaagcatgctgggaggcgattaacgttacacgcgtcggagatgccgcgttggcggtgcacaccatcgatcctctcttggcgcaggtgcgcgcgcttcgaaagtgccagcgatgtacaaacccaatgggctcagtgctcaacgagaggcattttagactgggctatagcccatcgaatgaagctagccaaatcctggcccggtaatgcccggcccaacaatccgaaatatccagtgaaaggcaggcacctgctcgccggccgtttgcttaagagtgaaaattaagtctgaacatttctctttaagtgccaagagagccattcaagatcattttgtcatatattatttttttgattcgatttgctctccaattttctactctgttcggaccattccagcaaaagtgtgtcattctggtccaagatagctatggaccattttagcttgctacgtggcgttgatgtgacatgccatacaaatgcgagattttggactatttgccactctattgaatggcacattctcaaatgctatccatctttcccagtaaatttgattgtttgtcatcgtgattcaccaaattgtttctattttatcacttttgacggccaacatactaaaagaaacagaaaatgacctcactgcccctctcatatcttctcttcttcctctccggcgtgggaatcccaggtacagttgcagttggatggatgacacaagcctccggtatttttgacggtgaggtcgttgatgagcgaggatatgtcgaggccaccttgaccacaagcgagatactcgtgctggtgagagagcatacaacttgacagcttgacccacgctggctcctgccctcctgtcgacgtttgatgtcgcgattccggtattcgcatggtatggggatcattggtactaggatatacacgagactgaggtaaaagaga

SEQ ID NO: 20380 - DNA, 220 bp, Oryza sativa
catcgtccaaggtaagtatattttactttatgctgccatatcatcttgctcccataaaaattgttagcacatccagatacatctcgaattgattaatctatgtctaccaggcttgattgattgcatggcctaatgtccgatttgttgttggttttgtttttgtctttttctctctcttgttccatgatggtgatcatggacataggagcactgacataga

SEQ ID NO: 20381 - DNA, 1501 bp, Oryza sativa
gacgaccatggacgccgccgccgcggcgtcgccgtcggcggcaacggcgagcacgttcaccagcaagacggcggcgcaaacgccgaggactagagcccttggcagagcccccattgctgaagctcacaagagatatatgatgatcagcaagaagtagtggattgggagatgagcaagaagagaggcagtgatgggtttatatagtgatcaagaagagcatatgcatgcaaagctacatgcaatattatgttcatatccatgcaagtgcaacagaagcatttggcatatgcaggagagagtaaattaaattgcaactaggtagatggtgtgttaaattaaactgcgactagctaggtagtagatagtagtgatcagctgagctaccagttcaatcaggcaccggctttgcagattgttagtaaatgtgccgttaaaagttgatgattgttctctctgttttctcagatctgcaattcttgccattgtgcatctggcactgggcaacttaattatctttcctttagggcaatgcatgcagagatgcatgaacaattaactgcaagtttgcaacaacaattggctgcattgaaagaacagttattgttgagattgtgttggaagtacaaggggtgtatttgcagcatggccggagattttaatttggtcccaggtttaacttgaattgttcaagttgaataactgttacatctgtggcactgctacatctgtgccacattctgtaggtcaccatagagaaagaaaggtattcatgtcttcagttcagcagtatatgtaggtactattaaagagatgtggtggattctgggtattcatgtatatattgttttttaacctcaaatttgactgctagatccaacagtttataatgaaaatttaaccaaaatgttatcaattgatcctgcttggttttgggccctctgtcctgttgccctgttggtcctcttgctgttaatattttaaaactaacctttatttattgtgtcgctgtcaaaaagagggttattgtaacatttcagtttaattcaattatattaattcagatattccaaatgaacttctcagtggtttactgaatttctggaaagtgttttcctactttaacaatctgctatatatgttgaaggaacaactatactgttgactttaatggaatctcattgcagtttagatgtgtttaatggcaaactttaaaagttttcgatattaatgtccttttaaatatttagaatgaattaaaaaaaatactgttagtataattttatcagcatttttaaataccttgcaatagaaattgacggtgaaacttttatcttgaagaccatatatactaatatatatccaaatcaacagtttcttttcccaaggagtttagatggtaacgtgtaacaaaatttgaaacagctaaaatcttttttcaaaattttatcatgctggtatttattgggttttcttttcctgttcctgttgtgccattgccaaa

SEQ ID NO: 20382 - DNA, 681 bp, Oryza sativa
ccaaactttaggggctaaatgcaattttttgcagacggcgccgtcgagccgccgtctgctacgtcagcttgccgccctccattaggacggcagggtctatttttgtaattttttgcgccaatagattatttctgtaaatattaaaagaaaaaaaattaaaaatgaaaaaaattctatcttcgtgagactcggccctctacctgcgttcagcttcgtcggcccaaattccaggcccattagcccagttgcatactccatgttgcaagttgcaacagttgtgtggggcacgagtcctcgtcacgtaacgttgttcctatcttatttccgcccgcaccccgccccacgcgagacgcgacggacaaaccgcttccccgccgcgatgtgccgatgatgcagcagacgagactagacgagacgaggcgggccaccactgagccgggacgcacccggtatctgggaaaaccaacgcgcgcggccacctgattcagcccgcaccacctgatgaccccctccccctcccttcaagtataaatcccacctccactccccaccagattctcatcaaacatagcaccaatcaccaatcacctatcagtagtacttcactgctcgctactagtcccctgaattcagcgatcagtataacagcgggaagctcaagaagagatcgtcgatcgatgg

SEQ ID NO: 20383 - DNA, 1501 bp, Oryza sativa
cgccagaagcgctggccccaacgacaggaggtcggtgcaggcgaaccacacactcaatgcggacggcaccgccgcaggatgctgcgctgcgggcctgcgacaccgttggtgaagaactcggcggcatatgacgagagaagcggccggccgggagcgagccttccattttcgtgggttgattttggtcggcgtgggctgaaaagaagccagtaggtccgctgtgcttgtttacctccgttggatggcgatcgagcggcatagtggcatcggacgtccctctgacgtagattgctctacgtcagaggatcctattccgtaaggctatgtacatcctttaggtgcagaggccggtttaatccattatctaaaaaaaaccaaacaaccactagcagttttcacattgagtacagaggtaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctc

SEQ ID NO: 20384 - DNA, 1501 bp, Oryza sativa
attttacatatctcacaaaagtttttgaataagacgaacggttaaacatgtgctaaaaagtcaacggtgtacatgtgctaaaaagtcaacggtgtcaaacatttcgaaacggagcgagtagttgcttgcattcgtacttacccttgaaagcggtctcggcgtccatgttcttcctgccgcagccggcgcacttggccgcgccgacgacgaccgacgccgtcgccgtcgtctcaccggcggccgccgccgccatcagtatcatcagcgccgcgccatggaggagcagccagcttgctcccatggcgaagctacagttgtgtgtggctctcaatagtagttgcactgtttgcaggtgaagagcaagggcgtccaatgaactgcttatataggcgatcattgcatatataattgcattactggatgttaataattcagcactgattatttattttatctatttatttacagctcgatcgatatgatgatccatggagttaagatgtgccacgaaaagagttaatgtcaaacgtacgtatagcgtaggagtgctacagtaagctacattttgtttagttaatttaccagcgaattaaatctcactggcagtgatgaaatggtagatagtatagagtatagagtataaatatacgtatgcatactagtagtatgtactttggctatgtataattaaatgccggctcaattcaatatgttgtcgccgttgtcatgatctcttatatcgtgagctacgcttctatgtaataagtagaactctagttctagtttgtgttcatctcagtttcgggggaaaatccagcagtacccactatacatataaaaatctcatcgggagaaattcaaattgttaaaaaatatttcccgaaattgaagcagttcaaaagagctttaatagttccaagaaattttagttgtcactacattgttgattataagctgtaacggtttaccaacaaacaaaaataatttataaataaaacttatatatatatatatatatatatatatatatagatatacattcttagctgtttaaatacaaatgttgtaaaataaactaccgttaacccaaaaatctgtcccaaaattaaattttgaagtttaaattttggtttataagctaaaggatgaacaataggagtgcttatttttttttccttggaccagaaaaatctcaagagggcccgagatagcaagatcctgcagagaatcttgcatgaccacacataggagagtagaggatgtagttatgttggatgcatgatcgaagcacatgcaacgatgatcgacgacgtcgtggggttgactgtcatcttcaatatgttcatgtgtgtgcattcaaccaagttggtgtaaatgtacgcattgtacagtcttgatctccaataatacagatctacggctgtgtttagttcagcgcaaagtttggattttgattgaaattagagatgatgtgactgaaaagttatgtgtgtatgacagg

SEQ ID NO: 20385 - DNA, 1501 bp, Oryza sativa
atcgtcgcgcccccttgagccctagagaatctccccgggacgccgccacggctggccgcctcgccggccgcgtccgcgccgtgccgcccatcccgccgccgcatggccgccatcgcgccgcctctccctcatccgagccgatggatggaaccgccttgagcccctctcgcttccggtgcctgccggcccctccggcttgccgccgctcgccggcggcgttgcgccgctgtgagccgtccgatccaggcgcctcctcctcccctctcgccttgccaccgtggctgcccatgtggcgtttgacccagtccatggtgcccagtcagccgccccctcctctctctccctgctcgtgggcttggcccattggccaaccttcctcctcggcctaaaaaacaaggaaagtctatctttactcccttccccaaacacagtggccaaaagtccataattgctccctccctattcactcctctctcaccatatgttggccccacacgtcaatgagtgactaaaaagaatattcttttccacaaattcaataaatcatttctttaatccagaaaattcaataaatcctttttccgttgttccacaaatattttccttcctcccagaaaattcaaacaaccttcgtaaataatttctcttattcccatcggataagtacatatcctcccttgtccacaaaatttccacaaattgttttccccgctccaaagaatcaaataaatcatttccttgtccagacattcatttaaagcctccaaaaattcatatctcccgatccgtgactccgattgacctcgttccacttccagtaattccgtaaaattgtgatctatctaatggcactattattttagtctaaataggatccttttctatttggtccttgtttagatttttgattgtatgcgcctagttgcggttaccggatatttttcgtcaagcggatttctcgaagattcgtgaagaccctgagcaaggcaagccacctttgaacatcttgagcctatatttgaacttaattatattgattgtaaaatattattcattgataggattgcacttaatatgtttgccccgcctgcgaggcagattggtgggcctacctaacttgttgcatttgatccttccattgttaattgctatatcatgctcccttgtaaccacctggttgcgcctcggtattcatacactctgtgcgagtatcgacggtcgcctttaaaacttaaaatctgagaaacatcttgggtaaaacttggtttacgaaaggattggaaaacccgacgcctgggtcggtgccttgtgaaagaaaatgagttttaaaaataaaactcgcgacacaaggccattcctgggcggaatgcttgtgcggtcacatttaaggaccgattcctttggaattacatccgagcatataacaagtgcgaccacatgggtggaatgggacacccctggctgagtaacaagctaggccagggaagccttgatgccaaga

SEQ ID NO: 20386 - DNA, 484 bp, Oryza sativa
tgcacctttgggtaagcctttactcaatagaaagggaggttgtggggattttgccactgcacctttacttcaataggtacaatctgacatacgctatatcagttttgtttggctccatatttaccaacatagggttttccatagtaagctcattctatgctttctggatatactacttgtcgcgatggttctcggccatgtcataggacatcacctcgtctaacttgtaattttagctgttgtaactattcatccaactttgtggcctcggttttcagttcgaggttcttgatacatgaacgtgcctgatcataatgaaaagtcccattgcaattgtacaaatatctcaattttaattaccatgtgttatttactttccagtaatacgttaccagaatcctccaatttcacatatacaaagaggtgtgtgccaattccatactggagtactcctatatttttaagtcacatactaagggtgtgt

SEQ ID NO: 20387 - DNA, 1501 bp, Oryza sativa
gttaatatattgtgacatgtggaacccaagaaaaatcccacaatgccaattccgattattatttgcatttattaattagggaattagctctaggttaattaagataatttcttcggacgatttatttagccaatttttaaagcaagcaaaggggggaaaacttcagggcgtgacaaccacaggcaatactagggaactaggacgaaaccttaatcttcacttcacttcaacttcaccttcagagctggcagaactatatatatatagagcaagggtgagtacttatgtactcagcaagccagggggacttagatggttaattcaagcttcaaggaaagtgtcggtgatatgggaccgggagtatcgtgaccagaggcttgaggcagacgcagtcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatcccctttaaatataaaaggaggaccttgcccatagagaggggggttgattcttttggagattgagagcctagaacaggggagaagtcggctcacactttgtagctccttcatacacagatccaacaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcagactcttccgtgtgcgccaagtttttcttgttcagcctaa

SEQ ID NO: 20388 - DNA, 1501 bp, Oryza sativa
gctcacactttgtagctccttcatacacagatccaccaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcagaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctgcagagggggtacactttacctacatgacgttactagccttggtcacctagcccgtgcggatcaaacacgtctggtgacttggggctttcacgacaaggcatttccaaagccaacacagggttgccatatgccaacgagaggggtcccggaccaacaacaggttaggtcccagaccatactgtgccatgaagcccaggggtcctccccgacaccaccccggcgaatccacttgtctcttggcatcaaggcttccctggcctagcttgttactcagccaggggtgtcccattccacccatgtggtcgcacttgttatatgctcggatgtaattccaaaggaatcggtccttaaatgtgaccgcacaagcattccgcccaggaatggccttgtgtcgcgagttttatttttaaaactcattttctttcacaaggcaccgacccaggcgtcgggttttccaatcctttcgtaaaccaagttttacccaagatgtttctcagattttaagttttaaaggcgaccgtcgatactcgcacagagtgtatgaataccgaggcgcaaccaggtggttacaagggagcatgatatagcaattaacaatggaaggatcaaatgcaacaagttaggtaggcccaccaatctgcctcgcaggcggggcaaacatattaagtgcaatcctatcaatgaataatattttacaatcaatataattaagttcaaatataggctcaagatgttcaaaggtggcttgccttgctcagggtcttcacgaatcttcgagaaatccgcttgacgaaaaatatccggtaaccgcaactaggcgcatacaatcaaaaatctaaacaaggaccaaatagaaaaggat

SEQ ID NO: 20389 - DNA, 633 bp, Oryza sativa
attctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttcaacagtagttcgttcgtttgttgtgaatcgaacggctaaacatacttccaaagtcagagcagtagagctctcagatgatccaaatccctcgcataccacccccggcacgtccatagacttttgagacatatttgtacttcctagg

SEQ ID NO: 20390 - DNA, 268 bp, Oryza sativa
aagcgtctcaaacatgaacaaggagatgattggggatagatacgataggggataggacgagcgacaggtgaagaagtaccaggaattaggatcttgaaattggaagcagtcggcaggtttcgatccgagaaccttcgtaatcgccatcgccaaatccgatctcaaaccctcaacgatcgattaatagggattagatagactgaagaacacaatcaattccgccccagaacgacgcagcaactgcacaatttcgcattgatctcccaaa

SEQ ID NO: 20391 - DNA, 861 bp, Oryza sativa
tgatcgttattgattctatatatataagtcgaagtcattttttttttaaaaaaattaatgtttgtgtctttgggtgacggtgagctagagcggagttatgggagctggtagggaaaaccgttagctggaggacatggctgtgttcggagtccagtgatggaagccaatccctcccgtacggaaaacgaagcggtcctttagcgcgtgattaattaagtattagctaatttttttaaaaaaaaatgaattaatttgatttttaagcaactttcgtatagaaaactttttaaaaaaaacgcatcgtttagtagtttaaaaaacgtgcgcgcggaaaatgaggaagatgggttgggaacatggggatgcaaagacagctgatgtggtagagtccttggatagaccatgtgaggccggtttggctgttcaatggagcatcctgtttaggtaggacttggatttagggcctgatcggaactgctatctgctgctgccgctatggctgtggctgtttttcagctgctgccgctgcagccatttttagctcttgcagccacagttgctgcagcagcaagcagtatcgatcacaccctttaattccaaatgctgtgccgtacgacggtacgaggtacgagcaggtcagcgggtcaccagtgttgtgtgaagccaagctgtattcactagctcgggatagttggcacaaacggcatgaaaatgtggcgccgtaaataagtgaaatacagctgcgtactttttgaacacgctgcaaacatgagacggagaaatttcaatgcaaaacggaaaataaaactgcaaacatgcgacggagaaaactcaatgcaaaacgaaaaaaaaaatgggagc

SEQ ID NO: 20392 - DNA, 408 bp, Oryza sativa
cggcggcttacgcgcacgcgcgcgcggcgtgcgggcgaggctgagcgggggagcggggaaagaggcgctcggggcggctctcgcacgcgcgagcagcgtacgggcgaggccgagcggggggggagagatgggagagcgcgcgagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcggggattgagatcttgagatggcacggacactagacaacaagcaaagaaacaaatttcgcagttagggtttttaagagataattttcccgctagg

SEQ ID NO: 20393 - DNA, 629 bp, Oryza sativa
acgcactacctcgccacgactccaaaagagttggtggcggaacaaaagggcctatcacacggacggctgctgaagactgcctcctctactcctcgtcggcctggctgcctcctgtagtcggctcctcagtcgaagaaacgtcgatcggctgacgcgaagggaccggcggaacctgtcgagggccagcagcagcacgggccgctggcggtgggggagctgggtagtggaaacggaacacgttggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgagggcagagccgcgggagctgtgggaggacaggtggctggcgtggcagaggcggcctgagtcccaagagatagtgtcaactgaggtgacaccctcctcggctagacaggcctccaaagcggcgtagcggcgggcaagggagcggtaagcctcaaggagtaggtcgtgctgagtggcctgagcctccgaaagctcgaccatgcgagtcagcgctggc

SEQ ID NO: 20394 - DNA, 1274 bp, Oryza sativa
ctcggctggcgcggcgcttgcggtcaaggagcggcaggtggtgacagcggctgtggtcggggaaaaaggcgaaaaggggagggaaaagagcttggctcccttgccactttgggaggaaggaggaaggagggagagagaacgagggagaggagcacgagctctgtctcttggttttggaaggatgcggcatggaggcatcggggccgagcgatgatagcggcgatgacggctaaaggcgagcggggccgggcggctgcgcggcgcaggcgcggggacaggcggcgtctgggctgacgtggcggcaaccgggcggtcagccacgcgcgagcgcgcaggaacgagcgaaggcggtgcagatttgagcggcgttggcgggaatcgacgccggggagagagagagcgaacggagagggagagaaaaggcagagaggcgggagctctcttcctctctcagctctgctgagtgaccacgtgcagcgcacgtgagagagaagggcagaggggagagatgggccgagggaggggattcggcccacgaacctgagggatgaaaattagacttttgcttagaatttgagttggagagaatttggattgggaatggaatttggatatctttcgagttggtacaagtatttggcgagaattcaaagagaggaattgaatttcggaatttgatctcggtgacttgaatcaggattggaaatttgaggtggaggatttcgattttgatgagagggggcaacgggatttgaattgagatcctggcacgacttagactctcacacaaagaacgaaaattttcgcaattaggattttgccgaattagtttttaacgcctcacgaaaagcggagcgttacaatagctcatagccgaaatatttgaccgaataaattaatatacggtcttgatttccgttggtatgctactgtgtgtatgtagcaaaaatttacaaaaactgaaacttcctagtgatagccgatgcaaattgaatcggctttgattttttctttttcggtaacagcgtgcagcaagaacagaactgtttctgtctcgtgtgtattgttagcgatgctactccacgtgacaaacgtataaagaggtgtcacactctcgcagcggcggtggacggtttacggtgcaaaccgacaaagatggactaaaactagggtaaaataaaaaacatagtaaaagaacgattgaagtaagcggcgacgaggtggagaggcggcggctcctctcccgacgatgatgatgactgtcgcgaccaaga

SEQ ID NO: 20395 - DNA, 1501 bp, Oryza sativa
ttgtttttggtggtgtcaactttggccttcttcgttgcccttgtgctggcaggaggtggagcttggcgagaccttgtcttgggaggtgcaggcggacacggtggaggtggaggcggaggaggcggaggagccggaggagatggtgcaggaggaggtggtagaggagccggaggagatggtgcaggaggaggtggcagaggagccggaggagatggtgcaggaggagacggcggagccggaggagatggtgcacgagacgccgcttgttgcccagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggccagtagtggtaagtccctgaaatgtccgttgggatggccattcccgacgccaccttcacgtgatgagaggttatctattagtaatcaacctaagcagcaacttgcggaacgtacaagtcaaaaatcatatattacatcgagcataccttgattgataagttcttgaagggaatatgcagcttacatggtgtccgttgcgtgatctcatcaacggggcaggtggtttcgtcctgggtttgcatggcgtccatgctatgtgattctacctgccccgttgaggcgcagctgctacgattgcctgatgggctgaccattggaggaggtatgtatggctggggatcgtgtgaccgatgtgctgccatgcgttcatccaccttccggaccacctcctcttgcatgctgagctcgtagctcgataccctgtactcaagatctgcaatcttcgcctcggtatctctcttgctcctcatccgactcttgtacgtgtggatgtcctccttgaatccaatcttccagggaatcacgcctttccctcgtgttcgtcctggatgctcgagagtctgtagggcgagtgacagctcgtccttctctctgtcgggttggaacgtgccatgagaagaggcttccactgcgtccgttagtcgactggcagcctcgcgtatctgatcgctgaagaccagggagccatcaactgggttaagcgttccaccgtgagcatagtaccagaacttcgatcgatctggccatttagcggtggctggttcgatacccctctcaatcattcttgcctccatctcctcccacttcggtattgcgacgctatagccacctgaccccaagtggtgatggtacttcttcttggcaacgttttacttgtttttgaccatcattgcttgcccttgttgccctgtcttgtaagcaacgaactcgtcccaatgatcccttagctttgggaatacgtcgaagttcggtgttagtcccttcaggatgtatttcttgtacagatctcccttgaaggtctagaactgttctgccattttcttaagagtccactatttcactatgttctccg

SEQ ID NO: 20396 - DNA, 999 bp, Oryza sativa
cactccacttcttgtgtgccgagcttcgttcggttcatgtctgaataattagtggcaactttagccttctaaagcttgcatgcctgcaggtcgaaactagccccgctgctgctcaccatgacacacaagagagagcgtggaataaagttcgtaacatgatactgtaacgcgacgaagaataataggcatggaaaattacgtactataaaccacgtctgtaataaaaaattgaaaactactgttagataaaaataaacgtttgagatttccccacgtcaccaagagtaaaaatattactgcaatatgaaagtaaaatttttacttttataccgtggacaaatcttatacatccatatattttaatcaaatgatagtttttaggttttcattacatgtggtttacaacacatatttttctaaataagctagtcttatatttgcacagggggtccggtctaaggggaaaaaggctcagaattgtttgtcgtcttatagcattcaattcgacaaagaaccataaaaaatgcagccacatcaaaacttgcctgataaaagaattttcatcaacgaaaaactaatttacaagtaaagtccgtgggtgaaaatggagtgtccagatgagatgggacaaaatgaaaagagagaaaaaaaagttgacgttagcaccctaagcccagaaaaggccgaattgcagatccacgaaaggcgccataacccagcccatccatatgctatgggccatgatctcagcctatccaaataaggcccaagtaaaataatctgtccgtaccagcccacgaatagcccacgaactatccaaaggcagtagagcccttcgcctcccggccgcctcgacgcatcgacgacgccggcgaccaggagatcccgcggccatgccgccgccgccgccgccgcatcccctcccctcaccatgccgccgacgccgctgcatcttgctcctcctgctctccaggctgctgctctcttcagcaagcaggt

SEQ ID NO: 20397 - DNA, 252 bp, Oryza sativa
taaggactaaataatcaaattttgaagagcatgtgcctcaccttgaagtaagtgaagcatagcagtatacgctagctaacagcctgcacctcccagtgccatgtttctccatcactaagcaagttacttttctttccagaatccaagcaaccaaaaagacaagttcagtttcttcatattgctgccatagtagtagcctcattctgcagtaaacagcacaagatactggaagggtgtcaataagagggggca

SEQ ID NO: 20398 - DNA, 1501 bp, Oryza sativa
atactgaagtctattatctaattcaaaattgtacctttgttatatttctcaaagtgcaaaattttctggtttcaatttctaaataaagcatttcttcgaacaaaattgcaagccagccagctgccaaaatctatttttggtgacaactcatcaggaaccaaacagagttctgtactgttggttctacaatttggttgatcttgttaatgttgggctagacataccagtataatagcacaagcaataactaggaaattatttgcaagctgaatgcaacttctttaccatatgagtgaattgcattggtggtacatgaacttgtttggtgggtgcaatctagtggatgaacttggcaaacactcgttttagtgcaaagacttgtctagtgtgtgcgaaccaaggccaaaaggacacgacaaggccaattttaccaagtttatgctgattaagacgtaatgtgtacatgtcaagtgggcatgcatgaaacatgctatatttactttatccttctatgtatctaacccttgcatcattcctcggtttttcatgtcttctatgtatataaacaagaaaggaagtgctatagagcatagattcagaaaaacaatttggtttacttattttacaacaattcatctaaaaatcaatatattttatagatcatagaagaactacctcaatgatgaatgtcataatgaacctcattcttcaaacaaatataagcagtaatgtttatccagatagttgttaagggcaaaaaatttatacggacctgaaaaattagagatggaacccattctggctcttcaacagtattatccatattgatgtacatttctgcactcagacgggtgtcatcatcttccgtgaatataagatcaagggcgtgctgtctgcagaaactatctttaagtttatccacaatacgttgcagcttctttttccattctcgctgctctgctacacggttttgcctgtctacactttttttacgaatatcattcacaccagtatggtttacagacgacaacttcatagctgctctaggtagcaactcttcagctagtaaggatgcattagcgaacaatgctagctgctgctcctcagtctctgccactcgaacaatcttatttcctaaaccttccaaattcgcttcatcatccagtgagtgtggcagagcacttatgagcagattgacatatgaattgaatattttcagaagcccgtccattgcagaaccacctaactgcaagctatgcagtgggccaacatcctcaaagaaatcctgcaaaataatacagtaaaacattaaaagaataactttatgtataaatcctcaattacaaaggctagaaacatttgtcaagcaatagaacattacctgaaccattgaactgaagcgatggccactgtttgagagcttaggttggagcaacaaactactagcagatgatctagcaaacgtccgtataccagatggaggataggtgagtacccagtc

SEQ ID NO: 20399 - DNA, 305 bp, Oryza sativa
acgaagtttacatgcgaataaaaaattcatttttttggaaaaacagttgcctcaaagaggtgaagttcatatgagcatgcatactgtgttggaccaaggcatataccataccaactcaatctgctagcatttgatctttgacttcgaacagctagctttaggagggaaaggaaaatgtgctcctcagctgacaaactcatccagcccaacgatttttattatgcagtcacttgtttagcatctgaggagctgcagtctggtcgcaactcatgtgcttctgtcacagatccgactttaccaatagc

SEQ ID NO: 20400 - DNA, 1019 bp, Oryza sativa
cagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagcca

SEQ ID NO: 20401 - DNA, 797 bp, Oryza sativa
ctccatttctgtttgatgattaatcctctgcccagttcttcactgacgaacgaacaagctcgccgccattgccaaaccaccttcttctttttcttcttcgcctcctcatcatccacgatcaggtccatttgggagatcaatgcgaaattgtgcagttgctgcgtcgttctggggcggaattgattgtgttcttcagtctatctaatccctattaatcgatcgttgagggtttgagatcggatttggcgatggcgattacgaaggttctcggatcgaaacctgccgactgcttccaatttcaagatcctaattcctggtacttcttcacctgtcgctcgtcctatcccctatcgtatctatccccaatcatctccttgttcatgtttgagacgctttgcgtgtgttcatctcctaaacgattcgttaacttctatatatatgtatatatatatttgccttcgttagggttcaatgtgatcctaacatatgacttgttgattgtgtccctgtagcgcacagactgcatggattttcttccatgaaaattcttcatttcaggttttttttttccaaaaaaaatatcgctatctttgatcaggttaagatgacagtaactcgatcataatacacctgtaagatgaacttaactttcagttttgaccgaatgtagcacataacagagaaaataaactgagatgtaaactttgacacattaacagaatagatgagcatatttgagatgaacagtgcagaatcttttgggtctctttcctgcactctgctagtggaattgcatg

SEQ ID NO: 20402 - DNA, 1501 bp, Oryza sativa
tactcagcaagccaggggaaataagtgtttaatgcaggtttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacgactgttcgaacagtttgttaacctctgcagagggggtacactttacccacacgacattactaacccggatcacccagcccgtggggatcagccacgtcgggagacctccaagctttcatgacaaggcatttccaaagccgacacaggcttaccttatgccgacgagaggggtcccagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttttgttcggatgaaattccaaggaatcggtccttaagtgcgggagcgggaaaaccgtacacccggtacgttccccggtccgcggttttagaaattcatttagttcacaagcaccgacccaggtgtcgggttttccaagtcttttgtaaaacccaagttttacccaagttgtttttcagattttaagtttgaaggcgactgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaatgggacaactcaacaaacggcgaaaataaagccttattaatgacctctaagcatgccattaggtagatctcgagatttggggaattttggaagttgaacggagtcaaacggatttacggcggggaagatattgaatttctaagattattggatttttggtctaaaggaaaaggatttaattaaatcctttttggaaaagataaagaaaagaaaagagggagggattatagacttttctcgggcggctagggcgcggcccgagaga

SEQ ID NO: 20403 - DNA, 184 bp, Oryza sativa
ccattatgcaatggattctatggagaatatccactaaggtcacatggctaccaaggaagtgagtgggagaaaaaacctgagactctcgatcgcaggtaacttcctaaatgcttgttatttagttggttccctgctgatgcttaccattgacctatagacatatttatcccattatatctacagg

SEQ ID NO: 20404 - DNA, 684 bp, Oryza sativa
ctatatattagttaatggccacagatttaccttaactgaaagtggaatatcagcaaccagctgtgcaacagcacccgcgccacccagcctgctcatgcttaaaacctaccaccatagaatcatgctctatcaaacaactaaaaacacaaaatgtggtttatgcttactagataatagcatagtgaaccaaacctttacttgcagcctcaggaatttcacataatcaaggatctcatctagcatagctgccctatctgtctgcatagttcaagaagacatcagagttatttcccccatagtcaacctctgatgttgcaatttacggaactctgtattatagtagtaaaatcacatgttattttaagcatgcatataaccctaaggatgcgctcttgcttatctcaaaagggacagcatactaagatttgatcgcatggttctcagtgaaccgaaacactcttttaaagaagaaaatttatattaaaaaagaattaatataatattgtgagcacatcatgacccaaaccacttgccaaaattttttcaatggctagcatgtgaaccacagaagtctttacccttataataaaacctaaaagtataacaaataatattaccttgtttgtattggggaccaattcctgtagggccctcatcctttctgctattctctctcttcttagc

SEQ ID NO: 20405 - DNA, 573 bp, Oryza sativa
cgagcgcgcggtccacctcccggaactccgcttgcagcgactccaccgcgcgggacacgtccgggtggaacgcagacgcgcgcgccgcacgcctgccgccccgcgaggcgggcgcggagcggggccacgcgacgagcggggagacggcggcggcggcgcccgtcatccctttcgctccgcttgggcagacgttatcctcgtccccgcgaaatgtttcgcctcccttaagcccagcctaatgcggccatgtgaagcgagaaatgggccgtggccgtctgatgaggcccattacgagagaatctgcttcggcccaggcccagcaacctagtagctctttcaaaaaggcgaaaccacccccaacggcgattggttgatggtgcgaagcaaagcatgcggggtaacacgccacacaatgcttgcactcaacgaaggctagctaagctaagcttaaatcattgcctcccactgctccgcttgctgcatgctgctctatatcacttgctgtgtcccggtgttttctctcatcaggatcaagctcgtctcgttgatcaatggcatcagacaagtgctcat

SEQ ID NO: 20406 - DNA, 1501 bp, Oryza sativa
caatttttctgtcacatcgttccaatttcaaccaaatttccaattttggtatgaactaaacacacccttagggcatgcacaaatgtagagtctaatatgagctctctatattaattaatgtcactagagactatcctcctataataatagagacaataagatttctaaaccattaatgcactaaatattttttttattatacttctttccttttttacaccctcatgcaacaaactttccgttaataaatgctaagagtcgactctgagccgttgcatgcgtagcaacgttgtttcttatttcttccatctctttcttccacatcatcaaatttacttgcatgacaacgaaaagagcccgttattagaaactattgcacatgcccttggtggacagatgtgatttgggacctccattctttaaagacgttaaaaactctttttatttaatttgtagattttatattttgcggtggagaaatagtaggaaacgtctgcttgataggtcgatgtcgtgggcacgcgggcacgggcgcgtcagctcggtttcggtttggagatgtgtcgggtcggaatagctagccccgccgtgcaaaacgtgcagtgttaagcagcaccactctctgttaatttgttcgtggccacacgctcgcgcgacgaccgttcgtcgcggatggcccagacacgatccaatactccatccctgacacttcagtacgagtacttgttcactgcactgaccagaccaaaccaaagcaacaatgaccaactgaccattccaatttcctctcgaccaccggcagaaacgaaatccaactgatgaacgtcaatgtgctcaaaaaagggggggaaaaaagctgatgaacgtgaacacaattagtacgattagtacctgctgatactggcgttgtgatagtgtctgcatgctctgctgactgctgatcaaacctgctgacgtgtaaatgctgacgtcacgaaaggagcagtacactagtgctccatcagcttagctagtgacgttctcctaaccgtccgtcgtcgatctctattcggtagatcggcgtatgactaaactaattggggaacaaacggagccatcgtttcggtgtatttgtgaacgaaaagtaatttatgaataaaaattttttatacgtgttcttagcaatatatttaaaagcaaaagctgacaaataaacttcaatgaaaaaaaccttaaaatcagctttaaatttaaggttaaaaatttaaattttggctgataagcataagtataaacgaaaagatgtggctctaaatttgtaaatcctaaaaaaagtgagaggacaaaaatataattgagattgaaaattgagacaaacaaattctccgattaataatactctaggttgtctctctacgtatatactccaattaatagtacatagcttgagagggacatcaaagactagtactaatacatgtttatgccttctagaagcttagcatgcatgtatttggccttt

SEQ ID NO: 20407 - DNA, 422 bp, Oryza sativa
agttgtagctgtctcatttggtgaagcttcagttctgatatttgatcacagctacaccccatgtactgaatctatgggaaacctcttcccttcccattgtatcgttagtgattttaaatcaaatgtactgcatttttccacggatgtgagaaaattggattcttctggaattggatgccatcgatccacaattgtagcgtctaaaaaaatgtcttcttgatgtttccgattcgtgtaatacttgtgatgcagccatttgcgttatagacattggactaatcttccattcttggcctgttcatttttccggtagcatcttggtgaagactgaaagtgattcacctggaaatgcagagatatgtgccagtcagtaacactctgtagattgtagacccatttttaattttggcgtggtgctaata

SEQ ID NO: 20408 - DNA, 1501 bp, Oryza sativa
tactgtctaaatatgtcactgattgttaggataactaatgctcaacatttaattttgaaaatatcaaacactcatattcaaaagaaaaagatatggttgtataattttatacgatattaacaaagtgcccgtagagtgagctataaatattaatcttggtggtttataaatatatacaatctagctactaaaaatttttttaggacaaagatcatatatttaaacattgtcaaataacatgttaagtaaaagtcactatatatccctacggcaataaaaacaataaaataaaaaataagatgtccatgcatgttttattccttcacatagcatcgagccaatcaagctgctaatgcaaagtttttttggttattatttatgcattgattgatgataatttgatctaggtgcgttagtaaattttcaattcctgtgttttctatgctccattgaaacattcgttcttttcaatactctactttacacatgtattattttcacacttttcaattttttttttcaatgctgtgttacaaaggaacctttaatttctttcaccgagagacaaagtcataacatttcataattgtaataacacaaattatgatagcttaaataagatgctcgcgcaaatgcgtgggctaccttcctagtttgtattaattaatatataaaaaacagaatacaactttaaggagttaactaagataaaatagaaatattaaggctagagttgaaacctaataacaaaatgtgatttcacatagagtgctcctcgccagtagacatgttgctcgaataaatatagcctctgagcgtcagccatggtccctgcaccatccccttatctaatgaatgatctctcctcccatcattccgttgctgatgagaagacatgaaggataagcggcgacggtggacattctgattccttcaagacgggatccatctttcaacgctgtaccgtccggtgttaacaaataagatcttaaacacctcgtagtgcggtgatacggtggggtcgaagacgatgcattctttgtcgaagaacccaaattatagctcgggttagtggcagggcaatagtggcaagctcacccacctccgagtggctgggttcaccacgaggagagagaaaagcaaaaggaggccgttacagtggcccatgatggtgggatttttttcacagaagtgctaaacatcagtcgactgaaaacctacctccaaatcttgcaaattttggttcactagatgtgcttcgtgattcatgctccagctgcttcttctccaactttgtcacacccagaaattcccgaatagatttccaaacagaatgtgcattaaaacccccgtctaggaccggctggggtacacaaatgacaaaattgacacacagattcacgtcttacaaacatcataaaagtcttacacaaatgcagcggaaaattgaaagataactggagctaagccttgacttggactgcagcgggaacaccactcc

SEQ ID NO: 20409 - DNA, 1501 bp, Oryza sativa
atatgttcaagaagtaatttaataaaatctaaaagtaatttgtaatttttcataaaaatatataatcatatgagatcttattataaagatttagttgttacggacataacggtgtaattgaatcgtagatcggatgagtaatttaagagaaaattttatttaaaacataggtgataggaatatattttctatacttgtttgatggactagtactatagttaagtagatttttctagtcatgtgatgcttcgtcactagttacaattaaaacgagatgctctagatttagattttacgaaaacttaagcacggtttaatatgcgatgggttgggacgggccttcgaccatactgggtccgccacttaatacgaggtggagcttgcacaaccgaataggtgggtgtggtgctatgtgcgtttttagattttcgttcgaatgaaagctcataggaacgcaaaaaagaatgtaggattctttttatttttgccaccttacacatgtattctctattcaaccatgaaaaaattgcacttaagagtaaatttgacctaacaacgtgtattgtagtctaagttgcacatgacatataactccatgtattatagccatatagtttcataaacccacaatcatcttaattttgatctatcaaattttttagttctacaatcaatttcttagctatttatcaatcatataaatgttacatctatgtaagtaatgttttttaaaatttgaaaatagatgttaaattggttaacggtgtggttttgtgaaactttagaatcataatacccgaggttacgtgtcatgtgctaaaattcctataattttgtaaaacttagactatagtaggtggggttttatgaaatttactcttgcaacttatcattttcaccactctttcgttagtgcatatctttcgtttgccatcactaataaatgtagttattaaaaacaaatttgtaatcaatgtcagttgaccgttaagtttgtccctaattaaacaaccactgttcccttgtaaaagttcaaaataaagtagcacttgaaattttaacatgtaccctaatattgtcaagaaaagtaaattatagcaacttaaaagatacttcctctggtttatattataagtcgctttgatttttcctcatcaaacttaatcaagtttgatcaactttatagaaaaatttagtaacatctaaaataccaaattagtttcattaaatctaacattgaatatattattttgataatatatatgttttgcgttgaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcct

SEQ ID NO: 20410 - DNA, 1501 bp, Oryza sativa
ttaaaaataattgtactgatttgaaagcgataccaacattacaaataattattgatcgttcagcgaaaccgtatactacgtctaactatggagaagatgactcaagtatcaggcagacttgaaaaggctttatacacactaaaaggccccatagaggcttgagtagaattgcacatgagcaattgagcatggagagcgtccaaagatatagcgcacaaaaagatcgcaacaaaaaggagaaacaaacgttgagttaaaatgtaaggaccatttaagaaacaaaaggcattacacaaatactgctaaacctacgtttgggtgtactgatatgagcactcgtcatttagagtaaattcacacttgaaagccaaactctttaaaatatagatgcaggattaactcgtcatgttaattcacacttggaaaacatgtgagtattaaaaccggtgagtttttttcggtaacatgcaaataaatcacgagttgacaaaaatcactcaattgtccttgctgtagattctcacgatttgtccacaaactcagtgacctccaggcatttgagacaaacttactctaaaaatggcttaaaccataaaattttgcaaacacctaaaccacaataaatttattccatgtctgcaacaacagcattcagtgcatcaccagtccaaaggtatcagtggagttgtcgccaaacagacttgaatagctagcaaatggtgatgttgcatacaaaagggtgtttttttttttgagttgtgattcaaattcatttgcacataataaccatcgccggaggcttgggctggagcgaagcggagaatcgttattcttttagggtttcaccttcgtatactttcatgagttcagttgagaatccatttggtcgatggaaccattttaatcacaagatggcaaattctgctttctctttcccttgaaagaaagtccatgtccctgcaaagtgcagaatcagaacaccaatgattgataagtgtgttcatgctgaaattgaaaggaaaagtttagagtttagttgactacatgaataaatcttctatattttagaaggagaaacatatgggtagcaaacttaatcaattgcaatgacatcagattcgtcaaccagaagggcccaatctctagctattgtgacattctcctttcccttcttgtggccactaccggaagtggattttgatccctcgaggggatatccactcgttgtttgcatgttatttaaatggctatgaagaaaattaaaaaaaattaagaaaatgtattaacatgtgatataccactccataaacatgcaagtaaaaattcaactcctacatcttacaacaaaaaaaataaatttgactctgaatatacgttaactagctgcggtttaatttgtttttttgttacgagatgtaggctgtgtttagttcagcgcaaagtttggattttggttgaaattggagatgatgtgattgaaaagttgtgtgtgtatgacagg
